US012545960B2

(12) United States Patent
Rabinowitz et al.

(10) Patent No.: US 12,545,960 B2
(45) Date of Patent: *Feb. 10, 2026

(54) METHODS FOR SIMULTANEOUS AMPLIFICATION OF TARGET LOCI

(71) Applicant: Natera, Inc., San Carlos, CA (US)

(72) Inventors: Matthew Rabinowitz, San Francisco, CA (US); Matthew Hill, Belmont, CA (US); Bernhard Zimmermann, Manteca, CA (US); George Gemelos, Portland, OR (US); Johan Baner, San Francisco, CA (US); Milena Banjevic, Los Altos Hills, CA (US); Allison Ryan, Belmont, CA (US); Styrmir Sigurjonsson, San Jose, CA (US); Zachary Demko, San Francisco, CA (US)

(73) Assignee: Natera, Inc., San Carlos, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 19/028,873

(22) Filed: Jan. 17, 2025

(65) Prior Publication Data

US 2025/0171850 A1 May 29, 2025

Related U.S. Application Data

(60) Continuation of application No. 18/126,344, filed on Mar. 24, 2023, which is a continuation of application No. 17/018,966, filed on Sep. 11, 2020, now Pat. No. 11,939,634, which is a division of application No. 16/140,298, filed on Sep. 24, 2018, now abandoned, which is a continuation of application No. 14/918,544, filed on Oct. 20, 2015, now Pat. No. 10,316,362, which is a continuation-in-part of application No. 14/877,925, filed on Oct. 7, 2015, now abandoned, and a continuation-in-part of application No. 14/692,703, filed on Apr. 21, 2015, now Pat. No. 10,179,937, and a continuation-in-part of application No. 14/538,982, filed on Nov. 24, 2014, now Pat. No. 9,677,118, said application No. 14/877,925 is a continuation-in-part of application No. 14/225,356, filed on Mar. 25, 2014, now abandoned, and a continuation-in-part of application No. 13/780,022, filed on Mar. 28, 2013, now abandoned, and a continuation of application No. 13/683,604, filed on Nov. 21, 2012, now abandoned, said application No. 14/225,356 is a continuation-in-part of application No. PCT/US2012/058578, filed on Oct. 3, 2012, said application No. 13/780,022 is a continuation-in-part of application No. 13/683,604, filed on Nov. 21, 2012, now abandoned, and a continuation-in-part of application No. PCT/US2012/058578, filed on Oct. 3, 2012, and a continuation-in-part of application No. 13/335,043, filed on Dec. 22, 2011, now Pat. No. 10,113,196, and a continuation-in-part of application No. 13/300,235, filed on Nov. 18, 2011, now Pat. No. 10,017,812, and a continuation-in-part of application No. 13/110,685, filed on May 18, 2011, now Pat. No. 8,825,412, said application No. 13/683,604 is a continuation of application No. 13/300,235, filed on Nov. 18, 2011, now Pat. No. 10,017,812, and a continuation-in-part of application No. 13/110,685, filed on (Continued)

(51) Int. Cl.
| | |
|---|---|
| *C12Q 1/68* | (2018.01) |
| *C12Q 1/6809* | (2018.01) |
| *C12Q 1/6811* | (2018.01) |
| *C12Q 1/6844* | (2018.01) |
| *C12Q 1/6848* | (2018.01) |
| *C12Q 1/6851* | (2018.01) |
| *C12Q 1/6855* | (2018.01) |
| *C12Q 1/6869* | (2018.01) |
| *C12Q 1/6874* | (2018.01) |
| *C12Q 1/6883* | (2018.01) |

(52) U.S. Cl.
CPC ......... *C12Q 1/6883* (2013.01); *C12Q 1/6809* (2013.01); *C12Q 1/6811* (2013.01); *C12Q 1/6844* (2013.01); *C12Q 1/6848* (2013.01); *C12Q 1/6851* (2013.01); *C12Q 1/6855* (2013.01); *C12Q 1/6869* (2013.01); *C12Q 1/6874* (2013.01); *C12Q 2600/156* (2013.01)

(58) Field of Classification Search
None
See application file for complete search history.

(56) References Cited

U.S. PATENT DOCUMENTS 6,156,504 A * 12/2000 Gocke .................. C07K 14/82
536/24.33
6,440,706 B1  8/2002 Vogelstein et al.
(Continued)

FOREIGN PATENT DOCUMENTS

CN      1650032 A    8/2005
CN    102892901 A    1/2013
(Continued)

OTHER PUBLICATIONS

US 8,501,409 B2, 08/2013, Simen (withdrawn)
(Continued)

*Primary Examiner* — Stephanie K Mummert

(57) ABSTRACT

The invention provides methods for simultaneously amplifying multiple nucleic acid regions of interest in one reaction volume as well as methods for selecting a library of primers for use in such amplification methods. The invention also provides library of primers with desirable characteristics, such as minimal formation of amplified primer dimers or other non-target amplicons.

30 Claims, 58 Drawing Sheets

Specification includes a Sequence Listing.

Related U.S. Application Data

May 18, 2011, now Pat. No. 8,825,412, said application No. PCT/US2012/058578 is a continuation-in-part of application No. 13/300,235, filed on Nov. 18, 2011, now Pat. No. 10,017,812, said application No. 13/335,043 is a continuation-in-part of application No. 13/300,235, filed on Nov. 18, 2011, now Pat. No. 10,017,812, and a continuation-in-part of application No. 13/110,685, filed on May 18, 2011, now Pat. No. 8,825,412, said application No. 13/300,235 is a continuation-in-part of application No. 13/110,685, filed on May 18, 2011, now Pat. No. 8,825,412.

(60) Provisional application No. 62/148,173, filed on Apr. 15, 2015, provisional application No. 62/147,377, filed on Apr. 14, 2015, provisional application No. 62/146,188, filed on Apr. 10, 2015, provisional application No. 62/066,514, filed on Oct. 21, 2014, provisional application No. 61/994,791, filed on May 16, 2014, provisional application No. 61/987,407, filed on May 1, 2014, provisional application No. 61/682,245, filed on Apr. 21, 2014, provisional application No. 61/634,431, filed on Feb. 29, 2012, provisional application No. 61/675,020, filed on Jul. 24, 2012, provisional application No. 61/683,331, filed on Aug. 15, 2012, provisional application No. 61/542,508, filed on Oct. 3, 2011, provisional application No. 61/426,208, filed on Dec. 22, 2010, provisional application No. 61/571,248, filed on Jun. 23, 2011, provisional application No. 61/516,996, filed on Apr. 12, 2011, provisional application No. 61/448,547, filed on Mar. 2, 2011, provisional application No. 61/462,972, filed on Feb. 9, 2011, provisional application No. 61/398,159, filed on Jun. 21, 2010, provisional application No. 61/395,850, filed on May 18, 2010.

(56) References Cited

U.S. PATENT DOCUMENTS

| | | |
|---|---|---|
| 6,479,235 B1 | 11/2002 | Schumm et al. |
| 6,605,451 B1 | 8/2003 | Marmaro et al. |
| 6,617,137 B2 | 9/2003 | Dean et al. |
| 6,664,056 B2 | 12/2003 | Lo et al. |
| 6,720,140 B1 | 4/2004 | Hartley et al. |
| 6,807,491 B2 | 10/2004 | Pavlovic et al. |
| 6,852,487 B1 | 2/2005 | Barany et al. |
| 6,858,412 B2 | 2/2005 | Willis et al. |
| 6,927,028 B2 | 8/2005 | Dennis et al. |
| 6,964,847 B1 | 11/2005 | Englert |
| 7,035,739 B2 | 4/2006 | Schadt et al. |
| 7,058,517 B1 | 6/2006 | Denton et al. |
| 7,058,616 B1 | 6/2006 | Larder et al. |
| 7,101,663 B2 | 9/2006 | Godfrey et al. |
| 7,153,656 B2 | 12/2006 | Nolan et al. |
| 7,218,764 B2 | 5/2007 | Vaisberg et al. |
| 7,297,485 B2 | 11/2007 | Bornarth et al. |
| 7,332,277 B2 | 2/2008 | Dhallan |
| 7,410,764 B2 | 8/2008 | Gocke et al. |
| 7,414,118 B1 | 8/2008 | Mullah et al. |
| 7,442,506 B2 | 10/2008 | Dhallan |
| 7,459,273 B2 | 12/2008 | Jones et al. |
| 7,537,897 B2 | 5/2009 | Brenner et al. |
| 7,645,576 B2 | 1/2010 | Lo et al. |
| 7,655,399 B2 | 2/2010 | Cantor et al. |
| 7,700,325 B2 | 4/2010 | Cantor et al. |
| 7,718,367 B2 | 5/2010 | Lo et al. |
| 7,718,370 B2 | 5/2010 | Dhallan |
| 7,727,720 B2 | 6/2010 | Dhallan |
| 7,741,463 B2 | 6/2010 | Gormley et al. |
| 7,785,798 B2 | 8/2010 | Cantor et al. |
| 7,790,393 B2 | 9/2010 | Lyamichev et al. |
| 7,790,418 B2 | 9/2010 | Mayer |
| 7,805,282 B2 | 9/2010 | Casey |
| 7,838,647 B2 | 11/2010 | Hahn et al. |
| 7,888,017 B2 | 2/2011 | Quake et al. |
| 7,981,609 B2 | 7/2011 | Rubin et al. |
| 8,008,018 B2 | 8/2011 | Quake et al. |
| 8,024,128 B2 | 9/2011 | Rabinowitz et al. |
| 8,133,719 B2 | 3/2012 | Drmanac et al. |
| 8,137,912 B2 | 3/2012 | Kapur et al. |
| 8,168,389 B2 | 5/2012 | Shoemaker et al. |
| 8,173,370 B2 | 5/2012 | Oeth et al. |
| 8,195,415 B2 | 6/2012 | Fan et al. |
| 8,236,503 B2 | 8/2012 | Faham et al. |
| 8,296,076 B2 | 10/2012 | Fan et al. |
| 8,304,187 B2 | 11/2012 | Fernando |
| 8,318,430 B2 | 11/2012 | Chuu et al. |
| 8,318,434 B2 | 11/2012 | Cuppens |
| 8,323,897 B2 | 12/2012 | Andersen et al. |
| 8,372,584 B2 | 2/2013 | Shoemaker et al. |
| 8,450,063 B2 | 5/2013 | Dube et al. |
| 8,467,976 B2 | 6/2013 | Lo et al. |
| 8,515,679 B2 | 8/2013 | Rabinowitz et al. |
| 8,532,930 B2 | 9/2013 | Rabinowitz et al. |
| 8,586,310 B2 | 11/2013 | Mitra et al. |
| 8,609,338 B2 | 12/2013 | Mitchell et al. |
| 8,679,741 B2 | 3/2014 | Hoyal-Wrightson et al. |
| 8,682,592 B2 | 3/2014 | Rabinowitz et al. |
| 8,703,652 B2 | 4/2014 | Quake et al. |
| 8,706,422 B2 | 4/2014 | Lo et al. |
| 8,748,103 B2 | 6/2014 | Faham et al. |
| 8,822,153 B2 | 9/2014 | Hayes et al. |
| 8,825,412 B2 | 9/2014 | Rabinowitz et al. |
| 9,051,602 B2 | 6/2015 | Oliphant et al. |
| 9,085,798 B2 | 7/2015 | Chee |
| 9,206,475 B2 | 12/2015 | Gerdes et al. |
| 9,228,234 B2 | 1/2016 | Rabinowitz et al. |
| 9,323,888 B2 | 4/2016 | Rava et al. |
| 9,364,829 B2 | 6/2016 | Heid et al. |
| 9,404,150 B2 | 8/2016 | Lee et al. |
| 9,424,392 B2 | 8/2016 | Rabinowitz et al. |
| 9,447,453 B2 | 9/2016 | Rava et al. |
| 9,453,257 B2 | 9/2016 | Hoyal-Wrightson et al. |
| 9,476,095 B2 | 10/2016 | Vogelstein et al. |
| 9,487,829 B2 | 11/2016 | Vogelstein et al. |
| 9,493,828 B2 | 11/2016 | Rava et al. |
| 9,506,119 B2 | 11/2016 | Faham et al. |
| 9,677,118 B2 | 6/2017 | Zimmermann et al. |
| 9,784,742 B2 | 10/2017 | Benz et al. |
| 9,926,593 B2 | 3/2018 | Ehrich et al. |
| 9,957,558 B2 | 5/2018 | Leamon et al. |
| 10,017,812 B2 | 7/2018 | Rabinowitz et al. |
| 10,061,890 B2 | 8/2018 | Rabinowitz et al. |
| 10,081,839 B2 | 9/2018 | Rabinowitz et al. |
| 10,083,273 B2 | 9/2018 | Rabinowitz et al. |
| 10,174,369 B2 | 1/2019 | Rabinowitz et al. |
| 10,179,937 B2 | 1/2019 | Babiarz et al. |
| 10,227,652 B2 | 3/2019 | Rabinowitz et al. |
| 10,229,244 B2 | 3/2019 | Ghosh |
| 10,240,202 B2 | 3/2019 | Rabinowitz et al. |
| 10,260,096 B2 | 4/2019 | Rabinowitz et al. |
| 10,262,755 B2 | 4/2019 | Babiarz et al. |
| 10,266,893 B2 | 4/2019 | Rabinowitz et al. |
| 10,308,981 B2 | 6/2019 | Sparks et al. |
| 10,316,362 B2 | 6/2019 | Babiarz et al. |
| 10,351,906 B2 | 7/2019 | Zimmermann et al. |
| 10,360,096 B2 | 7/2019 | Morris et al. |
| 10,392,664 B2 | 8/2019 | Rabinowitz et al. |
| 10,522,242 B2 | 12/2019 | Rabinowitz et al. |
| 10,526,658 B2 | 1/2020 | Babiarz et al. |
| 10,538,814 B2 * | 1/2020 | Babiarz ............... C12Q 1/6844 |
| 10,557,172 B2 * | 2/2020 | Babiarz ............... C12Q 1/6874 |
| 10,597,709 B2 | 3/2020 | Zimmermann et al. |
| 10,731,220 B2 * | 8/2020 | Babiarz ............... C12Q 1/6855 |
| 11,111,545 B2 * | 9/2021 | Babiarz ............... C12Q 1/6869 |
| 11,130,995 B2 | 9/2021 | Quake et al. |
| 11,319,596 B2 | 5/2022 | Babiarz et al. |
| 11,332,793 B2 * | 5/2022 | Rabinowitz .......... C12Q 1/6858 |

(56) References Cited

U.S. PATENT DOCUMENTS

| | | | |
|---|---|---|---|
| 11,371,100 B2 | 6/2022 | Babiarz et al. | |
| 11,519,035 B2 | 12/2022 | Rabinowitz et al. | |
| 11,746,376 B2* | 9/2023 | Rabinowitz | G16B 10/00 |
| | | | 702/19 |
| 12,203,142 B2 | 1/2025 | Babiarz et al. | |
| 2002/0006622 A1 | 1/2002 | Bradley et al. | |
| 2002/0107640 A1 | 8/2002 | Ideker et al. | |
| 2002/0119478 A1 | 8/2002 | Umansky et al. | |
| 2002/0182622 A1 | 12/2002 | Nakamura et al. | |
| 2002/0197630 A1 | 12/2002 | Knapp et al. | |
| 2003/0044388 A1 | 3/2003 | Dennis et al. | |
| 2003/0077586 A1 | 4/2003 | Pavlovic et al. | |
| 2003/0087276 A1 | 5/2003 | Kopreski | |
| 2003/0101000 A1 | 5/2003 | Bader et al. | |
| 2003/0108900 A1 | 6/2003 | Oliphant et al. | |
| 2003/0119004 A1 | 6/2003 | Wenz et al. | |
| 2003/0138780 A1 | 7/2003 | Gill et al. | |
| 2003/0148301 A1 | 8/2003 | Aono et al. | |
| 2003/0211489 A1 | 11/2003 | Shen et al. | |
| 2003/0232348 A1 | 12/2003 | Jones et al. | |
| 2003/0232353 A1 | 12/2003 | Kennedy | |
| 2003/0235848 A1 | 12/2003 | Neville et al. | |
| 2004/0009518 A1 | 1/2004 | Lo et al. | |
| 2004/0033596 A1 | 2/2004 | Threadgill et al. | |
| 2004/0067493 A1 | 4/2004 | Matsuzaki et al. | |
| 2004/0096874 A1 | 5/2004 | Neville et al. | |
| 2004/0126760 A1 | 7/2004 | Broude | |
| 2004/0137470 A1 | 7/2004 | Dhallan | |
| 2004/0146866 A1 | 7/2004 | Fu | |
| 2004/0157243 A1 | 8/2004 | Huang et al. | |
| 2004/0185495 A1 | 9/2004 | Schueler et al. | |
| 2004/0197797 A1 | 10/2004 | Inoko et al. | |
| 2004/0209299 A1 | 10/2004 | Pinter et al. | |
| 2004/0229231 A1 | 11/2004 | Frudakis et al. | |
| 2004/0236518 A1 | 11/2004 | Pavlovic et al. | |
| 2005/0043894 A1 | 2/2005 | Fernandez | |
| 2005/0049793 A1 | 3/2005 | Paterlini-Brechot | |
| 2005/0053950 A1 | 3/2005 | Zudaire Ubani et al. | |
| 2005/0064476 A1 | 3/2005 | Huang et al. | |
| 2005/0079521 A1 | 4/2005 | Beaulieu et al. | |
| 2005/0123914 A1 | 6/2005 | Katz et al. | |
| 2005/0130173 A1 | 6/2005 | Leamon et al. | |
| 2005/0142577 A1 | 6/2005 | Jones et al. | |
| 2005/0164241 A1 | 7/2005 | Hahn et al. | |
| 2005/0164252 A1 | 7/2005 | Yeung | |
| 2005/0216207 A1 | 9/2005 | Kermani | |
| 2005/0221341 A1 | 10/2005 | Shimkets et al. | |
| 2005/0227263 A1 | 10/2005 | Green et al. | |
| 2005/0250111 A1 | 11/2005 | Xie et al. | |
| 2005/0255508 A1 | 11/2005 | Casey | |
| 2005/0282185 A1 | 12/2005 | Lo Yuk-Ming et al. | |
| 2006/0014179 A1 | 1/2006 | Roberts | |
| 2006/0019278 A1 | 1/2006 | Lo et al. | |
| 2006/0046258 A1 | 3/2006 | Lapidus et al. | |
| 2006/0052945 A1 | 3/2006 | Rabinowitz et al. | |
| 2006/0057618 A1 | 3/2006 | Piper et al. | |
| 2006/0068394 A1 | 3/2006 | Langmore et al. | |
| 2006/0088871 A1 | 4/2006 | Finkelstein et al. | |
| 2006/0088912 A1 | 4/2006 | Yan et al. | |
| 2006/0094010 A1 | 5/2006 | Giles et al. | |
| 2006/0099614 A1 | 5/2006 | Gill et al. | |
| 2006/0121452 A1 | 6/2006 | Dhallan | |
| 2006/0134662 A1 | 6/2006 | Pratt et al. | |
| 2006/0210997 A1 | 9/2006 | Myerson et al. | |
| 2006/0216738 A1 | 9/2006 | Wada et al. | |
| 2006/0228721 A1 | 10/2006 | Leamon et al. | |
| 2006/0229823 A1 | 10/2006 | Liu et al. | |
| 2006/0234264 A1 | 10/2006 | Hardenbol | |
| 2006/0263789 A1 | 11/2006 | Kincaid | |
| 2006/0281105 A1 | 12/2006 | Li et al. | |
| 2006/0292599 A1 | 12/2006 | Ritz et al. | |
| 2007/0020640 A1 | 1/2007 | McCloskey et al. | |
| 2007/0027636 A1 | 2/2007 | Rabinowitz | |
| 2007/0031857 A1 | 2/2007 | Makarov et al. | |
| 2007/0037166 A1 | 2/2007 | Wohlgemuth et al. | |
| 2007/0042384 A1 | 2/2007 | Li et al. | |
| 2007/0059700 A1 | 3/2007 | Tao et al. | |
| 2007/0059707 A1 | 3/2007 | Cantor et al. | |
| 2007/0122805 A1 | 5/2007 | Cantor et al. | |
| 2007/0128624 A1 | 6/2007 | Gormley et al. | |
| 2007/0134658 A1 | 6/2007 | Bohmer | |
| 2007/0178478 A1 | 8/2007 | Dhallan et al. | |
| 2007/0178501 A1 | 8/2007 | Rabinowitz et al. | |
| 2007/0184467 A1 | 8/2007 | Rabinowitz et al. | |
| 2007/0202525 A1 | 8/2007 | Quake et al. | |
| 2007/0202536 A1 | 8/2007 | Yamanishi et al. | |
| 2007/0207466 A1 | 9/2007 | Cantor et al. | |
| 2007/0212689 A1 | 9/2007 | Bianchi et al. | |
| 2007/0231823 A1 | 10/2007 | McKernan et al. | |
| 2007/0243549 A1 | 10/2007 | Bischoff | |
| 2007/0259351 A1 | 11/2007 | Chinitz et al. | |
| 2008/0020390 A1 | 1/2008 | Mitchell et al. | |
| 2008/0026390 A1 | 1/2008 | Stoughton et al. | |
| 2008/0038733 A1 | 2/2008 | Bischoff et al. | |
| 2008/0050739 A1 | 2/2008 | Stoughton et al. | |
| 2008/0070792 A1 | 3/2008 | Stoughton et al. | |
| 2008/0071076 A1 | 3/2008 | Hahn et al. | |
| 2008/0085836 A1 | 4/2008 | Kearns et al. | |
| 2008/0090239 A1 | 4/2008 | Shoemaker et al. | |
| 2008/0096766 A1 | 4/2008 | Lee | |
| 2008/0102455 A1 | 5/2008 | Poetter | |
| 2008/0161420 A1 | 7/2008 | Shuber | |
| 2008/0193927 A1 | 8/2008 | Mann et al. | |
| 2008/0220422 A1 | 9/2008 | Shoemaker et al. | |
| 2008/0234142 A1 | 9/2008 | Lietz | |
| 2008/0243398 A1 | 10/2008 | Rabinowitz et al. | |
| 2008/0280292 A1 | 11/2008 | Wangh et al. | |
| 2008/0286783 A1 | 11/2008 | Hosono et al. | |
| 2008/0293589 A1 | 11/2008 | Shapero | |
| 2008/0299562 A1 | 12/2008 | Oeth et al. | |
| 2008/0305473 A1* | 12/2008 | Chowdary | A61P 35/00 |
| | | | 536/25.4 |
| 2009/0023190 A1 | 1/2009 | Lao et al. | |
| 2009/0029377 A1 | 1/2009 | Lo et al. | |
| 2009/0053719 A1 | 2/2009 | Lo et al. | |
| 2009/0087847 A1 | 4/2009 | Lo et al. | |
| 2009/0099041 A1 | 4/2009 | Church et al. | |
| 2009/0105959 A1 | 4/2009 | Braverman et al. | |
| 2009/0176662 A1 | 7/2009 | Rigatti et al. | |
| 2009/0233802 A1 | 9/2009 | Bignell et al. | |
| 2009/0253183 A1 | 10/2009 | Han | |
| 2009/0263800 A1 | 10/2009 | Wohlgemuth et al. | |
| 2010/0035232 A1 | 2/2010 | Ecker et al. | |
| 2010/0041048 A1 | 2/2010 | Diehl et al. | |
| 2010/0086914 A1 | 4/2010 | Bentley et al. | |
| 2010/0105049 A1 | 4/2010 | Ehrich et al. | |
| 2010/0112575 A1 | 5/2010 | Fan et al. | |
| 2010/0112586 A1 | 5/2010 | Stoughton et al. | |
| 2010/0112590 A1 | 5/2010 | Lo et al. | |
| 2010/0120038 A1 | 5/2010 | Mir et al. | |
| 2010/0124751 A1 | 5/2010 | Quake et al. | |
| 2010/0129792 A1 | 5/2010 | Makrigiorgos | |
| 2010/0129874 A1 | 5/2010 | Mitra et al. | |
| 2010/0138165 A1 | 6/2010 | Fan et al. | |
| 2010/0171954 A1 | 7/2010 | Quake et al. | |
| 2010/0173394 A1 | 7/2010 | Colston, Jr. et al. | |
| 2010/0184043 A1 | 7/2010 | Mitchell et al. | |
| 2010/0184069 A1 | 7/2010 | Fernando et al. | |
| 2010/0184152 A1 | 7/2010 | Sandler et al. | |
| 2010/0196892 A1 | 8/2010 | Quake et al. | |
| 2010/0203538 A1 | 8/2010 | Dube et al. | |
| 2010/0216145 A1 | 8/2010 | Duvdevani | |
| 2010/0216151 A1 | 8/2010 | Lapidus et al. | |
| 2010/0216153 A1 | 8/2010 | Lapidus et al. | |
| 2010/0227329 A1 | 9/2010 | Cuppens | |
| 2010/0248231 A1 | 9/2010 | Wei et al. | |
| 2010/0255492 A1 | 10/2010 | Quake et al. | |
| 2010/0256013 A1 | 10/2010 | Quake et al. | |
| 2010/0273159 A1 | 10/2010 | Melo et al. | |
| 2010/0273219 A1 | 10/2010 | May et al. | |
| 2010/0273678 A1 | 10/2010 | Alexandre et al. | |
| 2010/0285478 A1 | 11/2010 | Chen et al. | |
| 2010/0285537 A1 | 11/2010 | Zimmermann | |
| 2010/0291572 A1 | 11/2010 | Stoughton et al. | |

(56) References Cited

U.S. PATENT DOCUMENTS

| | | |
|---|---|---|
| 2010/0291635 A1 | 11/2010 | Peleg |
| 2010/0323352 A1 | 12/2010 | Lo et al. |
| 2011/0015096 A1 | 1/2011 | Chiu |
| 2011/0033862 A1 | 2/2011 | Rabinowitz et al. |
| 2011/0039724 A1 | 2/2011 | Lo et al. |
| 2011/0045462 A1 | 2/2011 | Fu et al. |
| 2011/0086769 A1 | 4/2011 | Oliphant et al. |
| 2011/0105353 A1 | 5/2011 | Lo et al. |
| 2011/0130558 A1 | 6/2011 | Ritt et al. |
| 2011/0151442 A1 | 6/2011 | Fan et al. |
| 2011/0159499 A1 | 6/2011 | Hindson et al. |
| 2011/0160078 A1 | 6/2011 | Fodor et al. |
| 2011/0178719 A1 | 7/2011 | Rabinowitz et al. |
| 2011/0189677 A1 | 8/2011 | Adli et al. |
| 2011/0201507 A1 | 8/2011 | Rava et al. |
| 2011/0212446 A1 | 9/2011 | Wang et al. |
| 2011/0212846 A1 | 9/2011 | Spier |
| 2011/0224087 A1 | 9/2011 | Quake et al. |
| 2011/0230358 A1 | 9/2011 | Rava |
| 2011/0246083 A1 | 10/2011 | Fan et al. |
| 2011/0288780 A1 | 11/2011 | Rabinowitz et al. |
| 2011/0294699 A1 | 12/2011 | Lee et al. |
| 2011/0300608 A1 | 12/2011 | Ryan et al. |
| 2011/0301854 A1 | 12/2011 | Curry et al. |
| 2011/0312503 A1 | 12/2011 | Chuu et al. |
| 2011/0318734 A1 | 12/2011 | Lo et al. |
| 2012/0003635 A1 | 1/2012 | Lo et al. |
| 2012/0003637 A1 | 1/2012 | Lo et al. |
| 2012/0010085 A1 | 1/2012 | Rava et al. |
| 2012/0028814 A1 | 2/2012 | Toloue et al. |
| 2012/0034603 A1 | 2/2012 | Oliphant et al. |
| 2012/0034685 A1 | 2/2012 | Sparks et al. |
| 2012/0108460 A1 | 5/2012 | Quake et al. |
| 2012/0122701 A1 | 5/2012 | Ryan et al. |
| 2012/0135872 A1 | 5/2012 | Chuu et al. |
| 2012/0165203 A1 | 6/2012 | Quake et al. |
| 2012/0185176 A1 | 7/2012 | Rabinowitz et al. |
| 2012/0190020 A1 | 7/2012 | Oliphant et al. |
| 2012/0190021 A1 | 7/2012 | Oliphant et al. |
| 2012/0190557 A1 | 7/2012 | Oliphant et al. |
| 2012/0191358 A1 | 7/2012 | Oliphant et al. |
| 2012/0196754 A1 | 8/2012 | Quake et al. |
| 2012/0214678 A1 | 8/2012 | Rava et al. |
| 2012/0264121 A1 | 10/2012 | Rava et al. |
| 2012/0264618 A1 | 10/2012 | Nygren |
| 2012/0270212 A1 | 10/2012 | Rabinowitz et al. |
| 2012/0270739 A1 | 10/2012 | Rava et al. |
| 2012/0295810 A1 | 11/2012 | Quake et al. |
| 2012/0295819 A1 | 11/2012 | Leamon et al. |
| 2012/0315633 A1 | 12/2012 | Mantzaris et al. |
| 2013/0005585 A1 | 1/2013 | Anderson et al. |
| 2013/0017549 A1 | 1/2013 | Hong |
| 2013/0022973 A1 | 1/2013 | Hansen et al. |
| 2013/0024127 A1 | 1/2013 | Stuelpnagel et al. |
| 2013/0034546 A1 | 2/2013 | Rava et al. |
| 2013/0040375 A1 | 2/2013 | Sparks et al. |
| 2013/0059733 A1 | 3/2013 | Lo et al. |
| 2013/0060483 A1 | 3/2013 | Struble et al. |
| 2013/0073214 A1 | 3/2013 | Hyland et al. |
| 2013/0090250 A1 | 4/2013 | Sparks et al. |
| 2013/0116130 A1 | 5/2013 | Fu et al. |
| 2013/0123120 A1 | 5/2013 | Zimmermann et al. |
| 2013/0130923 A1 | 5/2013 | Ehrich et al. |
| 2013/0137587 A1 | 5/2013 | Van Eijk et al. |
| 2013/0143219 A1 | 6/2013 | Mitchell et al. |
| 2013/0157870 A1 | 6/2013 | Pushkarev et al. |
| 2013/0172211 A1 | 7/2013 | Oliphant et al. |
| 2013/0178373 A1 | 7/2013 | Rabinowitz et al. |
| 2013/0196862 A1 | 8/2013 | Rabinowitz et al. |
| 2013/0210644 A1 | 8/2013 | Stoughton et al. |
| 2013/0225422 A1 | 8/2013 | Rabinowitz et al. |
| 2013/0231252 A1 | 9/2013 | Mitchell et al. |
| 2013/0252824 A1 | 9/2013 | Rabinowitz et al. |
| 2013/0253369 A1 | 9/2013 | Rabinowitz et al. |
| 2013/0261004 A1 | 10/2013 | Ryan et al. |
| 2013/0274116 A1 | 10/2013 | Rabinowitz et al. |
| 2013/0288252 A1 | 10/2013 | Sparks et al. |
| 2013/0323731 A1 | 12/2013 | Lo et al. |
| 2013/0338933 A1 | 12/2013 | Deciu et al. |
| 2013/0344066 A1 | 12/2013 | Faham et al. |
| 2014/0032128 A1 | 1/2014 | Rabinowitz et al. |
| 2014/0038830 A1 | 2/2014 | Srinivasan et al. |
| 2014/0045181 A1 | 2/2014 | Lo et al. |
| 2014/0087385 A1 | 3/2014 | Rabinowitz et al. |
| 2014/0094373 A1 | 4/2014 | Zimmermann et al. |
| 2014/0100126 A1 | 4/2014 | Rabinowitz |
| 2014/0100134 A1 | 4/2014 | Rabinowitz et al. |
| 2014/0106975 A1 | 4/2014 | Stoughton et al. |
| 2014/0141981 A1 | 5/2014 | Zimmermann et al. |
| 2014/0154682 A1 | 6/2014 | Rabinowitz et al. |
| 2014/0162269 A1 | 6/2014 | Rabinowitz et al. |
| 2014/0186827 A1 | 7/2014 | Pieprzyk et al. |
| 2014/0193816 A1 | 7/2014 | Rabinowitz et al. |
| 2014/0206552 A1 | 7/2014 | Rabinowitz et al. |
| 2014/0227691 A1 | 8/2014 | May et al. |
| 2014/0227705 A1 | 8/2014 | Vogelstein et al. |
| 2014/0336060 A1 | 11/2014 | Rabinowitz et al. |
| 2015/0051087 A1 | 2/2015 | Rabinowitz et al. |
| 2015/0064695 A1 | 3/2015 | Katz et al. |
| 2015/0099673 A1 | 4/2015 | Fodor et al. |
| 2015/0147815 A1 | 5/2015 | Babiarz et al. |
| 2015/0218631 A1 | 8/2015 | Chuu et al. |
| 2015/0322507 A1 | 11/2015 | Zimmermann et al. |
| 2016/0369333 A1 | 12/2016 | Babiarz et al. |
| 2017/0011166 A1 | 1/2017 | Rabinowitz et al. |
| 2017/0107576 A1 | 4/2017 | Babiarz et al. |
| 2018/0171409 A1 | 6/2018 | Rabinowitz et al. |
| 2018/0298439 A1 | 10/2018 | Ryan et al. |
| 2018/0320239 A1 | 11/2018 | Babiarz et al. |
| 2018/0371531 A1 | 12/2018 | Quake et al. |
| 2019/0211376 A1 | 7/2019 | Quake et al. |
| 2019/0211399 A1 | 7/2019 | Rabinowitz et al. |
| 2019/0316184 A1 | 10/2019 | Zimmermann et al. |
| 2020/0126634 A1 | 4/2020 | Sigurjonsson et al. |
| 2020/0190591 A1 | 6/2020 | Rabinowitz et al. |
| 2020/0232036 A1 | 7/2020 | Rabinowitz et al. |
| 2020/0350034 A1 | 11/2020 | Rabinowitz |
| 2023/0042405 A1 | 2/2023 | Babiarz et al. |
| 2024/0309456 A1 | 9/2024 | Rabinowitz et al. |
| 2024/0318263 A1 | 9/2024 | Babiarz et al. |
| 2024/0392387 A1 | 11/2024 | Diehn et al. |
| 2025/0027169 A1 | 1/2025 | Babiarz et al. |
| 2025/0027170 A1 | 1/2025 | Babiarz et al. |
| 2025/0163516 A1 | 5/2025 | Babiarz |
| 2025/0171859 A1 | 5/2025 | Babiarz |

FOREIGN PATENT DOCUMENTS

| | | |
|---|---|---|
| EP | 1325963 B1 | 9/2006 |
| EP | 1524321 B1 | 7/2009 |
| EP | 2551356 A1 | 1/2013 |
| EP | 1524321 B2 | 7/2014 |
| EP | 2902500 A1 | 8/2015 |
| EP | 2315849 B1 | 11/2017 |
| EP | 3760730 A1 | 1/2021 |
| EP | 3760731 A1 | 1/2021 |
| EP | 3760732 A1 | 1/2021 |
| GB | 2488358 A | 8/2012 |
| JP | 2002530121 A | 9/2002 |
| JP | 2002300894 A | 10/2002 |
| JP | 2003521252 A | 7/2003 |
| JP | 2004502466 A | 1/2004 |
| JP | 2004121087 A | 4/2004 |
| JP | 2005514956 A | 5/2005 |
| JP | 2005160470 A | 6/2005 |
| JP | 2006254912 A | 9/2006 |
| JP | 2008263974 A | 11/2008 |
| JP | 2008271980 A | 11/2008 |
| JP | 2010509922 A | 4/2010 |
| JP | 2011516069 A | 5/2011 |
| JP | 2012085556 A | 5/2012 |
| JP | 2013509883 A | 3/2013 |
| WO | WO-2001007640 A2 | 2/2001 |
| WO | WO-2001057269 A2 | 8/2001 |

(56) References Cited

FOREIGN PATENT DOCUMENTS

| WO | WO-2001090419 | A2 | 11/2001 |
|---|---|---|---|
| WO | WO-2002004672 | A2 | 1/2002 |
| WO | WO-2002044411 | A1 | 6/2002 |
| WO | WO-2002070751 | A1 | 9/2002 |
| WO | WO-2003000919 | A2 | 1/2003 |
| WO | WO-2003031646 | A1 | 4/2003 |
| WO | WO-2003062441 | A1 | 7/2003 |
| WO | WO-2003018757 | A3 | 9/2003 |
| WO | WO-2003020974 | A3 | 9/2003 |
| WO | WO-2004051218 | A2 | 6/2004 |
| WO | WO-2004069849 | A2 | 8/2004 |
| WO | WO-2004070005 | A2 | 8/2004 |
| WO | WO-2004070007 | A2 | 8/2004 |
| WO | WO-2004078999 | A1 | 9/2004 |
| WO | WO-2004081183 | A2 | 9/2004 |
| WO | WO-2005003375 | A2 | 1/2005 |
| WO | WO-2005021793 | A1 | 3/2005 |
| WO | WO-2005023091 | A2 | 3/2005 |
| WO | WO-2005035725 | A2 | 4/2005 |
| WO | WO-2005090607 | A1 | 9/2005 |
| WO | WO-2005039389 | A3 | 11/2005 |
| WO | WO-2006110855 | A2 | 10/2006 |
| WO | WO-2007052006 | A1 | 5/2007 |
| WO | WO-2007057647 | A1 | 5/2007 |
| WO | WO-2007073171 | A2 | 6/2007 |
| WO | WO-2007075836 | A2 | 7/2007 |
| WO | WO-2007086935 | A2 | 8/2007 |
| WO | WO-2007092473 | A2 | 8/2007 |
| WO | WO-2007100911 | A2 | 9/2007 |
| WO | WO-2007062164 | A3 | 11/2007 |
| WO | WO-2007132167 | A2 | 11/2007 |
| WO | WO-2007140417 | A2 | 12/2007 |
| WO | WO-2007145612 | A1 | 12/2007 |
| WO | WO-2007147073 | A2 | 12/2007 |
| WO | WO-2007147074 | A2 | 12/2007 |
| WO | WO-2007147076 | A2 | 12/2007 |
| WO | WO-2007147079 | A2 | 12/2007 |
| WO | WO-2008024473 | A2 | 2/2008 |
| WO | WO-2008051928 | A2 | 5/2008 |
| WO | WO-2008059578 | A1 | 5/2008 |
| WO | WO-2008061213 | A1 | 5/2008 |
| WO | WO-2008079374 | A2 | 7/2008 |
| WO | WO-2008081451 | A2 | 7/2008 |
| WO | WO-2008115497 | A2 | 9/2008 |
| WO | WO-2008118988 | A1 | 10/2008 |
| WO | WO-2008135837 | A2 | 11/2008 |
| WO | WO-2008157264 | A2 | 12/2008 |
| WO | WO-2009009769 | A2 | 1/2009 |
| WO | WO-2009013492 | A1 | 1/2009 |
| WO | WO-2009013496 | A1 | 1/2009 |
| WO | WO-2009017784 | A2 | 2/2009 |
| WO | WO-2009019215 | A1 | 2/2009 |
| WO | WO-2009019455 | A2 | 2/2009 |
| WO | WO-2009030100 | A1 | 3/2009 |
| WO | WO-2009032779 | A2 | 3/2009 |
| WO | WO-2009032781 | A2 | 3/2009 |
| WO | WO-2009033178 | A1 | 3/2009 |
| WO | WO-2009036525 | A2 | 3/2009 |
| WO | WO-2009049889 | A1 | 4/2009 |
| WO | WO-2009064897 | A2 | 5/2009 |
| WO | WO-2009091934 | A1 | 7/2009 |
| WO | WO-2009092035 | A2 | 7/2009 |
| WO | WO-2009099602 | A1 | 8/2009 |
| WO | WO-2009100029 | A1 | 8/2009 |
| WO | WO-2009105531 | A1 | 8/2009 |
| WO | WO-2009117122 | A2 | 9/2009 |
| WO | WO-2009120808 | A2 | 10/2009 |
| WO | WO-2009145828 | A2 | 12/2009 |
| WO | WO-2010014920 | A1 | 2/2010 |
| WO | WO-2010017214 | A1 | 2/2010 |
| WO | WO-2010019588 | A1 | 2/2010 |
| WO | WO-2010033578 | A2 | 3/2010 |
| WO | WO-2010033639 | A2 | 3/2010 |
| WO | WO-2010042831 | A2 | 4/2010 |
| WO | WO-2010045617 | A2 | 4/2010 |
| WO | WO-2010075459 | A1 | 7/2010 |
| WO | WO-2010088288 | A2 | 8/2010 |
| WO | WO-2010115016 | A2 | 10/2010 |
| WO | WO-2010115154 | A1 | 10/2010 |
| WO | WO-2010118016 | A2 | 10/2010 |
| WO | WO-2010127186 | A1 | 11/2010 |
| WO | WO-2011015944 | A2 | 2/2011 |
| WO | WO-2011041485 | A1 | 4/2011 |
| WO | WO-2011051283 | A1 | 5/2011 |
| WO | WO-2011057061 | A1 | 5/2011 |
| WO | WO-2011057094 | A1 | 5/2011 |
| WO | WO-2011087760 | A2 | 7/2011 |
| WO | WO-2011090556 | A1 | 7/2011 |
| WO | WO-2011094646 | A1 | 8/2011 |
| WO | WO-2011102998 | A2 | 8/2011 |
| WO | WO-2011109440 | A1 | 9/2011 |
| WO | WO-2011118603 | A1 | 9/2011 |
| WO | WO-2011130751 | A1 | 10/2011 |
| WO | WO-2011140433 | A2 | 11/2011 |
| WO | WO-2011142836 | A2 | 11/2011 |
| WO | WO-2011146632 | A1 | 11/2011 |
| WO | WO-2011146942 | A1 | 11/2011 |
| WO | WO-2011153254 | A2 | 12/2011 |
| WO | WO-2012019200 | A2 | 2/2012 |
| WO | WO-2012028746 | A1 | 3/2012 |
| WO | WO-2012042374 | A2 | 4/2012 |
| WO | WO-2012071621 | A1 | 6/2012 |
| WO | WO-2012083189 | A2 | 6/2012 |
| WO | WO-2012083250 | A2 | 6/2012 |
| WO | WO-2012088456 | A2 | 6/2012 |
| WO | WO-2012092426 | A1 | 7/2012 |
| WO | WO-2012108920 | A1 | 8/2012 |
| WO | WO-2012122374 | A2 | 9/2012 |
| WO | WO-2012125848 | A2 | 9/2012 |
| WO | WO-2012142531 | A2 | 10/2012 |
| WO | WO-2013049892 | A1 | 4/2013 |
| WO | WO-2013177581 | A2 | 11/2013 |
| WO | WO-2014053664 | A1 | 4/2014 |
| WO | WO-2014055790 | A2 | 4/2014 |
| WO | WO-2024076469 | A1 | 4/2024 |

OTHER PUBLICATIONS

"Abstracts for CNAPS IV Circulating Nucleic Acids in Plasma/Serum," Fourth International Conference on Circulating Nucleic Acids in Plasma/Serum (CNAPS-IV), London, Sep. 4-6, 2005, 40 Pages.

Alkan C., et al., "Personalized Copy Number and Segmental Duplication Maps Using Next-Generation Sequencing," Nature Genetics, Oct. 2009, vol. 41, No. 10, pp. 1061-1068.

Amicucci P., et al., "Prenatal Diagnosis of Myotonic Dystrophy Using Fetal DNA Obtained from Maternal Plasma," Clinical Chemistry, 2000, vol. 46, No. 2, pp. 301-302.

Andras S.C., et al., "Strategies for Signal Amplification in Nucleic Acid Detection," Molecular Biotechnology, 2001, vol. 19, pp. 29-44.

Anker P., et al., "Circulating DNA in Plasma or Serum," Medicina, 2000, vol. 60, pp. 699-702, 10 Pages.

Anker P., et al., "The Second International Symposium on Circulating Nucleic Acids in Plasma and Serum (CNAPS-2) held in Conjunction with the 6th Annual Scientific Symposium of the Hong Kong Cancer Institute", Clinical Chemistry, Hong Kong, Feb. 20-21, 2001, vol. 47, No. 2, pp. 361-370.

Ansorge W.J., "Next-Generation DNA Sequencing Techniques," New Biotechnology, Feb. 2, 2009, vol. 25, No. 4, pp. 195-203, (Apr. 2009).

Arandjelovic M., et al., "Two-Step Multiplex Polymerase Chain Reaction improves the Speed and Accuracy of Genotyping Using DNA from Noninvasive and Museum Samples," Molecular Ecology Resources, 2009, vol. 9, pp. 28-36.

Avent N.D., et al., "Cell-free Fetal DNA in The Maternal Serum And Plasma: Current And Evolving Applications," Current Opinion in Obstretrics and Gynecology, Apr. 1, 2009, vol. 21, No. 2, pp. 175-179.

(56) References Cited

OTHER PUBLICATIONS

Avgidou K., et al., "Prospective First-trimester Screening for Trisomy 21 in 30,564 Pregnancies," American Journal of Obstetrics and Gynecology, 2005, vol. 192, pp. 1761-1767 (13 Pages).pp. 1761.
Ayala R., et al., "Long-Term Follow-Up of Donor Chimerism Tolerance After Human Liver Transplantation," Liver Transplantation, May 28, 2009, vol. 15, No. 6, pp. 581-591.
Balduini A., et al., "Utility of Biochemical Markers in The Follow-Up Heart Transplant Recipients," Transplantation Proceedings, Dec. 1, 2003, vol. 35, No. 8, pp. 3075-3078.
Bau S., et al., "Targeted Next-Generation Sequencing by Specific Capture of Multiple Genomic Loci using Low-Volume Microfluidic DNA Arrays," Analytical and Bioanalytical Chemistry, 2009, vol. 393, pp. 171-175.
Bauer M., et al., "A Prospective Analysis of Cell-Free Fetal DNA Concentration in Maternal Plasma as an Indicator for Adverse Pregnancy Outcome," Prenatal Diagnosis, 2006, vol. 26, pp. 831-836.
Baxter-Lowe L.A., et al., "Tracking Microchimeric DNA In Plasma To Diagnose And Manage Organ Transplant Rejection," Clinical Chemistry, Apr. 1, 2006, vol. 52, No. 4, pp. 559-561.
Beck J., et al., "Next Generation Sequencing of Serum Circulating Nucleic Acids from Patients with Invasive Ductal Breast Cancer Reveals Differences to Healthy and Nonmalignant Controls," Molecular Cancer Research, Mar. 1, 2010, vol. 8, No. 3, pp. 335-342, 9 Pages.
Beck J., et al., "Profile of the Circulating DNA in Apparently Healthy Individuals," Clinical Chemistry, 2009, vol. 55, No. 4, pp. 730-738.
Bender K., et al., "A Multiplex SNP Typing Approach For The DNA Pyrosequencing Technology," International Congress Series, Apr. 20, 2006, vol. 1288, pp. 73-75.
Bentley G., et al., "High-Resolution, High-throughput HLA Genotyping by Next-Generation Sequencing," Tissue Antigens, Nov. 1, 2009, vol. 74, No. 5, pp. 393-403.
Bergen A.W., et al., "Effects of DNA Mass on Multiple Displacement Whole Genome Amplification and Genotyping Performance," BMC Biotechnology, Sep. 16, 2005, vol. 5, No. 24, 11 Pages.
Bianchi D.W., "Circulating Fetal DNA: Its Origin and Diagnostic Potential—A Review," Placenta, May 2004, vol. 25, vol. 18, Supplemental A, S93-S101.
Bianchi D.W., et al., "Insights into Fetal and Neonatal Development Through Analysis of Cell-Free RNA in Body Fluids," Early Human Development, Nov. 2010, vol. 86, No. 11, pp. 747-752, 11 Pages.
Bianchi D.W., et al., "Integration of Noninvasive DNA Testing for Aneuploidy into Prenatal Care: What Has Happened Since the Rubber Met the Road?," Clinical Chemistry, Nov. 2013, vol. 60(1), pp. 78-87.
Binladen J., et al., "The Use of Coded PCR Primers Enables High-Throughput Sequencing of Multiple Homolog Amplification Products by 454 Parallel Sequencing," PLOS One, Feb. 2007, Issue No. 2, Article No. e197, 9 Pages.
Birch L., et al., "Accurate and Robust Quantification of Circulating Fetal and Total DNA in Maternal Plasma from 5 to 41 Weeks of Gestation," Clinical Chemistry, 2005, vol. 51, No. 2, pp. 312-320.
Bisignano A., et al., "PGD and Aneuploidy Screening for 24 Chromosomes: Advantages and Disadvantages of Competing Platforms," Reproductive BioMedicine Online, 2011, vol. 23, pp. 677-685.
Bordoni R., et al., "Evaluation of Human Gene Variant Detection in Amplicon Pools by the GS-FLX Parallel Pyrosequencer," BMC Genomics, Oct. 8, 2008, vol. 9, pp. 1-8 (8 Pages).
Brockman W., et al., "Quality Scores and SNP Detection in Sequencing-by-synthesis Systems," Genome Research, May 1, 2008, vol. 18, No. 5, pp. 763-770.
Broude N.E., et al., "High Multiplexity PCR Based on PCR Suppression," DNA Amplification Current Technologies and Applications, 2004, pp. 61-76.
Broude N.E., et al., "High-Level Multiplex DNA Amplification," Antisense & Nucleic Acid Drug Development, 2001, vol. 11, pp. 327-332.
Broude N.E., et al., "Multiplex Allele-Specific Target Amplification based on PCR Suppression," Proceedings of the National Academy of Sciences of the United States of America, Jan. 2, 2001, vol. 98, No. 1, pp. 206-211.
Bustamante-Aragones A., et al., "New Strategy for The Prenatal Detection/Exclusion of Paternal Cystic Fibrosis Mutations in Maternal Plasma," Journal of Cystic Fibrosis, Nov. 1, 2008, vol. 7, Issue 6, pp. 505-510.
Butt A.N., et al., "Overview of Circulating Nucleic Acids in Plasma/Serum: Update on Potential Prognostic and Diagnostic Value in Diseases Excluding Fetal Medicine and Oncology," Annals of the New York Academy of Sciences, 2008, vol. 1137, pp. 236-242.
Caliendo A.M., "Multiplex PCR and Emerging Technologies for the Detection of Respiratory Pathogens," Clinical Infectious Diseases, 2011, vol. 52, Supp. 4, pp. S326-S330.
Campbell P. J., et al., "Subclonal Phylogenetic Structures in Cancer Revealed by Ultra-Deep Sequencing," Proceedings of the National Academy of Sciences of the United States of America, Sep. 2, 2008, vol. 105, No. 35, pp. 13081-13086.
Casbon J.A., et al., "A Method for Counting PCR Template Molecules with Application to Next-generation Sequencing," Nucleic Acids Research, Apr. 13, 2011, vol. 39, No. 12, pp. 1-8.
Castleberry C.D., et al., "Quantification of Circulating Cell-Free DNA in Pediatric Heart Transplant Recipients," Journal of Heart and Lung Transplantation, Apr. 1, 2011 vol. 30, No. 4, p. S139, DOI: 10.1016/j.healun.2011.01.415, ISSN: 1053-2498.
Chan A.K.C., et al., "Cell-Free Nucleic Acids in Plasma, Serum and Urine: A New Tool in Molecular Diagnosis," Annals of Clinical Biochemistry, Mar. 1, 2003, vol. 40, Issue 2, pp. 122-130.
Chan K.C.A., et al., "Size Distributions of Maternal and Fetal DNA in Maternal Plasma," Clinical Chemistry, 2004, vol. 50, No. 1, pp. 88-92.
Chen C.P., et al., "Fetal DNA in Maternal Plasma: The Prenatal Detection of a Paternally Inherited Fetal Aneuploidy," Prenatal Diagnosis, 2000, vol. 20, pp. 353-357, 4 Pages.
Chen E.Z., et al., "Noninvasive Prenatal Diagnosis of Fetal Trisomy 18 and Trisomy 13 by Maternal Plasma DNA Sequencing," PLoS ONE, Jul. 6, 2011, vol. 6, Issue 7, e21791, pp. 1-7.
Chiu R.W.K., et al., "Effects of Blood-Processing Protocols on Fetal and Total DNA Quantification in Maternal Plasma," Clinical Chemistry, Sep. 2001, vol. 47, No. 9, pp. 1607-1613, PubMed PMID: 11514393.
Chiu R.W.K., et al., "Maternal Plasma DNA Analysis With Massively Parallel Sequencing by Litigation for Noninvasive Prenatal Diagnosis of Trisomy 21," Clinical Chemistry, 2010, vol. 56, No. 3, pp. 459-463.
Chiu R.W.K., et al., "Non-Invasive Prenatal Assessment of Trisomy 21 by Multiplexed Maternal Plasma DNA Sequencing: Large Scale Validity Study," BMJ, 2011, vol. 342, c7401, 9 Pages.
Chiu R.W.K., et al., "Non-Invasive Prenatal Diagnosis by Single Molecule Counting Technologies," Trends in Genetics, 2009, vol. 25, No. 7, pp. 324-331.
Chiu R.W.K., et al., "Noninvasive Prenatal Diagnosis of Fetal Chromosomal Aneuploidy by Massively Parallel Genomic Sequencing of DNA in Maternal Plasma (With Supporting Information)," Proceedings of the National Academy of Sciences, Dec. 23, 2008, vol. 105, No. 51,23 Pages.
Choi M., et al., "Genetic Diagnosis by Whole Exome Capture and Massively Parallel DNA Sequencing," Proceedings of the National Academy of Sciences, Nov. 10, 2009, vol. 106, No. 45, pp. 19096-19101.
Chu T., et al., "A Novel Approach Toward the Challenge of Accurately Quantifying Fetal DNA in Maternal Plasma," Prenatal Diagnosis, Nov. 11, 2010, vol. 30, pp. 1226-1229.
Chu T., et al., "Statistical Considerations for Digital Approaches to Non-Invasive Fetal Genotyping," Bioinformatics, Advance Access publication Sep. 23, 2010, vol. 26, No. 22, pp. 2863-2866.
Chu T., et al., "Statistical Model for Whole Genome Sequencing and its Application to Minimally Invasive Diagnosis of Fetal Genetic

(56) References Cited

OTHER PUBLICATIONS

Disease," Bioinformatics, Advance Access Publication Mar. 23, 2009, vol. 25, No. 10, pp. 1244-1250.
Colella S., et al., "QuantiSNP: an Objectives Bayes Hidden-Markov Model to Detect and Accurately Map Copy Number Variation Using SNP Genotyping Data," Nucleic Acids Research, 2007, vol. 35, No. 6, pp. 2013-2025.
Costa J-M., et al., "Fetal RHD Genotyping in Maternal Serum during the First Trimester of Pregnancy," British Journal of Haematology, 2002, vol. 119, pp. 255-260.
Craig D.W., et al., "Identification of Genetic Variants using Bar-Coded Multiplexed Sequencing," Nature Methods, Oct. 2008, vol. 5, No. 10, pp. 887-893.
Crespo-Leiro M.G., et al., "Gene Expression Profiling for Monitoring Graft Rejection in Heart Transplant Recipients," Transplantation Proceedings, Jul. 1, 2009, vol. 41, No. 6, pp. 2240-2243.
Croft D.T., Jr., et al., "Performance of Whole-Genome Amplified DNA Isolated from Serum and Plasma on High-Density Single Nucleotide Polymorphism Arrays," Journal of Molecular Diagnostics, May 2008, vol. 10, No. 3, pp. 249-257.
Cross J., et al., "Resolution of Trisomic Mosaicism in Prenatal Diagnosis: Estimated Performance of a 50k SNP Microarray," Prenatal Diagnosis, 2007, vol. 27, pp. 1197-1204.
Cummings, N., et al., "Combining Target Enrichment with Barcode Multiplexing for High-throughput SNP Discovery," BMC Genomics 2010, vol. 11 (641), pp. 1-8.
Dahl F., et al., "Multigene Amplification and Massively Parallel Sequencing for Cancer Mutation Discovery," Proceedings of the National Academy of Sciences of the United States of America, May 29, 2007, vol. 104, No. 22, pp. 9387-9392, DOI: 10.1073/pnas.0702165104. Epub: May 17, 2007.
Daniels G., et al., "Fetal Blood Group Genotyping from DNA from Maternal Plasma: An Important Advance in the Management and Prevention of Haemolytic disease of the Fetus and Newbornm," Vox Sanguinis, 2004, vol. 87, pp. 225-232.
Daruwala R-S., et al., "A Versatile Statistical Analysis Algorithm to Detect Genome Copy Number Variation," Proceedings of the National Academy of Sciences, Nov. 16, 2004, vol. 101, No. 46, pp. 16292-16297.
Deutsch S., et al., "Detection of Aneuploidies by Paralogous Sequence Quantification," Journal of Medical Genetics, 2004, vol. 41, pp. 908-915.
Devaney S.A., et al., "Noninvasive Fetal Sex Determination Using Cell-free Fetal DNA: A Systematic Review and Meta-analysis," JAMA, Aug. 10, 2011, vol. 306, No. 6, pp. 627-636.
Dhallan R., et al., "A Non-Invasive Test for Prenatal Diagnosis Based on Fetal DNA Present in Maternal Blood: A Preliminary Study," Lancet, Feb. 10, 2007, vol. 369, No. 9560, pp. 474-481.
Dhallan R., et al., "Methods to Increase the Percentage of Free Fetal DNA Recovered From the Maternal Circulation," JAMA, Mar. 3, 2004, vol. 291, No. 9, pp. 1114-1119.
Diehl F., et al., "Circulating Mutant DNA to Assess Tumor Dynamics," Nature Medicine, Sep. 2008, vol. 14, No. 9, pp. 985-990, Published Jul. 31, 2008.
Donaghue C., et al., "Detection of Mosaicism for Primary Trisomies in Prenatal Samples by QF-PCR and Karyotype Analysis," Prenatal Diagnosis, 2005, vol. 25, pp. 65-72.
Doostzadeh J., et al., "High Throughput Automated Allele Frequency Estimation by Pyrosequencing," PLoS ONE, Jul. 16, 2008, vol. 3, Issue. 7, e2693, pp. 1-4.
Ehrich M., et al., "Noninvasive Detection of Fetal Trisomy 21 by Sequencing of DNA in Maternal Blood: A Study in a Clinical Setting," American Journal of Obstetrics & Gynecology, Mar. 2011, vol. 204, pp. 205.e1-205.e11.
Ellonen P., et al., "Development of SNP Microarray for Supplementary Paternity Testing," International Congress Series, 2004, vol. 1261, pp. 12-14.
Erlich R.L., "Next-Generation Sequencing for HLA Typing of Class Loci," BMC Genomics, Jan. 18, 2011, vol. 12, No. 42, 13 Pages.

Eronen L., et al., "HaploRec: Efficient and Accurate Large-Scale Reconstruction of Haplotypes," BMC Bioinformatics, Dec. 22, 2006, vol. 7, No. 542, 18 Pages.
European Commission: "The 7th International Conference on Circulating Nucleic Acids in Plasma and Serum (CNAPS VII) in Madrid-Spain," The International Conference on Circulating Nucleic Acids in Plasma and Serum, Oct. 24-25, 2011,2 Pages.
Fan H.C., et al., "Detection of Aneuploidy with Digital Polymerase Chain Reaction," Analytical Chemistry, Oct. 1, 2007, vol. 79, No. 19, pp. 7576-7579.
Fan H.C., et al., "Sensitivity of Noninvasive Prenatal Detection of Fetal Aneuploidy from Maternal Plasma Using Shotgun Sequencing is Limited only by Counting Statistics," PLoS One, Mar. 2010, vol. 5, Issue 5 (e10439), pp. 1-6 (7 Pages), Published May 3, 2010.
Fan H.C., et al., "In Principle Method for Noninvasive Determination of the Fetal Genome," National Precisionss, 2010, 16 Pages.
Fan H.C., et al., "Microfluidic Digital PCR Enables Rapid Prenatal Diagnosis of Fetal Aneuploidy," American Journal of Obstetrics & Gynecology, May 2009, vol. 200, pp. 543e1-543e7.
Fan H.C., "Noninvasive Diagnosis of Fetal Aneuploidy by Shotgun Sequencing DNA from Maternal Blood," Proceedings of the National Academy of Sciences, USA, Oct. 21, 2008, vol. 105, No. 42, pp. 16266-16271, DOI: 10.1073/pnas.0808319105 Published Online (Oct. 6, 2008).
Fan J-B., et al., "Highly Parallel Genomic Assays," Nature Reviews, Aug. 2006, vol. 7, pp. 632-644.
Fan J-B., et al., "Highly Parallel SNP Genotyping," Cold Spring Harbor Symposia on Quantitative Biology, vol. LXVIII, Feb. 2003, pp. 69-78.
Fredriksson M., et al., "Assessing Hematopoietic Chimerism After Allogeneic Stem Cell Transplantation by Multiplexed SNP Genotyping Using Microarrays and Quantitive Analysis of SNP Alleles," Leukemia, Dec. 4, 2003, vol. 18, Issue 2, pp. 255-266.
Fredriksson S., et al., "Multiplex Amplification of All Coding Sequences Within 10 Cancer Genes by Gene-collector," Nucleic Acids Research, 2007, vol. 35, No. 7, Article e47, pp. 1-6.
Fu X-H., et al., "Advances on Circulating Fetal DNA In Maternal Plasma," Chinese Medical Journal, Jul. 2, 2007, vol. 120, No. 14, pp. 1256-1259.
Fu Y-W., et al., "Presence of Donor-and-recipient Derived DNA Microchimerism in The Cell-free Blood Samples of Renal Transplantation Recipients Associates with The Acceptance Of Transplanted Kidneys," Asian Journal of Andrology, Jul. 1, 2006, vol. 8, No. 4, pp. 477-482.
Gadi V.K., et al., "Soluble Donor DNA Concentrations in Recipient Serum Correlate with Pancreas-Kidney Rejection," Clinical Chemistry, 2006, vol. 52, No. 3, pp. 379-382.
Ganova-Raeva L.M., "Chapter 6—Primer Extension Enrichment Rection (PEER) and Other Methods for Difference Screening," Nucleic Acids Hybridization, 2007, pp. 125-165.
Gautier E., et al., "Fetal RhD Genotyping by Maternal Serum Analysis: A Two-Year Experience," American Journal of Obstetrics and Gynecology, 2005, vol. 192, pp. 666-669.
Geifman-Holtzman O., et al., "Prenatal Diagnosis: Update on Invasive Versus Noninvasive Fetal Diagnostic Testing From Maternal Blood," Expert Review of Molecular Diagnostics, Nov. 1, 2008, vol. 8, No. 6, pp. 727-751.
Ghanta S., et al., "Non-invasive Prenatal Detection of Trisomy 21 using Tandem Single Nucleotide Polymorphisms," PLoS One, Oct. 8, 2010, vol. 5, No. 10:e.13184, 10 Pages, doi: 10.1371/journal.pone.0013184.
Gnirke A., et al., "Solution Hybrid Selection with Ultra-Long Oligonucleotides for Massively Parallel Targeted Sequencing," Nature Biotechnology, Feb. 2009, vol. 27, No. 2, pp. 182-189.
Go A.T.J.I., et al., "Non-invasive Aneuploidy Detection using Free Fetal DNA and RNA in Maternal Plasma: Recent Progress and Future Possibilities," Human Reproduction Update, 2011, vol. 17, No. 3, pp. 372-382.
Goessl C., "Diagnostic Potential of Circulating Nucleic Acids for Oncology," Expert Review of Molecular Diagnostics, 2003, vol. 3(4), pp. 431-432.

(56) References Cited

OTHER PUBLICATIONS

Goessl C. et al., "DNA Alterations in Body Fluids as Molecular Tumor Markers for Urological Malignancies," European Urology, 2002, vol. 41, pp. 668-676.
Gormally E., et al., "Amount of DNA in Plasma and Cancer Risk: A Prospective Study," International Journal of Cancer, Sep. 20, 2004, vol. 111, No. 5, DOI: 10.1002/ijc.20327, pp. 746-749.
Gwee P.-C., et al., "Simultaneous Genotyping of Seven Single-nucleotide Polymorphisms in the Mdr1 Gene by Single-tube Multiplex Minisequencing," Clinical Chemistry, Apr. 1, 2003, vol. 49, Issue. 3, pp. 672-676.
Hall M.P., "Panorama(TM) Non-Invasive Prenatal Screening for Microdeletion Syndromes," Panaroma Prenatal Screen, Apr. 1, 2014, 5 Pages, XP055157224, [Retrieved on Dec. 8, 2014], Retrieved from URL: http://www.panoramatest.com/sites/default/files/files/PanoramaMicrodeletionsWhitePaper-2.pdf.
Handley D., et al., "Noninvasive Prenatal Chromosomal Aneuploidy Detection using Plasma Cell-Free Nucleic Acid," Expert Review of Obstetrics & Gynecology, 2010, vol. 5, No. 5, pp. 581-590, 12 Pages.
Hardenbol P., et al., "Highly Multiplexed Molecular Inversion Probe Genotyping: Over 10,000 Targeted SNPs Genotyped in a Singled Tube Assay," Genome Research, 2005, vol. 15, pp. 269-275.
Hardenbol P., et al., "Multiplexed Genotyping with Sequence-Tagged Molecular Inversion Probes," Nature Biotechnology, Jun. 2003, vol. 21, No. 6, pp. 673-678 (7 Pages).
Harismendy O., et al., "Method for Improving Sequence Coverage Uniformity of Targeted Genomic Intervals Amplified by LR-PCR Using Illumina GA Sequencing-by-synthesis Technology," Bio Techniques, 2009, vol. 46, No. 3, pp. 229-231.
Hayden M.J., et al., "Multiplex-Ready PCR: A New Method for Multiplexed SSR and SNP Genotyping," BMC Genomics, Feb. 18, 2008, vol. 9, No. 80, pp. 1-12 (12 Pages).
Hochberg E.P., et al., "A Novel Rapid Single Nucleotide Polymorphism (SNP)-Based Method For Assessment Of Hematopoietic Chimerism After Allogeneic Stem Cell Transplantation," Jan. 1, 2003, Blood, vol. 101, No. 1, pp. 363-369.
Hoffmann S., et al., "Donor Genomics Influence Graft Events: The Effect Of Donor Polymorphisms On Acute Rejection And Chronic Allograft Nephropathy," Kidney International, Oct. 1, 2004, vol. 66, No. 4, pp. 1686-1693.
Hosono S., et al., "Unbiased Whole-Genome Amplification Directly from Clinical Samples," Genome Research, Jun. 2003, vol. 13, pp. 954-964, 12 Pages.
Hu D.G., et al., "Aneuploidy Detection in Single Cells Using DNA Array-Based Comparative Genomic Hybridization," Molecular Human Reproduction, 2004, vol. 10, No. 4, pp. 283-289.
Huang D.J., et al., "Use of an Automated Method Improves the Yield and Quality of Cell-Free Fetal DNA Extracted from Maternal Plasma," Clinical Chemistry, 2005, vol. 51, No. 12, pp. 2419-2420.
Huang J., et al., "Whole Genome DNA Copy Number Changes Identified by High Density Oligonucleotide Arrays," Human Genomics, May 2004, vol. 1, No. 4, pp. 287-299, 13 Pages.
Hubacek J.A., et al., "Detection of Donor DNA After Heart Transplantation: How Far Could It Be Affected by Blood Transfusion and Donor Chimerism?," Transplantation Proceedings, Jun. 1, 2007, vol. 39, pp. 1593-1595.
Hung E.C.W., et al., "Detection of Circulating Fetal Nucleic Acids: A Review of Methods and Applications," Journal of Clinical Pathology, 2009, vol. 62, pp. 308-313, 7 Pages.
Ingman M., et al., "SNP Frequency Estimation using Massively Parallel Sequencing of Pooled DNA," European Journal of Human Genetics, 2009, vol. 17, No. 3, pp. 383-386, Published Online Oct. 15, 2008.
Interewicz B., et al., "DNA Released from Ischemic and Rejecting Organs as an Indicator of Graft Cellular Damage," Annals of Transplantation, May 1, 2004, vol. 9, No. 2, pp. 42-45.

Ishii K., et al., "Optimization of Annealing Temperature to Reduce Bias Caused by a Primer Mismatch in Multitemplate PCR," Applied and Environmental Microbiology, Aug. 2001, vol. 67 (8), pp. 3753-3755.
Ito T., et al., "Estimation of Haplotype Frequencies, Linkage-Disequilibrium Measures, and Combination of Haplotype Copies in Each Pool By Use Of Pooled DNA Data," American Journal of Human Genetics, Jan. 17, 2003, vol. 72, pp. 384-398.
Jarvie T., "Next Generation Sequencing Technologies," Drug Discovery Today: Technologies, 2005, vol. 2, No. 3, pp. 255-260.
Jen J., et al., "An Overview on the Isolation and Analysis of Circulating Tumor DNA in Plasma and Serum," Annals New York Academy of Sciences, 2000, pp. 8-12.
Jung K., et al., "Increased Cell-free DNA in Plasma of Patients with Metastatic Spread in Prostate Cancer," Cancer Letters, 2004, vol. 205, pp. 173-180.
Kamat A.A., et al., "Quantification of Total Plasma Cell-Free DNA in Ovarian Cancer using Real-Time PCR," Annals of the New York Academy of Sciences, Sep. 2006, vol. 1075, pp. 230-234.
Kaper F., et al., "Abstract 1164: Parallel Preparation of Targeted Resequencing Libraries from 480 Genomic Regions Using Multiplex PCR on the Access Array System," American Association for Cancer Research, Apr. 17-21, 2010, vol. 70, Supplement. 8, No. 1164, pp. 1-2.
Kaper F., et al., "Parallel Preparation of Targeted Resequencing Libraries from 480 Genomic Regions Using Multiplex PCR on the Access Array(TM) System," Fluidigm Poster, 2011, 1 Page.
Kinde I., et al., "Detection and Quantification of Rare Mutations with Massively Parallel Sequencing," Proceedings of the National Academy of Sciences of the United States of America, Jun. 7, 2011, vol. 108, No. 23, pp. 9530-9535.
Kircher M., et al., "Improved Base Calling for the Illumina Genome Analyzer Using Machine Learning Strategies," Genome Biology, Aug. 14, 2009, vol. 10, Issue 8, Article No. R83, pp. R83.2-R83.9, (9 Pages).
Kittler R., et al., "A Whole Genome Amplification Method to Generate Long Fragments from Low Quantities of Genomic DNA," Analytical Biochemistry, 2002, vol. 300, pp. 237-244.
Kivioja T., et al., "Counting Absolute Number of Molecules Using Unique Molecular Identifiers," Nature Proceedings, Apr. 14, 2011, 18 Pages.
Koboldt D.C., et al., "VarScan: Variant Detection In Massively Parallel Sequencing Of Individual And Pooled Samples," Bioinformatics, Jun. 19, 2009, vol. 25, No. 17, pp. 2283-2285.
Koelman C.A., et al., "Donor-Derived Soluble HLA Plasma Levels Can Not Be Used To Monitor Graft Rejection In Heart Transplant Recipients," Transplant Immunology, Mar. 1, 2000, vol. 8, No. 1, pp. 57-64.
Kohler C., et al., "Levels of Plasma Circulating Cell Free Nuclear and Mitochondrial DNA as Potential Biomarkers for Breast Tumors," Molecular Cancer, Nov. 17, 2009, vol. 8, No. 105, 9 Pages.
Koide K., et al., "Fragmentation of Cell-Free Fetal DNA in Plasma and Urine of Pregnant Women," Prenatal Diagnosis, 2005, vol. 25, pp. 604-607.
Koldehoff M., et al., "Quantitative Analysis of Chimerism After Allogeneic Stem Cell Transplantation by Real-time Polymerase Chain Reaction With Single Nucleotide Polymorphisms, Standard Tandem Repeats, and Y-Chromosome-specific Sequences," American Journal of Hematology, Jul. 12, 2006, vol. 18, No. 10, pp. 735-746.
Korn J.M., et al., "Integrated Genotype Calling And Association Analysis Of SNPS, Common Copy Number Polymorphisms And Rare CNVS," Nature Genetics, Oct. 1, 2008, vol. 40, No. 10, pp. 1253-1260.
Krishnakumar S., et al., "A Comprehensive Assay for Targeted Multiplex Amplification of Human DNA Sequences," The Proceedings of the National Academy of Sciences, Jul. 8, 2008, vol. 105, No. 27, pp. 9296-9301.
Krjutskov K., et al., "Development of a Single Tube 640-plex Genotyping Method for Detection of Nucleic Acid Variations on Microarrays," Nucleic Acids Research, May 23, 2008, vol. 36, No. 12, pp. e75-e75 (7 Pages), XP055207208, ISSN: 0305-1048, DOI: 10.1093/nar/gkn357 . . . .

(56) References Cited

OTHER PUBLICATIONS

Kukita Y., et al., "Quantitative Identification of Mutant Alleles Derived From Lung Cancer in Plasma Cell-free DNA via Anomaly Detection Using Deep Sequencing Data," PLoS ONE, Nov. 2013, vol. 8(11), pp. 1-10.
Lavebratt C., et al., "Single Nucleotide Polymorphism (SNP) Allele Frequency Estimation in DNA Pools Using Pyrosequencing(TM)," Nature Protocols, Jan. 11, 2007, vol. 1, No. 6, pp. 2573-2582.
Lavebratt C., et al., "Pyrosequencing(TM)-based SNP Allele Frequency Estimation In DNA Pools," Human Mutation, Dec. 19, 2003, vol. 23, Issue 1, pp. 92-97.
Leamon J.H., et al., "A Massively Parallel PicoTiterPlate based Platform for Discrete Picoliter-scale Polymerase Chain Reactions," Electrophoresis, Nov. 1, 2003, vol. 24, No. 21, pp. 3769-3777.
Leary R.J., et al., "Development of Personalized Tumor Biomarkers Using Massively Parallel Sequencing," Science Translational Medicine, Feb. 24, 2010, vol. 2, Issue. 20 (20ra14), pp. 1-8.
Lecomte T., et al., "Detection of Free-Circulating Tumor-Associated DNA in Plasma of Colorectal Cancer Patients and its Association with Prognosis," International Journal of Cancer, Aug. 10, 2002, vol. 100, No. 5, pp. 542-548, DOI: 10.1002/ijc.10526.
Lee T., et al., "Down Syndrome and Cell-Free Fetal DNA in Archived Maternal Serum," American Journal of Obstetrics & Gynecology, Nov. 2002, vol. 187, No. 5, pp. 1217-1221.
Lee T.H., et al., "Quantitation of Genomic DNA in Plasma and Serum Samples: Higher Concentrations of Genomic DNA found in Serum than in Plasma," Transfusion, Feb. 2001, vol. 41, pp. 276-282.
Lefebure B., et al., "Prognostic Value of Circulating Mutant DNA in Unresectable Metastatic Colorectal Cancer," Annals of Surgery, Feb. 2010, vol. 251, No. 2, pp. 275-280, DOI: 10.1097/SLA.0b013e3181c35c87.
Li R., et al., "SNP Detection For Massively Parallel Whole-Genome Resequencing," Genome Research, 2009, vol. 19, pp. 1124-1132 (10 Pages).
Li Y., et al., "Biochemical and Clinical Diagnostic Aspects of Circulating Nucleic Acids," Dissertation, 2005, 103 Pages.
Li Y., et al., "Detection of Donor-specific DNA Polymorphisms in the Urine of Renal Transplant Recipients," Clinical Chemistry, Apr. 1, 2003, vol. 49, No. 4, pp. 655-658.
Li Y., et al., "Detection of Paternally Inherited Fetal Point Mutations for Beta-Thalassemia Using Size-Fractionated Cell-Free DNA in Maternal Plasma," JAMA, Feb. 16, 2005, vol. 293, No. 7, pp. 843-849, 8 Pages, Apr. 13, 2005.
Li Y., et al., "Detection of SNPs in the Plasma of Pregnant Women and in the Urine of Kidney Transplant Recipients by Mass Spectrometry," Annals of the New York Academy of Sciences, Sep. 5, 2006, vol. 1075, pp. 144-147.
Li Y., et al., "Size Separation of Circulatory DNA in Maternal Plasma Permits Ready Detection of Fetal DNA Polymorphisms," Clinical Chemistry, 2004, vol. 50, No. 6, pp. 1002-1011.
Li Y., et al., "Non-invasive Prenatal Diagnosis Using Cell-free Fetal DNA in Maternal Plasma From PGD Pregnancies," Reproductive Bio Medicine Online, 2009, vol. 19, No. 5, pp. 714-720 (8 Pages).
Liao G.J.W., et al., "Targeted Massively Parallel Sequencing of Maternal Plasma DNA Permits Efficient and Unbiased Detection of Fetal Alleles," Clinical Chemistry, 2011, vol. 92, No. 1, pp. 92-101.
Lichtenstein A.V., et al., "Circulating Nucleic Acids and Apoptosis," Annals New York Academy of Sciences, Aug. 1, 2001, vol. 945, pp. 239-249.
Liew M., et al., "Genotyping of Single-Nucleotide Polymorphisms by High-Resolution Melting of Small Amplicons," Clinical Chemistry, 2004, vol. 50, No. 7, pp. 1156-1164.
Liljedahl U., et al., "Detecting Imbalanced Expression of SNP Alleles by Minisequencing On Microarrays," BMC Biotechnology, Oct. 22, 2004, vol. 4, Article No. 24, pp. 1-10.
Lindroos K., et al., "Genotyping SNPs by Minisequencing Primer Extension Using Oligonucleotide Microarrays," Methods in Molecular Biology, Single Nucleotide Polymorphisms: Methods and Protocols, P-K Kwok (ed.), Humana Press, Inc., Totowa, NJ, 2003, vol. 212, pp. 149-165.
Lo Y., "Noninvasive Prenatal Detection of Fetal Chromosomal Aneuploidies by Maternal Plasma Nucleic Acid Analysis: A Review of the Current State of the Art," BJOG An International Journal of Obstetrics and Gynaecology, 2009, vol. 116, pp. 152-157.
Lo Y.M.D., et al., "Circulating Nucleic Acids in Plasma and Serum: An Overview," Annals of the New York Academy of Sciences, Sep. 1, 2001, vol. 945, pp. 1-7.
Lo Y.M.D., et al., "Digital PCR for the Molecular Detection of Fetal Chromosomal Aneuploidy," Proceedings of the National Academy of Sciences, Aug. 7, 2007, vol. 104, No. 32, pp. 13116-13121.
Lo Y.M.D., et al., "Free Fetal DNA in Maternal Circulation," JAMA (Letters to the Editor), Dec. 15, 2004, vol. 292, No. 23, pp. 2835-2836 (3 Pages).
Lo Y.M.D., et al., "Maternal Plasma DNA Sequencing Reveals the Genome-Wide Genetic and Mutational Profile of the Fetus," Science Translational Medicine, Dec. 8, 2010, vol. 2, No. 61, 13 Pages.
Lo Y.M.D., et al., "Next-Generation Sequencing Of Plasma/Serum DNA: An Emerging Research And Molecular Diagnostic Tool," Clinical Chemistry, Apr. 1, 2009, vol. 55, No. 4, pp. 607-608.
Lo Y.M.D., et al., "Prenatal Diagnosis: Progress through Plasma Nucleic Acids," Nature Reviews, Jan. 2007, vol. 8, pp. 71-77.
Lo Y.M.D., et al., "Transplantation Monitoring by Plasma DNA Sequencing," Clinical Chemistry, Jul. 2011, vol. 57, No. 7, pp. 941-942, DOI: 10.1373/clinchem.2011.166686, PubMed PMID: 21566070.
Lo Y.M.D., "Fetal DNA in Maternal Plasma: Biology and Diagnostic Applications," Clinical Chemistry, 2000, vol. 46, No. 12, pp. 1903-1906.
Lo Y.M.D., "Fetal Nucleic Acids in Maternal Plasma: Toward the Development of Noninvasive Prenatal Diagnosis of Fetal Chromosomal Aneuploidies," Annals of the New York Academy of Sciences, 2008, vol. 1137, pp. 140-143.
Lovmar L., et al., "Quantitative Evaluation by Minisequencing and Microarrays Reveals Accurate Multiplexed SNP Genotyping of Whole Genome Amplified DNA," Nucleic Acids Research, 2003, vol. 31, No. 21(e129), 9 Pages.
Lui Y.Y.N., et al., "Circulating DNA in Plasma and Serum: Biology, Preanalytical Issues And Diagnostic Applications," Clinical Chemistry and Laboratory Medicine, Oct. 29, 2002, vol. 40, No. 10, pp. 962-968.
Lui Y.Y.N., et al., "Origin of Plasma Cell-Free DNA after Solid Organ Transplantation," Clinical Chemistry, Mar. 1, 2003, vol. 49, No. 3, pp. 495-496.
Lui Y.Y.N., et al., "Predominant Hematopoietic Origin of Cell-Free DNA in Plasma and Serum after Sex-Mismatched Bone Marrow Transplantation," Clinical Chemistry, 2002, vol. 48, vol. 3, pp. 421-427.
Lun F M F., et al., "Microfluidics Digital PCR Reveals A Higher Than Expected Fraction Of Fetal DNA In Maternal Plasma," Clinical Chemistry, Aug. 14, 2008, vol. 54, No. 10, pp. 1664-1672.
Lun F.M.F., et al., "Noninvasive Prenatal Diagnosis of Monogenic Diseases by Digital Size Selection and Relative Mutation Dosage on DNA in Maternal Plasma," PNAS, Dec. 16, 2008, vol. 105, No. 50, pp. 19920-19925.
Mamanova L., et al., "Target-Enrichment Strategies for Next-Generation Sequencing," Nature Methods, Feb. 2010, vol. 7, No. 2, pp. 111-118 (9 Pages) DOI: 10.1038/nmeth.1419.
Mamon H., et al., "Letters to the Editor: Preferential Amplification of Apoptotic DNA from Plasma: Potential for Enhancing Detection of Minor DNA Alterations in Circulating DNA," Clinical Chemistry, 2008, vol. 54, No. 9, pp. 1582-1584.
Maron J.L., et al., "Cell-free Fetal DNA Plasma Extraction and Realtime Polymerase Chain Reaction Quantification," Methods In Molecular Medicine, Aug. 1, 2007, vol. 132, pp. 51-63.
Matsuzaki H., et al., "Genotyping over 100,000 SNPs on a Pair of Oligonucleotide Arrays," Nature Methods, Nov. 2004, vol. 1, No. 2, pp. 109-111.
Maughan, P., et al., "SNP Discovery via Genomic Education, Barcoding, and Pyrosequencing in Amaranth," The Plant Genome, 2009, vol. 2(3), pp. 1.

(56) References Cited

OTHER PUBLICATIONS

Mcbride D.J., et al., "Use of Cancer-Specific Genomic Rearrangements to Quantify Disease Burden in Plasma from Patients with Solid Tumors," Genes, Chromosomes & Cancer, Aug. 19, 2010, vol. 49, pp. 1062-1069.
Mccloskey M.L., et al., "Encoding PCR Products with Batch-Stamps and Barcodes," Biochemical Genetics, Oct. 23, 2007, vol. 45, pp. 761-767.
Mertes F., et al., "Targeted Enrichment of Genomic DNA Regions for Next-Generation sequencing," Briefings in Functional Genomics, Nov. 26, 2011, vol. 10, No. 6, pp. 374-386.
Meuzelaar L.S., et al., "Megaplex Pcr: A Strategy for Multiplex Amplification," Nature Methods, 2007, vol. 4, pp. 835-837, 8 Pages.
Milani L., et al., "Genotyping Single Nucleotide Polymorphisms By Multiplex Minisequencing Using Tag-Arrays," DNA Microarrays for Biomedical Research, Jan. 16, 2009, vol. 529, pp. 215-229.
Miner B.E., et al., "Molecular Barcodes Detect Redundancy and Contamination in Hairpin-Bisulfite PCR," Nucleic Acids Research, Sep. 30, 2004, vol. 32(17), pp. 1-4.
Moreira V.G., et al., "Cell-Free DNA as a Noninvasive Acute Rejection Marker in Renal Transplantation," Clinical Chemistry, 2009, vol. 55, No. 11, pp. 1958-1966.
Nannya Y., et al., "A Robust Algorithm for Copy Number Detection Using High-density Oligonucleotide Single Nucleotide Polymorphism Genotyping Arrays," Cancer Research, Jul. 15, 2005, vol. 65, No. 14, pp. 6071-6079.
*Natera Inc.* v. *CareDx, Inc.*, Memorandum Opinion: Case 1:20-cv-00038-CFC-CJB, United States District Court for the District of Delaware, Feb. 24, 2025, pp. 1-21.
*Natera Inc.* v. *NeoGenomics Laboratories, Inc.*, Memorandum Opinion and Order: Case 1:23-cv-00629-CCE-JLW, United States District Court for the Middle District of North Carolina, Aug. 28, 2025, pp. 1-16.
Newman, A., et al., "An Ultrasensitive Method for Quantitating Circulating Tumor DNA With Broad Patient Coverage," Nature Medicine, May 2014, vol. 20 (5), pp. 1-166.
No Author Listed, "Abstracts for CNAPS III Circulating Nucleic Acids in Plasma and Serum and Serum Proteomics," Loews Santa Monica Beach Hotel, Clinical Chemistry, Nov. 9-12, 2003, vol. 49, No. 11, 33 Pages.
Owczarzy R., et al., "Melting Temperatures of Nucleic Acids Discrepancies in Analysis," Biophysical Chemistry, 2005, vol. 117, pp. 207-215.
Palomaki G.E., et al., "DNA Sequencing of Maternal Plasma to Detect Down Syndrome: An International Clinical Validation Study," Genetics in Medicine, Nov. 2001, vol. 13, No. 11, pp. 913-920.
Panjkovich A., et al., "Comparison of Different Melting Temperature Calculation Methods for Short DNA Sequences," Bioinformatics, 2005, vol. 21, No. 6, pp. 711-722.
Papadopoulou E., et al., "Cell-Free DNA and RNA in Plasma as a New Molecular Marker for Prostate Cancer," Oncology Research, 2004, vol. 14, pp. 439-445.
Papageorgiou E.A., et al., Fetal-Specific DNA Methylation Ratio Permits Noninvasive Prenatal Diagnosis of Trisomy 21, Nature Medicine, Advanced Online Publication, Mar. 6, 2011, vol. 17, pp. 510-513 (5 Pages).
Parameswaran P., et al., "A Pyrosequencing-Tailored Nucleotide Barcode Design Unveils Opportunities for Large-Scale Sample Multiplexing," Nucleic Acids Research, Oct. 11, 2007, vol. 35, No. 19(e130), 9 Pages.
Pathak A.K., et al., "Circulating Cell-Free DNA in Plasma/Serum of Lung Cancer Patients as a Potential Screening and Prognostic Tool," Clinical Chemistry, 2006, vol. 52, No. 10, pp. 1833-1842.
Peters D., et al., "Noninvasive Prenatal Diagnosis of a Fetal Microdeletion Syndrome," New England Journal of Medicine, 2011, vol. 365, No. 11, pp. 1847-1848.
Pinard R., et al., "Assessment of Whole Genome Amplification-induced Bias Through High-throughput, Massively Parallel Whole Genome Sequencing," BMC Genomics, Aug. 23, 2006, vol. 7, No. 216, pp. 1-21.
Podder M., et al., "Robust SNP Genotyping by Multiplex PCR and Arrayed Primer," BMC Medical Genomics, 2008, vol. 1, No. 5, pp. 1-15.
Pont-Kingdon., G., et al., "Rapid Detection of Aneuploidy (Trisomy 21) by Allele Quantification Combined with Melting Curves Analysis of Single-Nucleotide Polymorphism Loci," Clinical Chemistry, 2003, vol. 49, No. 7, pp. 1087-1094.
Pourmand N., et al., "Multiplex Pyrosequencing," Nucleic Acid Research, Apr. 1, 2002, vol. 30, No. 7(e31), pp. 1-5.
Prabhu S., et al., "Overlapping Pools for High-throughput Targeted Resequencing," Genome Research, May 15, 2009, vol. 19, pp. 1254-1261.
Puszyk W.M., "Epigenetics of Cell-free Plasma Dna for Non-invasive Prenatal Diagnosis of Fetal Aneuploidies," Diss. University of Warwick, Sep. 2008, 199 Pages.
Puszyk W.M., et al., "Noninvasive Prenatal Diagnosis Of Aneuploidy Using Cell-free Nucleic Acids In Maternal Blood: Promises And Unanswered Questions," Prenatal Diagnosis, 2008, vol. 28, No. 1, pp. 1-6, Nov. 16, 2007.
Roedder S., et al., "Biomarkers in Solid Organ Transplantation: Establishing Personalized Transplantation Medicine," Genome Medicine, Jun. 8, 2011, vol. 3, No. 6 (37), 12 Pages.
Saito H., et al., "Prenatal DNA Diagnosis of a Single-Gene Disorder from Maternal Plasma," The Lancet, Sep. 30, 2000, vol. 356, p. 1170.
Samura O., et al., "Diagnosis of Trisomy 21 in Fetal Nucleated Erythrocytes from Maternal Blood by Use of Short Tandem Repeat Sequences," Clinical Chemistry, 2001, vol. 47, No. 9, pp. 1622-1626.
Schoske R., et al., "Multiplex PCR Design Strategy used for the Simultaneous Amplification of 10 Y Chromosome Short Tandem Repeat (STR) Loci," Analytical and Bioanalytical Chemistry, 2003, vol. 375, pp. 333-343.
Schwarzenbach H., et al., "Cell-Free Nucleic Acids as Biomarkers in Cancer Patients," Nature Reviews Cancer, Jun. 2011, vol. 11, No. 6, pp. 426-437, DOI: 10.1038/nrc3066m EPublished May 12, 2011.
Schwarzenbach H., et al., "Detection and Characterization of Circulating Microsatellite-DNA in Blood of Patients with Breast Cancer," Annals of the New York Academy of Sciences, 2004, vol. 1022, pp. 25-32.
Schwarzenbach H., et al., "Evaluation of Cell-Free Tumour DNA and RNA in Patients with Breast Cancer and Benign Breast Disease," Molecular BioSystems, Jul. 2011, vol. 7, pp. 2848-2854, 8 Pages.
Sehnert A.J., et al., Optimal Detection of Fetal Chromosomal Abnormalities by Massively Parallel DNA Sequencing of Cell-Free Fetal DNA from Maternal Blood, Clinical Chemistry, Apr. 25, 2011, vol. 57, No. 7, pp. 1-8.
Seppo A., et al., "Detection of Circulating Fetal Cells Utilizing Automated Microscopy: Potential for Noninvasive Prenatal Diagnosis of Chromosomal Aneuploidies," Prenatal Diagnosis, vol. 28, pp. 815-821, Published Online on Jul. 22, 2008.
Shen Z., et al., "MPprimer: A Program for Reliable Multiplex PCR Primer Design," BMC Bioinformatics, Mar. 18, 2010, vol. 11, No. 143, pp. 1-7.
Shendure J., et al., "Next-Generation DNA Sequencing," Nature Biotechnology, Oct. 2008, vol. 26, No. 10, pp. 1135-1145.
Shendure J., et al., "The Expanding Scope of DNA Sequencing," Nature Biotechnology, Nov. 2012, vol. 30(11), pp. 1084-1094.
Smith D.R., et al., "Rapid Whole-genome Mutational Profiling using Next-generation Sequencing Technologies," Genome Research, Sep. 4, 2008, vol. 18, pp. 1638-1642.
Smith J.F., et al., "Cell-Free Fetal DNA in Maternal Plasma," Progress and Potential, Neo Reviews, Aug. 1, 2008, vol. 9, No. 8, pp. e332-e337 (8 Pages).
Snyder M.W., et al., "Noninvasive Fetal Genome Sequencing: A Primer," Prenatal Diagnosis, 2013, vol. 33, pp. 1-8.
Snyder T.M., et al., "Universal Noninvasive Detection of Solid Organ Transplant Rejection," Proceedings of the National Academy of Sciences of the United States of America, Apr. 12, 2011, vol. 108, No. 15, pp. 6229-6234.

(56) References Cited

OTHER PUBLICATIONS

Spits C., et al., "Optimization and Evaluation of Single-Cell Whole Genome Multiple Displacement Amplification," Human Mutation, 2006, vol. 27, No. 5, pp. 496-503.

Srinivasan A., et al., "Noninvasive Detection of Fetal Subchromosome Abnormalities via Deep Sequencing of Maternal Plasma," The American Journal of Human Genetics, Feb. 7, 2013, vol. 92, pp. 167-176, Published Jan. 10, 2013.

Stiller M., et al., "Direct Multiplex Sequencing (DMPS)-A Novel Method for Targeted High-throughput Sequencing of Ancient and Highly Degraded DNA," Genome Research, Oct. 2009, vol. 19, No. 10, pp. 1843-1848.

Swarup V., et al., "Circulating (Cell-Free) Nucleic Acids—A Promising, Non-Invasive Tool for Early Detection of Several Human Diseases," FEBS Letters, 2007, vol. 581, pp. 795-799.

Swinkels D.W., et al., "Effects of Blood-Processing Protocols on Cell-Free DNA Quantification in Plasma," Clinical Chemistry, Mar. 2003, vol. 49, No. 3, pp. 525-526, PubMed PMID: 12600978.

Taback B., et al., "Quantification of Circulating DNA in the Plasma and Serum of Cancer Patients," Annals of the New York Academy of Sciences, 2004, vol. 1022, pp. 17-24.

Tamkovich S.N., et al., "Circulating Nucleic Acids in Blood of Healthy Male and Female Donors," Clinical Chemistry, Jul. 2005, vol. 51, No. 7, pp. 1317-1319, PubMed PMID: 15976134.

Ten Bosch J.R., et al., "Keeping Up With the Next Generation Massively Parallel Sequencing in Clinical Diagnostics," Journal of Molecular Diagnostics, Nov. 2008, vol. 10, No. 6, pp. 484-492.

Tewhey R., et al., "Microdroplet-Based PCR Enrichment for Large-Scale Targeted Sequencing," Nature Biotechnology, Nov. 2009, vol. 27, No. 11, pp. 1025-1031, 11 Pages, DOI: 10.1038/nbt.1583, EPublished Nov. 1, 2009.

Tewhey R., et al., "The Importance of Phase Information for Human Genomics," Nature Reviews Genetics, Mar. 1, 2011, vol. 12, No. 3, pp. 215-223.

Tong Y-K., et al., "Diagnostic Developments Involving Cell-Free (Circulating) Nucleic Acids," Clinica Chimica Acta, Jan. 2006, vol. 363, No. 1-2, pp. 187-196, Epub Aug. 26, 2005 Review. PubMed PMID: 16126188.

Tong Y.K., et al., "Noninvasive Prenatal Detection of Fetal Trisomy 18 by Epigenetic Allelic Ratio Analysis in Maternal Plasma: Theoretical and Empirical Considerations," Clinical Chemistry, 2006, vol. 52, No. 12, pp. 2194-2202.

Tong Y.K., et al., "Noninvasive Prenatal Detection of Trisomy 21 by an Epigenetic-Genetic Chromosome-Dosage Approach," Clinical Chemistry, Jan. 2010, vol. 56, No. 1, pp. 90-98.

Tounta G., et al., "A Multiplex PCR for Non-invasive Fetal RHD Genotyping Using Cell-free Fetal DNA," In Vivo, 2011, vol. 25, pp. 411-418, 7 Pages.

Tounta G., et al., "Non-Invasive Prenatal Diagnosis using Cell-free Fetal Nucleic Acids in Maternal Plasma: Progress Overview beyond Predictive and Personalized Diagnosis," EPMA Journal, 2011, vol. 2, Issue. 2, pp. 163-171.

Tsang J.C.H., et al., "Circulating Nucleic Acids in Plasma/Serum," Pathology, Apr. 1, 2007, vol. 39, No. 2, pp. 197-207.

Tufan N.L.S., et al., "Analysis of Cell-Free Fetal DNA from Maternal Plasma and Serum Using a Conventional Multiplex PCR: Factors Influencing Success," The Turkish Journal of Medical Sciences, 2005, vol. 35, pp. 85-92.

Tungwiwat W., et al., Non-Invasive Fetal Sex Determination using a Conventional Nested PCR Analysis of Fetal DNA in Maternal Plasma, Clinica Chimica Acta, 2003, vol. 334, No. 1-2, pp. 173-177.

Tynan J.A., et al., "Restriction Enzyme-Mediated Enhanced Detection of Circulating Cell-Free Fetal DNA in Maternal Plasma," The Journal of Molecular Diagnostics, Jul. 2011, vol. 13, No. 4, pp. 382-389.

Tzimagiorgis G., et al., "Recovering Circulating Extracellular or Cell-Free RNA from Bodily Fluids," Cancer Epidemiology, 2011, vol. 35, pp. 580-589.

Urbanova M., et al., "Circulating Nucleic Acids as a New Diagnostic Tool," Cellular & Molecular Biology Letters, 2010, vol. 15, No. 2, pp. 242-259.

Vallone P.M., et al., "Demonstration of Rapid Multiplex PCR Amplification Involving 16 Genetic Loci," Forensic Science International: Genetics, 2008, vol. 3, pp. 42-45.

Varley K.E., et al., "Nested Patch PCR Enables Highly Multiplexed Mutation Discovery in Candidate Genes," Genome Research, Nov. 2008, vol. 18, No. 11, pp. 1844-1850, DOI: 10.1101/gr.078204.108.

Veselovska L., "The Use of Cell-Free Nucleic Acids in Maternal Plasma for Non-Invasive Prenatal Diagnosis of Monogenic Diseases, Placental Insufficiency-Related Complications and Down Syndrome," Thesis from Charles University in Prague, Apr. 25, 2011, 104 Pages.

Wagner F.F., et al., "RHD Gene Deletion Occurred in the Rhesus box," Blood, Jun. 15, 2000, vol. 95, No. 12, pp. 3662-3668.

Wagner J., et al., "Non-invasive Prenatal Paternity Testing From Maternal Blood," International Journal of Legal Medicine, 2009, vol. 123, pp. 75-79 (3 Pages), Published Online Oct. 24, 2008.

Wang H-Y., et al., "A Genotyping System Capable of Simultaneously Analyzing 1000 Single Nucleotide Polymorphisms in a Haploid Genome," Genome Research, 2005, vol. 15, pp. 276-283, 9 Pages.

Wang S., et al., "Self-Formed Adaptor PCR: a Simple and Efficient Method for Chromosome Walking," Applied and Environmental Microbiology, May 2007, vol. 73(15), pp. 50485051.

Wang W-P., et al., "Multiplex Single Nucleotide Polymorphism Genotyping by Adapter Ligation-Mediated Allele-Specific Amplification," Analytical Biochemistry, May 5, 2006, vol. 355, pp. 240-248.

Wang Y., et al., "Allele Quantification Using Molecular Inversion Probes (MIP)," Nucleic Acids Research, Oxford University 1 Press, GB, Nov. 1, 2005, vol. 33, No. 21, pp. e183/1-14, XP009127259, ISSN: 1362-4962, DOI: 10.1093/NAR/GNI177 [retrieved on Nov. 28, 2005], Abstract.

Wapner R., et al., "First-Trimester Screening for Trisomies 21 and 18," The New England Journal of Medicine, Oct. 9, 2003, vol. 349, No. 15, pp. 1405-1413.

Wasson J., et al., "Assessing Allele Frequencies of Single Nucleotide Polymorphisms in DNA Pools by Pyrosequencing(TM) Technology," BioTechniques, May 1, 2022, vol. 32, No. 5, pp. 1144-1152, 6 Pages.

Wei C., et al., "Detection and Quantification by Homogeneous PCR of Cell-free Fetal DNA in Maternal Plasma," Clinical Chemistry, 2001, vol. 47, No. 2, pp. 336-338.

Wilkening., et al., "Determination of Allele Frequency in Pooled DNA: Comparison of Three PCR-based Methods," Bio Techniques, May 30, 2005, vol. 39, No. 6, pp. 853-857, (Dec. 2005).

Wong K-K., et al., "Allelic Imbalance Analysis by High-Density Single Nucleotide Polymorphic Allele (SNP) Array with Whole Genome Amplified DNA," Nucleic Acids Research, May 17, 2004, vol. 32, No. 9 (e69), 8 Pages.

Wright C., et al., "Cell-free Fetal Nucleic Acids for Noninvasive Prenatal Diagnosis," PHG Foundation, Jan. 1, 2009, pp. 1-64.

Wright C.F., et al., "Cell-Free Fetal DNA and RNA in Maternal Blood: Implications for Safer Antenatal Testing," BMJ, Jul. 18, 2009, vol. 339, b2451, pp. 161-165.

Wright C.F., et al., "The Use of Cell-free Fetal Nucleic Acids in Maternal Blood for Non-invasive Prenatal Diagnosis," Human Reproduction Update, 2009, vol. 15, No. 1, pp. 139-151.

Wu T-L., et al., "Cell-Free DNA: Measurement in Various Carcinomas and Establishment of Normal Reference Range," Clinica Chimica Acta, 2002, vol. 321, pp. 77-87.

Xia P., et al., "Simultaneous Quantitative Assessment of Circulating Cell-free Mitochondrial And Nuclear DNA By Multiplex Real-time PCR," Genetics and Molecular Biology, Mar. 1, 2009, vol. 32, No. 1, pp. 20-24.

Xie C., et al., "CNV-SEQ, A New Method to Detect Copy No. Variation Using High-throughput Sequencing," BMC Bioinformatics, Mar. 6, 2009, vol. 10 No. 80, pp. 1-9.

Xue X., et al., "Optimizing the Yield And Utility Of Circulating Cell-free DNA From Plasma And Serum," Clinica Chimica Acta, Jun. 27, 2009, vol. 404, No. 2, pp. 100-104.

(56) References Cited

OTHER PUBLICATIONS

Zachariah R., et al., "Circulating Cell-free DNA as a Potential Biomarker for Minimal and Mild Endometriosis," Reproductive Biomedicine Online, 2009, vol. 18, No. 3, pp. 407-411, Published Online, Jan. 27, 2009.

Zhang Z., et al., "Diagnosis of Acute Rejection by Analysis of Urinary DNA of Donor Origin in Renal Transplant Recipients," Transplantation Proceedings, Feb. 2001, vol. 33, No. 1-2, pp. 380-381.

Zhang Z., et al., "Use Of PCR And PCR-SSP For Detection Of Urinary Donor-Origin Dna In Renal Transplant Recipients With Acute Rejection," Chinese Medical Journal, Feb. 2003, vol. 116, No. 2, pp. 191-194, 5 Pages.

Zhao X., et al., An Integrated View of Copy Number and Allelic Alterations in the Cancer Genome Using Single Nucleotide Polymorphism Arrays, Cancer Research, May 1, 2004, vol. 64, pp. 3060-3071.

Zheng S., et al., "Whole Genome Amplification Increases the Efficiency and Validity of Buccal Cell Genotyping in Pediatric Populations," Cancer Epidemiology, Biomarkers & Prevention, Jun. 2001, vol. 10, pp. 697-700, 5 Pages.

Zhong X.Y., et al., "Cell-free DNA in Urine: A Marker for Kidney Graft Rejection, but Not for Prenatal Diagnosis?," Annals New York Academy of Sciences, Sep. 1, 2001, vol. 945, pp. 250-257.

Zhong X.Y., et al., "Detection of Fetal Rhesus D and Sex Using Fetal DNA from Maternal Plasma by Multiplex Polymerase Chain Reaction," British Journal of Obstetrics and Gynaecology, Jun. 2000, vol. 107, pp. 766-769.

Zhong X.Y., et al., "Risk Free Simultaneous Prenatal Identification of Fetal Rhesus D Status and Sex by Multiplex Real-time PCR using Cell Free Fetal DNA in Maternal Plasma," Swiss Medical Weekly, Mar. 2001, vol. 131, pp. 70-74 (7 Pages).

Zimmermann B., et al., "Digital PCR: A Powerful New Tool for Noninvasive Prenatal Diagnosis?," Prenatal Diagnosis, Nov. 10, 2008, vol. 28, pp. 1087-1093.

Zimmermann B., et al., "Novel Real-Time Quantitative PCR Test for Trisomy 21," Clinical Chemistry, 2002, vol. 48, No. 2, pp. 362-363.

Zimmermann B., et al., "Optimized Real-Time Quantitative PCR Measurement of Male Fetal DNA in Maternal Plasma," Clinical Chemistry, 2005, vol. 51, No. 9, pp. 1598-1604.

Zimmermann B., et al., "Real-Time Quantitative Polymerase Chain Reaction Measurement of Male Fetal DNA in Maternal Plasma," Methods in Molecular Medicine, 2007, vol. 132, pp. 43-49.

Zimmermann B. et al., "Use of Real-Time Polymerase Chain Reaction for the Detection of Fetal Aneuploidies," Methods in Molecular Biology, Feb. 2006, vol. 336, pp. 83-100.

\* cited by examiner

| | | |
|---|---|---|
| The sequencing-adaptor sequence is located inside the primer sequence and flanked by target specific sequence on both sides. 10 bases are target-specific at the 3'-end of each primer. Primers were tested successfully in real-time PCR. For sequencing this reduces the number of primer bases that need to be sequenced. | | |
| rs8130564 | int-tag 1.10 | AACTCACATAGCACACGACGCTCTTCCGATCTTGCAAGCACA |
| rs2832093 | int-tag 2.10 | TCCTCTGTGACACGACGCTCTTCCGATCTCCCTGCTCTT |
| rs12011281 | int-tag 3.10 | tcctctctACACGACGCTCTTCCGATCTCGGGCTGTCA |
| rs6719561 | int-tag 4.10 | TACATCCTTGAGACACGACGCTCTTCCGATCTGCTGTGCAGT |
| rs10187018 | int-tag 5.10 | tttgcttgagcTACACGACGCTCTTCCGATCTcgggagtttc |
| rs10460481 | int-tag 6.10 | gtcttatggtggACACGACGCTCTTCCGATCTcaaagccagt |
| The sequencing-adaptor sequence is located inside the primer sequence and flanked by target specific sequence on both sides. The internal tag is formed into a hairpin structure by 10 complementary bases on either end. This brings the target-specific ends of the primer into close proximity and hinders unspecific binding to the "internal tag". 10 bases are target-specific at the 3'-end of each primer. Primers were tested successfully in real-time PCR. | | |
| rs8130564 | loop-int-tag 1.10 | AACTCACATAGCtgatcggtACACGACGCTCTTCCGATCTTGCAAGCACA |
| rs2832093 | loop-int-tag 2.10 | TCCTCTGTGtgatcggtACACGACGCTCTTCCGATCTCCCTGCTCTT |
| rs12011281 | loop-int-tag 3.10 | tcctctcttgatcggtACACGACGCTCTTCCGATCTCGGGCTGTCA |
| rs6719561 | loop-int-tag 4.10 | TACATCCTTGAGtgatcggtACACGACGCTCTTCCGATCTGCTGTGCAGT |
| rs10187018 | loop-int-tag 5.10 | tttgcttgagcttgatcggtACACGACGCTCTTCCGATCTcgggagtttc |
| rs10460481 | loop-int-tag 6.10 | gtcttatggtggtgatcggtACACGACGCTCTTCCGATCTcaaagccagt |

FIG. 12

Euploid
% FF
XY

T13
30% FF
XY

T13
13% FF
XY

T21
20% FF
XX 45X
15% FF

47, XXY
13% FF $$\Delta G = \Delta G_1 + \Delta G_2 + ... + \Delta G_x$$

```
5'  A   T   C   G   A   3'
─────────────────────────────

─────────────────────────────
3'  G   A   C   T   T   5'
```

SHIFT
        ALIGNMENT
        BY 1

| Description | MAPPED_READS | TOTAL_READS | %Mapped Reads |
|---|---|---|---|
| gMother | 3,633,900 | 3,647,446 | 100% |
| gMother | 3,567,685 | 3,578,549 | 100% |
| gMother | 3,733,706 | 3,747,692 | 100% |
| gChild | 3,725,554 | 3,737,742 | 100% |
| gChild | 3,816,989 | 3,829,450 | 100% |
| gChild | 3,524,956 | 3,536,569 | 100% |
| 1 mother | 3,467,493 | 7,564,869 | 46% |
| 1 mother | 3,868,210 | 7,107,028 | 54% |
| 1 mother | 4,918,140 | 7,613,240 | 65% |
| 1 child | 361,390 | 6,507,434 | 6% |
| 1 child | 1,885,864 | 6,496,348 | 29% |
| 1 child | 2,789,647 | 6,259,288 | 45% |

FIG. 34

| Description | MAPPED_READS | TOTAL_READS | %Mapped Reads |
|---|---|---|---|
| case 1 blastoceol | 68,123 | 8,470,872 | 1% |
| case 1 cell 1 | 4,340,613 | 8,248,598 | 53% |
| case 1 cell 2 | 5,480,580 | 8,230,870 | 67% |
| case 1 cell 3 | 4,664,577 | 7,846,040 | 59% |
| case 2 blastoceol | 45,794 | 6,302,957 | 1% |
| case 2 cell 1 | 6,988,854 | 8,622,495 | 81% |
| case 2 cell 2 | 7,083,600 | 8,843,495 | 80% |
| case 2 cell 3 | 5,811,364 | 8,256,310 | 70% |

FIG. 36

|  | gDNA | Single Cell |
|---|---|---|
| Count | 75 | 510 |
| Mean | 0.15 % | 0.51 % |
| Median | 0.09 % | 0.33 % |
| Max | 1.03 % | 10 % |
| Standard Deviation | 0.16% | 0.79 % |
| 95th percentile | 0.43 % | 1.22 % |
| 90th percentile | 0.37 % | 0.92 % |

| DOE1 | Mapped READS | TOTAL READS | % Mapped | Dropout Count | Median DOR All | NOR | Error Rate (%) |
|---|---|---|---|---|---|---|---|
| 1xMM | 1,112,007 | 1,262,558 | 80.0% | 436 | 26.25 | 1,043,539 | 0.107% |
| 2xMM | 3,412,593 | 3,615,347 | 94.4% | 105 | 147.75 | 3,206,478 | 0.141% |
| F-A | 449,074 | 635,571 | 70.6% | 1379 | 9.625 | 421,228 | 0.077% |
| F-B | 3,293,944 | 3,519,378 | 93.7% | 105 | 142.5 | 3,106,520 | 0.072% |
| F-D | 4,028,128 | 4,109,448 | 98.0% | 122 | 142.5 | 3,796,213 | 0.064% |
| F-J | 3,676,617 | 3,922,330 | 93.7% | 102 | 159.25 | 3,461,304 | 0.079% |

F-A is: 25 mM Tris pH 7.8, 3 mM MgCl$_2$, 0 mM KCl, 10 mM (NH$_4$)$_2$SO$_4$, 50 U/mL Taq Gold    aka F-A Gold F-B is: 75 mM Tris pH 7.8, 6 mM MgCl$_2$, 0 mM KCl, 40 mM (NH$_4$)$_2$SO$_4$, 150 U/mL Taq Gold    aka F-B Gold F-D is: 25 mM Tris pH 8.2, 3 mM MgCl$_2$, 30 mM KCl, 40 mM (NH$_4$)$_2$SO$_4$, 150 U/mL Taq Gold F-J is: 75 mM Tris pH 7.8, 6 mM MgCl$_2$, 0 mM KCl, 40 mM (NH$_4$)$_2$SO$_4$, 150 U/mL Qiagen HS Taq    aka F-B Qiagen

FIG. 45

METHODS FOR SIMULTANEOUS AMPLIFICATION OF TARGET LOCI

CROSS-REFERENCE TO RELATED APPLICATIONS

This application is a continuation of U.S. Utility application Ser. No. 18/126,344, filed Mar. 24, 2023.

U.S. Utility application Ser. No. 18/126,344 is a continuation of U.S. Utility application Ser. No. 17/018,966, filed Sep. 11, 2020, now U.S. Pat. No. 11,939,634.

U.S. Utility application Ser. No. 17/018,966 is a divisional of U.S. Utility application Ser. No. 16/140,298, filed Sep. 24, 2018, now abandoned.

U.S. Utility application Ser. No. 16/140,298 is a continuation of U.S. Utility application Ser. No. 14/918,544, filed Oct. 20, 2015, now U.S. Pat. No. 10,316,362.

U.S. Utility application Ser. No. 14/918,544, filed Oct. 20, 2015, is a continuation-in-part application of U.S. Utility application Ser. No. 14/877,925, filed Oct. 7, 2015, now abandoned; a continuation-in-part application of U.S. Utility application Ser. No. 14/692,703, filed Apr. 21, 2015, now U.S. Pat. No. 10,179,937; a continuation-in-part application of U.S. Utility application Ser. No. 14/538,982, now U.S. Pat. No. 9,677,118, filed Nov. 24, 2014; and claims the benefit of and priority to U.S. Provisional Application Ser. No. 62/148,173, filed Apr. 15, 2015; U.S. Provisional Application Ser. No. 62/147,377, filed Apr. 14, 2015; U.S. Provisional Application Ser. No. 62/146,188, filed Apr. 10, 2015; and U.S. Provisional Application Ser. No. 62/066,514, filed Oct. 21, 2014.

U.S. Utility application Ser. No. 14/877,925, filed Oct. 7, 2015, now abandoned, is a continuation-in-part of U.S. Utility application Ser. No. 14/225,356 (now Abandoned), filed Mar. 25, 2014; is a continuation-in-part of U.S. Utility application Ser. No. 13/780,022 (now Abandoned), filed Feb. 28, 2013; and is a continuation of U.S. Utility application Ser. No. 13/683,604 (now Abandoned), filed Nov. 21, 2012.

U.S. Utility application Ser. No. 14/692,703, filed Apr. 21, 2015, now U.S. Pat. No. 10,179,937, claims the benefit of and priority to U.S. Provisional Application Ser. No. 62/148,173, filed Apr. 15, 2015; U.S. Provisional Application Ser. No. 62/147,377, filed Apr. 14, 2015; U.S. Provisional Application Ser. No. 62/146,188, filed Apr. 10, 2015; U.S. Provisional Application Ser. No. 62/066,514, filed Oct. 21, 2014; U.S. Provisional Application Ser. No. 61/994,791, filed May 16, 2014; U.S. Provisional Application Ser. No. 61/987,407, filed May 1, 2014; and U.S. Provisional Application Ser. No. 61/982,245, filed Apr. 21, 2014.

U.S. Utility application Ser. No. 14/538,982, now U.S. Pat. No. 9,677,118, filed Nov. 24, 2014 claims the benefit of and priority to U.S. Provisional Application Ser. No. 62/066,514, filed Oct. 21, 2014; U.S. Provisional Application Ser. No. 61/994,791, filed May 16, 2014; U.S. Provisional Application Ser. No. 61/987,407, filed May 1, 2014; and U.S. Provisional Application Ser. No. 61/982,245, filed Apr. 21, 2014.

U.S. Utility application Ser. No. 14/225,356 (now Abandoned), filed Mar. 25, 2014 is a continuation of PCT Application PCT/US2012/58578, filed Oct. 3, 2012.

U.S. Utility application Ser. No. 13/780,022 (now Abandoned), filed Feb. 28, 2013, is a continuation-in-part of U.S. Utility application Ser. No. 13/683,604 (now Abandoned), filed Nov. 21, 2012; a continuation-in-part of PCT Application No. PCT/US2012/58578, filed Oct. 3, 2012; a continuation-in-part of U.S. Utility application Ser. No. 13/335,043, filed Dec. 22, 2011, now U.S. Pat. No. 10,113,196; a continuation-in-part of U.S. Utility application Ser. No. 13/300,235, filed Nov. 18, 2011, now U.S. Pat. No. 10,017,812; and an continuation-in-part of U.S. Utility application Ser. No. 13/110,685 (now U.S. Pat. No. 8,825,412), filed May 18, 2011, and also claims the benefit of U.S. Provisional Application Ser. No. 61/634,431, filed Feb. 29, 2012.

U.S. Utility application Ser. No. 13/683,604 (now Abandoned), filed Nov. 21, 2012, is a continuation-in-part of U.S. Utility application Ser. No. 13/300,235 (now U.S. Pat. No. 10,017,812), filed Nov. 18, 2011; is a continuation-in-part of U.S. Utility application Ser. No. 13/110,685 (now U.S. Pat. No. 8,825,412), filed May 18, 2011; and claims the benefit of and priority to U.S. Provisional Application Ser. No. 61/675,020, filed Jul. 24, 2012.

PCT Application No. PCT/US2012/058578, filed Oct. 3, 2012, is a continuation-in-part of U.S. Utility application Ser. No. 13/300,235 (now U.S. Pat. No. 10,017,812), filed Nov. 18, 2011; and claims the benefit of and priority to U.S. Provisional Application Ser. No. 61/683,331, filed Aug. 15, 2012; and U.S. Provisional Application Ser. No. 61/542,508, filed Oct. 3, 2011.

U.S. Utility application Ser. No. 13/335,043, filed Dec. 22, 2011, is a continuation-in-part of U.S. Utility application Ser. No. 13/300,325 (now U.S. Pat. No. 10,017,812), filed Nov. 18, 2011; a continuation-in-part of U.S. Utility application Ser. No. 13/110,685 (now U.S. Pat. No. 8,825,412), filed May 18, 2011; and claims the benefit of U.S. Provisional Application Ser. No. 61/426,208, filed Dec. 22, 2010.

U.S. Utility application Ser. No. 13/300,235 (now U.S. Pat. No. 10,017,812), filed Nov. 18, 2011 is a continuation-in-part of U.S. Utility application Ser. No. 13/110,685 (now U.S. Pat. No. 8,825,412), filed May 18, 2011; and claims the benefit of U.S. Provisional Application Ser. No. 61/542,508, filed Oct. 3, 2011; and U.S. Provisional Application Ser. No. 61/571,248, filed Jun. 23, 2011.

U.S. Utility application Ser. No. 13/110,685 (now U.S. Pat. No. 8,825,412), filed May 18, 2011, claims the benefit of U.S. Provisional Application Ser. No. 61/516,996, filed Apr. 12, 2011; U.S. Provisional Application Ser. No. 61/448,547, filed Mar. 2, 2011; U.S. Provisional Application Ser. No. 61/462,972, filed Feb. 9, 2011; U.S. Provisional Application Ser. No. 61/398,159, filed Jun. 21, 2010; and U.S. Provisional Application Ser. No. 61/395,850, filed May 18, 2010.

Each of these applications cited above is hereby incorporated by reference in its entirety.

SEQUENCE LISTING

The instant application contains a Sequence Listing which has been submitted electronically in ASCII format and is hereby incorporated by reference in its entirety. Said ASCII copy, created on Aug. 20, 2020, is named N012US33_SL.txt and is 8,726 kilo bytes in size.

FIELD OF THE INVENTION

The present invention generally relates to methods and compositions for simultaneously amplifying multiple nucleic acid regions of interest in one reaction volume.

BACKGROUND OF THE INVENTION

To increase assay throughput and allow more efficient use of nucleic acid samples, simultaneous amplification of many target nucleic acids in a sample of interest can be carried out by combining many oligonucleotide primers with the sample and then subjecting the sample to polymerase chain reaction (PCR) conditions in a process known in the art as multiplex PCR. Use of multiplex PCR can significantly simplify experimental procedures and shorten the time required for nucleic acid analysis and detection. However, when multiple pairs are added to the same PCR reaction, non-target amplification products may be generated, such as amplified primer dimers. The risk of generating such products increases as the number of primers increases. These non-target amplicons significantly limit the use of the amplified products for further analysis and/or assays. Thus, improved methods are needed to reduce the formation of non-target amplicons during multiplex PCR.

Improved multiplex PCR methods would be useful for a variety of application, such as Non-Invasive Prenatal Genetic Diagnosis (NPD). In particular, current methods of prenatal diagnosis can alert physicians and parents to abnormalities in growing fetuses. Without prenatal diagnosis, one in 50 babies is born with serious physical or mental handicap, and as many as one in 30 will have some form of congenital malformation. Unfortunately, standard methods have either poor accuracy, or involve an invasive procedure that carries a risk of miscarriage. Methods based on maternal blood hormone levels or ultrasound measurements are non-invasive, however, they also have low accuracies. Methods such as amniocentesis, chorion villus biopsy and fetal blood sampling have high accuracy, but are invasive and carry significant risks. Amniocentesis was performed in approximately 3% of all pregnancies in the US, though its frequency of use has been decreasing over the past decade and a half.

Normal humans have two sets of 23 chromosomes in every healthy, diploid cell, with one copy coming from each parent. Aneuploidy, a condition in a nuclear cell where the cell contains too many and/or too few chromosomes is believed to be responsible for a large percentage of failed implantations, miscarriages, and genetic diseases. Detection of chromosomal abnormalities can identify individuals or embryos with conditions such as Down syndrome, Klinefelter's syndrome, and Turner syndrome, among others, in addition to increasing the chances of a successful pregnancy. Testing for chromosomal abnormalities is especially important as the mother's age: between the ages of 35 and 40 it is estimated that at least 40% of the embryos are abnormal, and above the age of 40, more than half of the embryos are abnormal.

It has recently been discovered that cell-free fetal DNA and intact fetal cells can enter maternal blood circulation. Consequently, analysis of this genetic material can allow early NPD. Improved methods are desired to improve the sensitivity and specificity and reduce the time and cost required for NPD.

SUMMARY OF THE INVENTION

In one aspect, the invention features methods of amplifying target loci in a nucleic acid sample. In some embodiments, the method involves (i) contacting the nucleic acid sample with a library of test primers (such as non-immobilized primers) that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, the method involves multiplex PCR and sequencing (such as high throughput sequencing). In some embodiments, the method includes selecting the test primers from a library of candidate primers by removing one or more of the candidate primers based at least in part on the likelihood of dimer formation between candidate primers (such as ΔG values, undesirability scores, or interaction scores) prior to contacting the nucleic acid sample with the library of test primers.

In some embodiments, the method involves (i) contacting a sample comprising target human loci with a library of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein the annealing temperature for the reaction conditions is greater than a melting temperature (such as the empirically measured or calculated $T_m$) of at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) of the non-identical primers and/or the length of the annealing step of the reaction conditions is greater than 5 minutes (such as at least 8, 10, 15, 20, 30, 45, 60, 75, 90, 120, 150, or 180 minutes; and wherein at least 50 (such as at least 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci.

In some embodiments, the method involves (i) contacting a sample comprising target human loci with a library of at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-immobilized, non-identical primers that simultaneously hybridize to at least 2 (such as at least 5, 10, 25 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000) non-identical target human loci to produce a reaction mixture; wherein the primers do not include molecular inversion probes (MIPs); (ii) subjecting the reaction mixture to primer extension reaction conditions to produce amplified products comprising target amplicons; wherein at least 2 (such as at least 5, 10, 25 50; 75; 100; 300; 500; 750; 1,000; 2,000; 5,000;

7,500; 10,000; 15,000; 19,000; 20,000; 25,000; 27,000; 28,000; 30,000; 40,000; 50,000; 75,000; 100,000) non-identical target human loci are simultaneously amplified; and (iii) detecting the amplified products such as by sequencing the amplified products or hybridizing the amplified products to an array. In various embodiments, (i) the annealing temperature is at least 1, 2, 3, 4, 5, 6, 7, 8, 9, 10, 11, 12, 13, or 15° C. greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (ii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; (iii) the annealing temperature is at least 1, 2, 3, 4, 5, 6, 7, 8, 9, 10, 11, 12, 13, or 15° C. greater than the highest melting temperature (such as the empirically measured or calculated $T_m$) of the primers; (iv) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers; (v) the annealing temperature is at least 1, 2, 3, 4, 5, 6, 7, 8, 9, 10, 11, 12, 13, or 15° C. greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers; or (vi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 2, 5, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, (i) the length of the annealing step (per PCR cycle) is greater than 1, 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive. In various embodiments, any of the embodiments for annealing temperature are combined with any of the embodiments for annealing time. In various embodiments, the annealing temperature is at least 3° C. greater than the melting temperature of at least 50 of the non-identical primers, the annealing temperature is at least 3° C. greater than the highest melting temperature of the primers, the annealing temperature is at least 8° C. greater than the highest melting temperature of the primers, the annealing temperature is at least 3° C. greater than the average melting temperature of the primers, the annealing temperature is at least 8° C. greater than the average melting temperature of the primers, the range of melting temperature of the primers is between 1 to 5° C., inclusive, the range of melting temperatures of the primers is less than 5° C., or any combination thereof. In some embodiments, the method includes empirically measuring or calculating (such as calculating with a computer) the melting temperature of at least 25, 50, 80, 90, 92, 94, 96, 98, 99, or 100% of the primers in the library and selecting an annealing temperature that satisfies any of these embodiments for PCR amplification of target loci. In some embodiments, a crowding agent, such as PEG or glycerol is included in the reaction mixture.

In various embodiments of any of the aspects of the invention, the method includes non-specifically amplifying nucleic acids in a sample comprising target human loci; contacting the amplified nucleic acids with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the non-specific amplification comprises universal polymerase chain reaction (PCR), whole genome application, ligation-mediated PCR, degenerate oligonucleotide primer PCR, or multiple displacement amplification. In some embodiments, the method includes contacting a sample comprising target human loci with a library of non-identical primers (such as non-immobilized primers) that simultaneously hybridize to at least 1,000 non-identical target human loci to produce a reaction mixture; wherein the primers do not include molecular inversion probes (MIPs); subjecting the reaction mixture to primer extension reaction conditions to produce amplified products comprising target amplicons; wherein the annealing temperature for the reaction conditions is greater than the melting temperature of at least 1,000 of the non-identical primers; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture in which the concentration of each primer is less than 20 nM; wherein the primers do not include molecular inversion probes (MIPs); subjecting the reaction mixture to primer extension reaction conditions to produce amplified products comprising target amplicons; wherein the length of the annealing step of the reaction conditions is greater than 10 minutes; and wherein at least 1,000 non-identical target human loci are simultaneously amplified; and sequencing the amplified products. In some embodiments, the method includes contacting a sample comprising target human loci with a library of non-identical primers (such as non-immobilized primers) that simultaneously hybridize to at least 1,000 non-identical target human loci to produce a reaction mixture; wherein the guanine-cytosine (GC) content of the primers is between 30% and 80%, inclusive; wherein the range of melting temperatures of the primers is less than 5° C.; wherein the length of the primers is between 15 to 75 nucleotides, inclusive; and wherein the primers do not include molecular inversion probes (MIPs); subjecting the reaction mixture to primer extension reaction conditions to produce amplified products comprising target amplicons; wherein at least 1,000 non-identical target human loci are simultaneously amplified; and sequencing the amplified products. In some embodiments, the method does not comprise using a microarray. In some embodiments, the library includes a least 25; 50; 75; 100; 300; 500; 750; 1,000; 2,000; 5,000; 7,500; 10,000; 15,000; 19,000; 20,000; 25,000; 27,000; 28,000; 30,000;

40,000; 50,000; 75,000; or 100,000 different primers. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified.

In various embodiments of any of the aspects of the invention, the ΔG values for each possible combination of two primers in the library are all equal to or greater than −5 kcal/mol. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes a forward primer and a reverse primer that hybridize to the same target human locus. In some embodiments, the method also includes simultaneously PCR-amplifying at least 1,000 non-identical target human loci in the first set of amplified products using at least 1,000 non-identical primer pairs (such as non-immobilized primer pairs) to produce a second set of amplified products; wherein each primer pair includes a forward primer and a reverse primer that hybridize to the same target human locus. In some embodiments, the primer pairs used in the first and second round of PCR are the same. In some embodiments, the primer pairs used in the first and second round of PCR are different. In some embodiments, the forward primers used in the first and second round of PCR are the same, and the reverse primers used in the first and second round of PCR are different. In some embodiments, the forward primers used in the first and second round of PCR are different, and the reverse primers used in the first and second round of PCR are the same. In some embodiments, the method simultaneously PCR-amplifying at least 1,000 non-identical target human loci in the sample using at least 1,000 non-identical primer pairs (such as non-immobilized primer pairs) to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal reverse primer and at least 1,000 non-identical inner forward primers to produce a second set of amplified products; wherein each inner forward primer hybridizes to a region downstream from the corresponding outer forward primer. In some embodiments, the method includes simultaneously PCR-amplifying at least 1,000 non-identical target human loci in the sample using at least 1,000 non-identical primer pairs to produce a first set of amplified products; wherein each primer pair includes an outer forward primer and an outer reverse primer that hybridize to the same target human locus; and simultaneously PCR-amplifying at least 1,000 non-identical target human loci in the first set of amplified products using a universal forward primer and at least 1,000 non-identical inner reverse primers to produce a second set of amplified products; wherein each inner reverse primer hybridizes to a region upstream from the corresponding outer reverse primer. In some embodiments, the method includes simultaneously PCR-amplifying at least 1,000 non-identical target human loci in the sample using at least 1,000 non-identical forward primers and a universal reverse primer to produce a first set of amplified products; and simultaneously PCR-amplifying at least 1,000 non-identical target human loci in the first set of amplified products using a universal forward primer and at least 1,000 non-identical reverse primers to produce a second set of amplified products. In some embodiments, the method includes simultaneously PCR-amplifying at least 1,000 non-identical target human loci in the sample using at least 1,000 non-identical reverse primers and a universal forward primer to produce a first set of amplified products; and simultaneously PCR-amplifying at least 1,000 non-identical target human loci in the first set of amplified products using a universal reverse primer and at least 1,000 non-identical forward primers to produce a second set of amplified products. In some embodiments, at least 96% of the primer molecules are extended to form amplified products. In some embodiments, the annealing temperature is at least 1, 2, 3, 4, 5, 6, 7, 8, 9, 10, 11, 12, 13, or 15° C. greater than the melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the highest melting temperature of the non-identical primers. In some embodiments, the annealing temperature is at least 1, 2, 3, 4, 5, 6, 7, 8, 9, 10, 11, 12, 13, or 15° C. greater than the average melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the range of melting temperature of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers is between 1 to 5° C., inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers have 2, 1, or 0 guanines or cytosines in the last 5 bases at the 3' end of the primers. In some embodiments, the sample comprises maternal DNA from the pregnant mother of a fetus and fetal DNA, and wherein the method comprises determining the presence or absence of a fetal chromosome abnormality from the sequencing data. In some embodiments, the sample is from an individual suspected of having cancer or an above normal risk for cancer; and wherein one or more of the target human loci comprises a polymorphism or other mutation associated with an above normal risk for cancer or associated with cancer.

In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, or 99.5% of the amplified products are target amplicons. In some embodiments, at least 50, 60, 70, 80, 90, 95, 96, 97, 98, 99, or 99.5% of the target loci are amplified. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 test primer pairs, wherein each pair of primers includes a forward test primer and a reverse test primer that hybridize to the same target locus. In some embodiments, the library of test primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual test primers that hybridize to different target loci, wherein the individual primers are not part of primer pairs.

In various embodiments of any of the aspects of the invention, the concentration of each test primer is less than 100, 75, 50, 25, 10, 5, 2, 1, 0.5, 0.1, or 0.05 nM. In various embodiments, the guanine-cytosine (GC) content of the test primers is between 30 to 80%, such as between 20 to 70%, 40 to 70%, or 50 to 60%, inclusive. In some embodiments, the range of GC content (e.g., the maximum GC content minus minimum GC content, such as 80%–60%=a range of 20%) of the test primers is less than 30, 20, 10, or 5%. In some embodiments, there are at least 2 (such as 3, 4, or 5) guanines or cytosines in the last 5 bases at the 3' end of the primers. In some embodiments, a maximum of 2 (such as 2, 1, or 0) of the bases in the last 5 bases at the 3' end of the primers are guanines or cytosines. In some embodiments, there are at least 1 (such as 2 or 3) guanines or cytosines in the last 3 bases at the 3' end of the primers. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the range of melting temperatures of the test primers is less than 20, 15, 10, 5, 3, or 1° C. In some embodiments, the length of the test primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, the test primers include a tag that is not target specific, such as a tag that forms an internal loop structure. In some embodiments, the tag is between two DNA binding regions. In various embodiments, the test primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the test primers include a 5' region that is not specific for a target locus (such as a tag or a universal primer binding site) followed by a region that is specific for a target locus, an internal region that is not specific for the target locus and forms a loop structure, and a 3' region that is specific for the target locus. In some embodiments, the range of the length of the test primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. In some embodiments, the range of the length of the target amplicons is less than 50, 25, 15, 10, or 5 nucleotides. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, average length ±30%, or average length ±50%.

In various embodiments of any of the aspects of the invention, the primer extension reaction conditions are polymerase chain reaction conditions (PCR). In various embodiments, the length of the annealing step is greater than 3, 5, 8, 10, 15, 20, 30, 45, 60, 75, 90, 120, 150, or 180 minutes. In various embodiments, the length of the extension step is greater than 0.2, 0.5, 1, 3, 5, 8, 10, or 15 minutes.

In various embodiments of any of the aspects of the invention, the test primers are used to simultaneously amplify at least 300 different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using at least 300 specific primers and a universal primer to produce a first set of amplified products; and amplifying the first set of amplified products using at least 300 pairs of specific primers to produce a second set of amplified products.

In various embodiments of any of the aspects of the invention, the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of the fetus and fetal DNA to establish whether the alleged father is the biological father of the fetus.

In various embodiments of any of the aspects of the invention, the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization.

In various embodiments of any of the aspects of the invention, the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes In various embodiments of any of the aspects of the invention, the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest (such as cancer), or an increased risk (such as an above normal level of risk) for a disease or phenotype of interest; and wherein one or more of the target loci include a sequence (e.g., a polymorphism or other mutation) associated with an increased risk (such as an above normal level of risk) for the disease or phenotype of interest, or associated with the disease or phenotype of interest. In various embodiments, the method involves using the test primers to simultaneously amplify e.g. at least 100 (e.g., at least 300 or 1,000) different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest.

In some embodiments of any of the aspects of the invention, the test primers are selected from a library of candidate primers based on one or more parameters, such as the selection of primers using any of the methods of the invention. In some embodiments, the test primers are selected from a library of candidate primers based at least in part on the ability of the candidate primers to form primer dimers.

In one aspect, the invention features methods of selecting test primers from a library of candidate primers. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below a minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In one aspect, the invention features methods of selecting test primers from a library of candidate primers. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a library of test primers. In some embodiments, the selection method is performed until the score (such as the undesirability score) for the candidate primer combinations remaining in the library are all equal to or below the first minimum threshold. In some embodiments, the selection method is performed until the number of candidate primers remaining in the library is reduced to a desired number. In various embodiments, a score (such as an undesirability score) is calculated for at least 80, 90, 95, 98, 99, or 99.5% of the possible combinations of candidate primers in the library. In various embodiments, the candidate primers remaining in the library are capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes (v) contacting a nucleic acid sample that includes target loci with the candidate primers remaining in the library to produce a reaction mixture; and (vi) subjecting the reaction mixture to primer extension reaction conditions to produce amplified products that includes target amplicons.

In various embodiments of any of the aspects of the invention, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number.

In various embodiments of any of the aspects of the invention, the method involves, prior to step (i), identifying or selecting primers that hybridize to the target loci. In some embodiments, multiple primers (or primer pairs) hybridize to the same target locus, and the selection method is used to select a one primer (or one primer pair) for this target locus based on one or more parameters. In various embodiments, the method involves, prior to step (ii), removing a primer pair from the library that produces a target amplicon that overlaps with a target amplicon produced by another primer pair. In various embodiments, a candidate primer is selected out of a group of two or more candidate primers with equal scores (such as undesirability scores) for removal from the library of candidate primers based on one or more other parameters. In some embodiments, the candidate primers remaining in the library are used as a library of test primers in any of the methods of the invention. In some embodiments, the resulting library of test primers includes any of the primer libraries of the invention.

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2,3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In various embodiments, a score (such as an undesirability score) is calculated for at least 80, 90, 95, 98, 99, or 99.5% of the possible combinations of candidate primers in the library. In some embodiments, the score is based at least in part on the current coverage of the bases in the target locus (such as the number of other primer pools that have a primer or primer pair that amplifies a particular base in the target locus). In various embodiments, one or more of the pools are each capable of simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In various embodiments, the method also includes separately contacting a nucleic acid sample that includes target loci with two or more of the pools to produce separate reaction mixtures; and (vi) subjecting the reaction mixtures to primer extension reaction conditions to produce amplified products that includes target amplicons.

In some embodiments, at least 70, 80, 85, 90, 95, or 100% of the nucleotides in a region of interest (such as an exon) are included in at least 1, 2, 3, or 4 different amplicons (i.e., amplicons with non-identical sequences that are formed by different primers or primer pairs). In some embodiments, at least 70, 80, 85, 90, 95, or 100% of the nucleotides in at least 70, 80, 85, 90, 95, or 100% of the regions of interest are amplified by at least 1, 2, 3, or 4 different amplicons. In some embodiments in which 2-fold coverage is desired, the primers are divided into at least two different pools such the amplicons in each pool do not overlap with each other (which would cause interference during amplification).

In various embodiments of any of the aspects of the invention, the score (such as the undesirability score) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a sample that includes maternal DNA from the pregnant mother of a fetus and fetal DNA to determine the presence or absence of a fetal chromosome abnormality. In various embodiments, the method includes ligating a universal primer binding site to the DNA molecules in the sample; amplifying the ligated DNA molecules using e.g. at least 100 (e.g., at least 300 or 1,000) specific primers and a universal primer to produce a first set of amplified products; and amplifying the first set of amplified products using e.g. at least 100 (e.g., at least 300 or 1,000) pairs of specific primers to produce a second set of amplified products. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in sample includes DNA from an alleged father of a fetus and to simultaneously amplify the target loci in a sample that includes maternal DNA from the pregnant mother of a fetus and fetal DNA to establish whether the alleged father is the biological father of the fetus. In various embodiments, at least 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the score (such as the undesirability score) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in one cell or multiple cells from an embryo to determine the presence or absence of a chromosome abnormality. In various embodiments, cells from a set of two or more embryos are analyzed, and one embryo is selected for in vitro fertilization. In various embodiments, at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, specificity of the candidate primer for the target locus; size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the test primers are used to simultaneously amplify e.g. at least 100 (e.g., at least 300 or 1,000) different target loci in a forensic nucleic acid sample. In various embodiments, the length of the annealing step is greater than 3, 5, 8, 10, 15, 20, 30, 45, 60, 75, 90, 120, 150, or 180 minutes. In various embodiments, at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000) different target loci in a control nucleic acid sample to produce a first set of target amplicons and to simultaneously amplify the target loci in a test nucleic acid sample to produce a second set of target amplicons; and comparing the first and second sets of target amplicons to determine whether a target locus is present in one sample but absent in the other, or whether a target locus is present at different levels in the control sample and the test sample. In various embodiments, the test sample is from an individual suspected of having a disease or phenotype of interest, or an increased risk for a disease or phenotype of interest; and wherein one or more of the target loci include a sequence (e.g., a polymorphism) at the target locus associated with an increased risk for the disease or phenotype of interest, or associated with the disease or phenotype of interest. In various embodiments, at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In various embodiments of any of the aspects of the invention, the scores (such as the undesirability scores) are based at least in part on one or more parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon; and the method involves using the test primers to simultaneously amplify e.g. at least 100 (e.g., at least 300 or 1,000); different target loci in a control sample that includes RNA to produce a first set of target amplicons and to simultaneously amplify the target loci in a test sample that includes RNA to produce a second set of target amplicons; and comparing the first and second sets of target amplicons to determine the presence or absence of a difference in the RNA expression levels between the control sample and the test sample. In various embodiments, the RNA is mRNA. In various embodiments, the test sample is from an individual suspected of having a disease or phenotype of interest (such as cancer) or an increased risk for the disease or phenotype of interest (such as cancer); and wherein one or more of the target loci includes a sequence (e.g., a polymorphism or other mutation) associated with an increased risk for the disease or phenotype of interest or associated with the disease or phenotype of interest. In some embodiments, the test sample is from an individual diagnosed with a disease or phenotype of interest (such as cancer); and wherein a difference in the RNA expression level between the control sample and test sample indicates a target locus includes a sequence (e.g., a polymorphism or other mutation) associated with an increased or decreased risk for the disease or phenotype of interest. In various embodiments, at least 300; 500; 750; 1,000; 2000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold.

In one aspect, the invention features libraries of primers (such as non-immobilized primers). In some embodiments, the primers are selected from a library of candidate primers using any of the methods of the invention. In some embodiments, the library includes primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that less than 60, 40, 30, 20, 10, 5, 4, 3, 2, 1, 0.5, 0.25, 0.1, or 0.05% of the amplified products are primer dimers. In some embodiments, the library includes primers that simultaneously amplify at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci such that at least 50, 60, 70, 80, 90, 95, 96, 97, 98, 99, or 99.5% of the amplified products are target amplicons. In some embodiments, the library includes primers that simultaneously amplify target loci such that at least 50, 60, 70, 80, 90, 95, 96, 97, 98, 99, or 99.5% of the target loci out of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs. In some embodiments, the primers in the library are not immobilized (such as not immobilized to a solid support) or not part of a microarray. In some embodiments, the primers are dissolved in solution (such as dissolved in the liquid phase). In some embodiments, the library of primers consists essentially of, or consists of primers.

In some embodiments, ΔG values for each possible combination of two primers (each possible primer dimer) in a library are all equal to or greater than −20, −18, −16, −14, −12, −10, −9, −8, −7, −6, −5, −4, −3, −2, or −1 kcal/mol. In some embodiments, ΔG values for at least 80, 85, 90, 92, 94, 96, 98, 99, or 100% of the primers in the library for possible combinations of that primer with other primers in the library are all equal to or greater than −20, −18, −16, −14, −12, −10, −9, −8, −7, −6, −5, −4, −3, −2, or −1 kcal/mol.

In various embodiments of any of the aspects of the invention, the concentration of each primer is less than 100, 75, 50, 25, 10, 5, 2, 1, 0.5, 0.1, or 0.05 nM. In various embodiments, the GC content of the primers is between 30 to 80%, such as between 40 to 70%, 20 to 70%, or 50 to 60%, inclusive. In some embodiments, the range of GC content of the primers is less than 30, 20, 10, or 5%. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, the melting temperature of the primers is between 40 to 80° C., such as 50 to 70° C., 55 to 65° C., 54 to 60.5° C., or 57 to 60.5° C., inclusive. In some embodiments, the range of melting temperature of the primers is less than 15, 10, 5, 3, or 1° C. In some embodiments, the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive. In some embodiments, the primers include a tag that is not target specific, such as a tag that forms an internal loop structure. In some embodiments, the tag is between two DNA binding regions. In various embodiments, the primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as another tag or a universal primer binding site) followed by a region that is specific for a target locus, an internal region that is not specific for the target locus and forms a loop structure, and a 3' region that is specific for the target locus. In some embodiments, the range of the length of the primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the target loci are on two or more different chromosomes, such as two or more of chromosomes 13, 18, 21, X and Y. In some embodiments, the target loci are target human loci. In some embodiments, the target loci includes a sequence (e.g., a polymorphism or other mutation) associated with an increased risk for the disease or phenotype of interest (such as cancer), or associated with the disease or phenotype of interest (such as cancer). In some embodiments, the polymorphism or mutation is a driver mutation that has a causative role in the disease or phenotype of interest (such as cancer). In some embodiments, the polymorphism or mutation is not a causative mutation. For example, in some cancers, multiple mutations accumulate but some of them are not causative mutations. Polymorphisms or mutations (such as those that are present at a higher frequency in subjects with a disease or phenotype of interest such as cancer than subjects without the disease or phenotype of interest such as cancer) that are not causative can still be useful for diagnosing the disease or phenotype. In some embodiments, the polymorphisms or mutation is present at a higher frequency in subjects with a disease or disorder (such as cancer) than subjects (such as healthy or normal subjects) without the disease or disorder (such as cancer). In some embodiments, the polymorphisms or mutation is indicative of cancer, such as a causative mutation. In some embodiments, the polymorphism(s) or mutation(s) are directly detected. In some embodiments, the polymorphism(s) or mutation(s) are indirectly detected by detection of one or more sequences (e.g., a polymorphic locus such as a SNP) that are linked to the polymorphism or mutation).

In one aspect, the invention provides a composition that includes any of the primer libraries of the invention (such as non-immobilized primers). In some embodiments, the composition includes one or more free nucleotides (such as deoxynucleotides, ATP, CTP, GTP, TTP, UTP, dATP, dCTP, dGTP, dTTP, dUTP an activated nucleotide or deoxynucleotide, or a non-naturally occurring nucleotide or deoxynucleotide). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and one or more non-human or non-naturally occurring enzymes (e.g., ligase or polymerase from a species other than a human, such as a bacterial or non-naturally-occurring ligase or polymerase). In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with the polynucleotide sequence of a human nucleic acid and a buffer or additive that is non-naturally-occurring or is not found in a human. In some embodiments, the composition comprises, consists essentially of, or consists of one or more of the following: primer(s), amplicon(s) free nucleotide(s), non-human or non-naturally occurring enzyme(s), buffer(s), additive(s), or any combination thereof. In some embodiments, the composition comprises, consists essentially of, or consists of primers and one or more non-human or non-naturally occurring enzymes. Exemplary non-naturally occurring enzymes contain at least one sequence difference compared to naturally occurring (wild-type) enzymes.

In one aspect, the invention provides a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume. In some embodiments, the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides a composition comprising at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 and 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume. In some embodiments, the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof. In some embodiments, at least one amplicon or primer has a non-human or non-naturally occurring sequence, nucleotide, or linkage between nucleotides.

In one aspect, the invention provides kits that include any of the primer libraries or compositions of the invention for amplifying target loci in a nucleic acid sample. In some embodiments, the kits consists essentially of, or consists of primers, primers and instructions for using the primers, a composition of the invention, or a composition of the invention and instructions for using the composition. In some embodiments, the kit includes instructions for using the library to amplify the target loci.

In one aspect, the invention provides an apparatus, device, or composition that includes any of the primer libraries or compositions of the invention. In some embodiments, the apparatus, device, or composition includes a physical structure (such as one or more reaction vessels, reaction chambers, or wells) that contains the primer library or composition of the invention (for example, the primers may be dissolved in a solution that is in the physical structure). In some embodiments, the physical structure is a non-naturally occurring physical structure or a physical structure that does not naturally contain a primer library or composition of the invention (such as a physical structure that is not found in nature with nucleic acids in it).

In one aspect, the invention features methods for determining a ploidy status of chromosome in a gestating fetus. In some embodiments, the method involves contacting a nucleic acid sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci to produce a reaction mixture; wherein the nucleic acid sample includes maternal DNA from the mother of the fetus and fetal DNA from the fetus. In some embodiments, the reaction mixture is subjected to primer extension reaction conditions to produce amplified products; the amplified products are measured with a high throughput sequencer to produce sequencing data; allele counts at the polymorphic loci are calculated on a computer based on the sequencing data; a plurality of ploidy hypotheses each pertaining to a different possible ploidy state of the chromosome are created on a computer; a joint distribution model for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability.

In one aspect, the invention features methods for determining a ploidy status of a chromosome in a gestating fetus. In an embodiment a method for determining a ploidy status of a chromosome in a gestating fetus includes obtaining a first sample of DNA that comprises maternal DNA from the mother of the fetus and fetal DNA from the fetus, preparing the first sample by isolating the DNA so as to obtain a prepared sample, measuring the DNA in the prepared sample at a plurality of polymorphic loci on the chromosome, calculating, on a computer, allele counts at the plurality of polymorphic loci from the DNA measurements made on the prepared sample, creating, on a computer, a plurality of ploidy hypotheses each pertaining to a different possible ploidy state of the chromosome, building, on a computer, a joint distribution model for the expected allele counts at the plurality of polymorphic loci on the chromosome for each ploidy hypothesis, determining, on a computer, a relative probability of each of the ploidy hypotheses using the joint distribution model and the allele counts measured on the prepared sample, and calling the ploidy state of the fetus by selecting the ploidy state corresponding to the hypothesis with the greatest probability.

In one aspect, the invention features methods of testing for an abnormal distribution of a chromosome in a sample that includes a mixture of maternal and fetal DNA. In some embodiments, the method involves (i) contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes include at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing on a computer the numbers from step (v) to determine the presence or absence of an abnormal distribution of the first chromosome.

In one aspect, the invention provides methods for detecting the presence or absence of a fetal aneuploidy. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy.

In one aspect, a method is disclosed for determining presence or absence of fetal aneuploidy in a maternal tissue sample comprising fetal and maternal genomic DNA, the method including (a) obtaining a mixture of fetal and maternal genomic DNA from said maternal tissue sample, (b) conducting massively parallel DNA sequencing of DNA fragments randomly selected from the mixture of fetal and maternal genomic DNA of step (a) to determine the sequence of said DNA fragments, (c) identifying chromosomes to which the sequences obtained in step (b) belong, (d) using the data of step (c) to determine an amount of at least one first chromosome in said mixture of maternal and fetal genomic DNA, wherein said at least one first chromosome is presumed to be euploid in the fetus, (e) using the data of step (c) to determine an amount of a second chromosome in said mixture of maternal and fetal genomic DNA, wherein said second chromosome is suspected to be aneuploid in the fetus, (f) calculating the fraction of fetal DNA in the mixture of fetal and maternal DNA, (g) calculating an expected distribution of the amount of the second target chromosome if the second target chromosome is euploid, using the number in step (d), (h) calculating an expected distribution of the amount of the second target chromosome if the second target chromosome is aneuploid, using the first number is step (d) and the calculated fraction of fetal DNA in the mixture of fetal and maternal DNA in step (f), and (i) using a maximum likelihood or maximum a posteriori approach to determine whether the amount of the second chromosome as determined in step (e) is more likely to be part of the distribution calculated in step (g) or the distribution calculated in step (h); thereby indicating the presence or absence of a fetal aneuploidy.

In various embodiments of any of the aspects of the invention, the target loci include one or more SNPs in the homologous non-recombining region of chromosome X and/or chromosome Y. In some embodiments, the method includes determining the relative amount of chromosome X and chromosome Y. In some embodiments, the method includes determining the number of copies of chromosome X and/or chromosome Y.

In some embodiments, the method also includes obtaining genotypic data from one or both parents of the fetus. In some embodiments, obtaining genotypic data from one or both parents of the fetus includes preparing the DNA from the parents where the preparing comprises preferentially enriching the DNA at the plurality of polymorphic loci to give prepared parental DNA, optionally amplifying the prepared parental DNA, and measuring the parental DNA in the prepared sample at the plurality of polymorphic loci.

In various embodiments of any of the aspects of the invention, building a joint distribution model for the expected allele count probabilities of the plurality of polymorphic loci on the chromosome is done using the obtained genetic data from the one or both parents. In some embodiments, the sample (e.g., the first sample) has been isolated from maternal plasma and where the obtaining genotypic data from the mother is done by estimating the maternal genotypic data from the DNA measurements made on the prepared sample.

In one aspect, a diagnostic box is disclosed for helping to determine a ploidy status of a chromosome in a gestating fetus where the diagnostic box is capable of executing the preparing and measuring steps of any of the methods of the invention.

In various embodiments of any of the aspects of the invention, the allele counts are probabilistic rather than binary. In some embodiments, measurements of the DNA in the prepared sample at the plurality of polymorphic loci are also used to determine whether or not the fetus has inherited one or a plurality of disease linked haplotypes.

In various embodiments of any of the aspects of the invention, building a joint distribution model for allele count probabilities is done by using data about the probability of chromosomes crossing over at different locations in a chromosome to model dependence between polymorphic alleles on the chromosome. In some embodiments, building a joint distribution model for allele counts and the step of determining the relative probability of each hypothesis are done using a method that does not require the use of a reference chromosome.

In various embodiments of any of the aspects of the invention, determining the relative probability of each hypothesis makes use of an estimated fraction of fetal DNA in the prepared sample. In some embodiments, the DNA measurements from the prepared sample used in calculating allele count probabilities and determining the relative probability of each hypothesis comprise primary genetic data. In some embodiments, selecting the ploidy state corresponding to the hypothesis with the greatest probability is carried out using maximum likelihood estimates or maximum a posteriori estimates.

In various embodiments of any of the aspects of the invention, calling the ploidy state of the fetus also includes combining the relative probabilities of each of the ploidy hypotheses determined using the joint distribution model and the allele count probabilities with relative probabilities of each of the ploidy hypotheses that are calculated using statistical techniques taken from a group consisting of a read count analysis, comparing heterozygosity rates, a statistic that is only available when parental genetic information is used, the probability of normalized genotype signals for certain parent contexts, a statistic that is calculated using an estimated fetal fraction of the sample (e.g., the first sample) or the prepared sample, and combinations thereof.

In various embodiments of any of the aspects of the invention, a confidence estimate is calculated for the called ploidy state. In some embodiments, the method also includes taking a clinical action based on the called ploidy state of the fetus, wherein the clinical action is selected from one of terminating the pregnancy or maintaining the pregnancy.

In various embodiments of any of the aspects of the invention, the method may be performed for fetuses at between 4 and 5 weeks gestation; between 5 and 6 weeks gestation; between 6 and 7 weeks gestation; between 7 and 8 weeks gestation; between 8 and 9 weeks gestation; between 9 and 10 weeks gestation; between 10 and 12 weeks gestation; between 12 and 14 weeks gestation; between 14 and 20 weeks gestation; between 20 and 40 weeks gestation; in the first trimester; in the second trimester; in the third trimester; or combinations thereof.

In various embodiments of any of the aspects of the invention, a report displaying a determined ploidy status of a chromosome in a gestating fetus generated using the method. In some embodiments, a kit is disclosed for determining a ploidy status of a target chromosome in a gestating fetus designed to be used with any of the methods of the invention, the kit including a plurality of inner forward primers and optionally the plurality of inner reverse primers, where each of the primers is designed to hybridize to the region of DNA immediately upstream and/or downstream from one of the polymorphic sites on the target chromosome, and optionally additional chromosomes, where the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, 31 to 60, and combinations thereof.

In one aspect, the invention features methods for establishing whether an alleged father is the biological father of a fetus that is gestating in a pregnant mother. In some embodiments the method involves, (i) simultaneously amplifying a plurality of polymorphic loci that includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA includes fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

In one aspect, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo.

In one aspect, the invention features methods of measuring the amount of two or more target loci in a nucleic acid sample. In some embodiments, the method involves (i) using PCR to amplify a nucleic acid sample that includes a first standard locus, a second standard locus, a first target locus, and a second target locus to form amplified products; wherein the first standard locus and the first target locus have the same number of nucleotides but have a sequence that differs at one or more nucleotides; and wherein the second standard locus and the second target locus have the same number of nucleotides but have a sequence that differs at one or more nucleotides; (ii) sequencing the amplified products to determine a standard ratio that compares the relative amount of the amplified first standard locus compared to the amplified second standard locus; wherein the standard ratio indicates the difference in PCR efficiency for the amplification of the first standard locus and the second standard locus; (iii) determining a target ratio that compares the relative amount of the amplified first target locus compared to the amplified second target locus; and (iv) adjusting the target ratio from step (iii) based on the standard ratio from step (ii) to determine the relative amount of the first target locus and the second target locus in the sample. In various embodiments, the method involves determining the absolute amount of the first target locus and the second target locus in the sample. In various embodiments, the method further includes determining the presence or absence of a target locus (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in the sample. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci.

In one aspect, the invention features methods of quantitatively measuring a plurality of genetic targets in a sample for analysis. In some embodiments, the method includes (i) mixing genetic material derived from the sample for analysis with a plurality of target specific amplification reagents, and a plurality of standard sequences corresponding to the target specific amplification reagent targets; (ii) amplifying target regions of the genetic material and the standard sequences to produce target amplicons and standard sequence amplicons; and (iii) measuring the quantity of target amplicons and standard sequence amplicons produced. In some embodiments, the genetic material is present in a genetic library. In some embodiments, the genetic targets are polymorphic loci (such as SNPs). In some embodiments, the measuring of quantity is achieved by counting sequences. In some embodiments, the method further includes determining the estimated copy number of at least one chromosome in a sample from which the genetic library was derived, wherein the determination involves comparing the number of sequence reads of a target amplicon with the number of sequence reads of a standard amplicon. In some embodiments, the standard sequences and the genetic library include universal priming sites cable of being primed by the same primer. In some embodiments, the mixing step includes at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 different target specific amplification reagents and at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 standard sequences. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the relative amounts of each of the standard sequences are known. In some embodiments, the relative amounts of each of the sequences is has been calibrated with respect to a reference genome. In some embodiments, the sample for analysis includes a mixture of fetal and maternal genomes. In some embodiments, the sample for analysis is derived from the blood of a pregnant woman or derived from blood plasma. In some embodiments, the reference genome has at least one aneuploidy, such as an aneuploidy at chromosome 13, 18, 21, X, or Y. In some embodiments, the reference genome is diploid.

In one aspect, the invention features a mixture that includes a plurality of genetic standard sequences, wherein the relative amount of each genetic standard sequence in the mixture has been determined by calibration to a reference genome. In various embodiments, the mixture includes at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences. In various embodiments, the genetic standard sequences include a first universal priming site, a second universal priming site, a first target specific priming site, a second target specific priming site, and a marker sequence located between the first and second target specific priming sites, wherein the first target specific site and the second target specific priming site are located between the first and second universal priming sites. In various embodiments, the calibration involves using any of the primer libraries of the invention. In various embodiments, the calibration involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome has at least one aneuploidy, such as an aneuploidy at chromosome 13, 18, 21, X, or Y. In some embodiments, the reference genome is diploid.

In one aspect, the invention features methods of producing a set of calibrated genetic standard sequences. In some embodiments, the method includes (i) forming an amplification reaction mixture that includes a genetic library prepared from a reference genome, a plurality of target-specific amplification primer reagent sets, and a plurality of genetic standard sequences corresponding to the target specific amplification reagent sets, (ii) amplifying the genetic library and the genetic standard sequences to produce amplicons from the target sequences and amplicons from the genetic standard sequences, (iii) measuring the quantity of the amplicons from the target sequences and amplicons from the genetic standard sequences, and (iv) determining the relative amount of each of genetic standard sequences with respect to each other, whereby the plurality of genetic standard sequences is calibrated. In various embodiments, at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different sequences. In some embodiments, the reference genome has at least one aneuploidy, such as an aneuploidy at chromosome 13, 18, 21, X, or Y. In some embodiments, the reference genome is diploid.

In one aspect, the invention provides a set of genetic standard sequences that have been calibrated according to any of the methods of the invention. In one aspect, the invention provides a set of genetic standard sequences that may be calibrated either before, during or after the method is performed.

In one aspect, the invention features methods of measuring the number of copies of a gene of interest having at least one allele that has a deletion. In some embodiments, the method includes (i) mixing genetic material derived from a sample for analysis with an amplification reagent specific for the gene of interest and not capable of significantly amplifying the deletion comprising allele of the gene of interest, a standard sequence corresponding to gene of interest, an amplification reagent specific for a reference sequence, and a standard sequence corresponding to the reference sequence; (ii) amplifying the gene sequence of interest, the standard sequence corresponding to the gene of interest, the reference sequence, and the standard sequence corresponding to the reference sequence to produce gene of interest amplicons, reference sequence amplicons, and standard sequence amplicons; and (iii) measuring the quantity of target amplicons and standard sequence amplicons produced. In some embodiments, the measuring of quantity is achieved by counting sequence reads. In some embodiments, the method further includes determining the estimated copy number of at least one chromosome in the sample from which the genetic library was derived, wherein the determination involves comparing the number of sequences of target amplicons with the number of sequences of a standard amplicons. In some embodiments, the standard sequences and the genetic library include universal priming sites capable of being primed by the same primer. In some embodiments, the relative amounts of each of the sequences have been calibrated with respect to reference genome. In various embodiments, at least 10; 100, 500; 1,000; 2,000; 5,000; 7,500; 10,000; 15,000; 19,000; 20,000; 25,000; 27,000; 28,000; 30,000; 40,000; 50,000; 75,000; or 100,000 genetic standard sequences are used. In various embodiments, the method involves using any of the primer libraries of the invention. In various embodiments, the method involves simultaneously amplifying at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target regions. In some embodiments, the reference genome is diploid. In some embodiments, the sample for analysis is derived from blood.

In some embodiments of any of the aspects of the invention, preferentially enriching the DNA in the sample (e.g., the first sample) at the target loci (e.g., the plurality of polymorphic loci) includes obtaining a plurality of pre-circularized probes where each probe targets one of the loci (e.g., polymorphic loci), where the 3' and 5' end of the probes are preferably designed to hybridize to a region of DNA that is separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the pre-circularized probes to DNA from the sample (e.g., the first sample), filling the gap between the hybridized probe ends using DNA polymerase, circularizing the pre-circularized probe, and amplifying the circularized probe.

In some embodiments of any of the aspects of the invention, the preferentially enriching the DNA at the target loci (e.g., the plurality of polymorphic loci) includes obtaining a plurality of ligation-mediated PCR probes where each PCR probe targets one of the target loci (e.g., the polymorphic loci), and where the upstream and downstream PCR probes are designed to hybridize to a region of DNA on one strand of DNA that is preferably separated from the polymorphic site of the locus by a small number of bases, where the small number is 1, 2, 3, 4, 5, 6, 7, 8, 9, 10, 11, 12, 13, 14, 15, 16, 17, 18, 19, 20, 21 to 25, 26 to 30, 31 to 60, or a combination thereof, hybridizing the ligation-mediated PCR probes to the DNA from the sample (e.g., the first sample), filling the gap between the ligation-mediated PCR probe ends using DNA polymerase, ligating the ligation-mediated PCR probes, and amplifying the ligated ligation-mediated PCR probes.

In some embodiments of various aspects of the invention, preferentially enriching the DNA at the target loci (e.g., plurality of polymorphic loci) includes obtaining a plurality of hybrid capture probes that target the loci (e.g., the polymorphic loci), hybridizing the hybrid capture probes to the DNA in the sample (e.g., the first sample) and physically removing some or all of the unhybridized DNA from the sample (e.g., the first sample) of DNA.

In some embodiments of any of the aspects of the invention, the hybrid capture probes are designed to hybridize to a region that is flanking but not overlapping the polymorphic site. In some embodiments, the hybrid capture probes are designed to hybridize to a region that is flanking but not overlapping the polymorphic site, and where the length of the flanking capture probe may be selected from the group consisting of less than about 120 bases, less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases. In some embodiments, the hybrid capture probes are designed to hybridize to a region that overlaps the polymorphic site, and where the plurality of hybrid capture probes comprise at least two hybrid capture probes for each polymorphic loci, and where each hybrid capture probe is designed to be complementary to a different allele at that polymorphic locus.

In some embodiments of any of the aspects of the invention, preferentially enriching the DNA a plurality of polymorphic loci includes obtaining a plurality of inner forward primers where each primer targets one of the polymorphic loci, and where the 3' end of the inner forward primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, optionally obtaining a plurality of inner reverse primers where each primer targets one of the polymorphic loci, and where the 3' end of the inner reverse primers are designed to hybridize to a region of DNA upstream from the polymorphic site, and separated from the polymorphic site by a small number of bases, where the small number is selected from the group consisting of 1, 2, 3, 4, 5, 6 to 10, 11 to 15, 16 to 20, 21 to 25, 26 to 30, or 31 to 60 base pairs, hybridizing the inner primers to the DNA, and amplifying the DNA using the polymerase chain reaction to form amplicons.

In some embodiments of any of the aspects of the invention, the method also includes obtaining a plurality of outer forward primers where each primer targets one of the target (e.g., polymorphic loci), and where the outer forward primers are designed to hybridize to the region of DNA upstream from the inner forward primer, optionally obtaining a plurality of outer reverse primers where each primer targets one of the target loci (e.g., polymorphic loci), and where the outer reverse primers are designed to hybridize to the region of DNA immediately downstream from the inner reverse primer, hybridizing the first primers to the DNA, and amplifying the DNA using the polymerase chain reaction.

In some embodiments of any of the aspects of the invention, the method also includes obtaining a plurality of outer reverse primers where each primer targets one of the polymorphic loci, and where the outer reverse primers are designed to hybridize to the region of DNA immediately downstream from the inner reverse primer, optionally obtaining a plurality of outer forward primers where each primer targets one of the target loci (e.g., the polymorphic loci), and where the outer forward primers are designed to hybridize to the region of DNA upstream from the inner forward primer, hybridizing the first primers to the DNA, and amplifying the DNA using the polymerase chain reaction.

In some embodiments of any of the aspects of the invention, preparing the sample (e.g., the first sample) further includes appending universal adapters to the DNA in the sample (e.g., the first sample) and amplifying the DNA in the sample (e.g., the first sample) using the polymerase chain reaction. In some embodiments, at least a fraction of the amplicons that are amplified are less than 100 bp, less than 90 bp, less than 80 bp, less than 70 bp, less than 65 bp, less than 60 bp, less than 55 bp, less than 50 bp, or less than 45 bp, and where the fraction is 10%, 20%, 30%, 40%, 50%, 60%, 70%, 80%, 90%, or 99%.

In some embodiments of any of the aspects of the invention, amplifying the DNA is done in one or a plurality of individual reaction volumes, and where each individual reaction volume contains more than 100 different forward and reverse primer pairs, more than 200 different forward and reverse primer pairs, more than 500 different forward and reverse primer pairs, more than 1,000 different forward and reverse primer pairs, more than 2,000 different forward and reverse primer pairs, more than 5,000 different forward and reverse primer pairs, more than 10,000 different forward and reverse primer pairs, more than 20,000 different forward and reverse primer pairs, more than 50,000 different forward and reverse primer pairs, or more than 100,000 different forward and reverse primer pairs. In various embodiments of any of the aspects of the invention, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs are used.

In some embodiments of any of the aspects of the invention, preparing the sample (e.g., the first sample) further comprises dividing the sample (e.g., the first sample) into a plurality of portions, and where the DNA in each portion is preferentially enriched at a subset of the target loci (e.g., plurality of polymorphic loci). In some embodiments, the inner primers are selected by identifying primer pairs likely to form undesired primer duplexes and removing from the plurality of primers at least one of the pair of primers identified as being likely to form undesired primer duplexes. In some embodiments, the inner primers contain a region that is designed to hybridize either upstream or downstream of the targeted locus (e.g., the polymorphic locus), and optionally contain a universal priming sequence designed to allow PCR amplification. In some embodiments, at least some of the primers additionally contain a random region that differs for each individual primer molecule. In some embodiments, at least some of the primers additionally contain a molecular barcode.

In some embodiments of any of the aspects of the invention, preferential enrichment results in average degree of allelic bias between the prepared sample and the sample (e.g., the first sample) of a factor selected from the group consisting of no more than a factor of 2, no more than a factor of 1.5, no more than a factor of 1.2, no more than a factor of 1.1, no more than a factor of 1.05, no more than a factor of 1.02, no more than a factor of 1.01, no more than a factor of 1.005, no more than a factor of 1.002, no more than a factor of 1.001 and no more than a factor of 1.0001. In some embodiments, the plurality of polymorphic loci are SNPs. In some embodiments, measuring the DNA in the prepared sample is done by sequencing.

In some embodiments, the nucleic acids in the sample are non-specifically amplified prior to amplification of the target loci (such as specific amplification of the target loci with a primer library of the invention). In some embodiments, the non-specific amplification includes whole genome application (WGA), such as ligation-mediated PCR (LM-PCR), degenerate oligonucleotide primer PCR (DOP-PCR), or multiple displacement amplification (MDA). In some embodiments, the non-specific amplification includes universal PCR, such as adaptor-mediated universal PCR.

In some embodiments of any of the aspects of the invention, the target loci are present on the same nucleic acid of interest (e.g, the same chromosome or the same region of a chromosome). In some embodiments, at least some of the target loci are present on different nucleic acids of interest (e.g., different chromosomes). In some embodiments, the nucleic acid sample includes fragmented or digested nucleic acids. In some embodiments, the nucleic acid sample includes DNA, such as genomic DNA, cDNA, cell-free DNA (cfDNA), cell-free mitochondrial DNA (cf mDNA), cell-free DNA that originated from nuclear DNA (cf nDNA), cellular DNA, or mitochondrial DNA. In some embodiments, nucleic acid sample includes RNA, such as cfRNA, cellular RNA, cytoplasmic RNA, coding cytoplasmic RNA, non-coding cytoplasmic RNA, mRNA, miRNA, mitochondrial RNA, rRNA, or tRNA. In some embodiments, the nucleic acid sample includes DNA from a single cell, 2 cells, 3 cells, 4 cells, 5 cells, 6 cells, 7 cells, 8 cells, 9 cell, 10 cells, or more than 10 cells. In some embodiments, the nucleic acid sample is a blood or plasma sample that is substantially free of cells. In some embodiments, the nucleic acid sample includes or is derived from blood, plasma, saliva, semen, sperm, cell culture supernatant, mucus secretion, dental plaque, gastrointestinal tract tissue, stool, urine, hair, bone, body fluids, tears, tissue, skin, fingernails, blastomeres, embryos, amniotic fluid, chorionic villus samples, bile, lymph, cervical mucus, or a forensic sample. In some embodiments, the target loci are segments of human nucleic acids. In some embodiments, the target loci are segments of human nucleic acids found in the human genome. In some embodiments, the target loci comprise or consist of single nucleotide polymorphisms (SNPs). In some embodiments, the primers are DNA molecules.

In some embodiments of any of the aspects of the invention, the DNA in the sample (e.g., the first sample) originates from maternal plasma. In some embodiments, preparing the sample (e.g., the first sample) further comprises amplifying the DNA. In some embodiments, preparing the sample (e.g., the first sample) further comprises preferentially enriching the DNA in the sample (e.g., the first sample) at the target loci (e.g., a plurality of polymorphic loci).

In various embodiments, the primer extension reaction or the polymerase chain reaction includes the addition of one or more nucleotides by a polymerase. In some embodiments, greater than or equal to 5, 10, 20, 30, 40, 50, or 60 cycles of PCR are performed. In some embodiments, the amplification of loci is performed using a polymerase (e.g., a DNA polymerase, RNA polymerase, or reverse transcriptase) with low 5'→3' exonuclease and/or low strand displacement activity. In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In various embodiments, the primer extension reaction or the polymerase chain reaction does not include ligation-mediated PCR. In various embodiments, the primer extension reaction or the polymerase chain reaction does not include the joining of two primers by a ligase. In various embodiments, the primers do not include Linked Inverted Probes (LIPs), which can also be called pre-circularized probes, pre-circularizing probes, circularizing probes, Padlock Probes, or Molecular Inversion Probes (MIPs). In some embodiments, the primers are not loopable primers. In some embodiments, the primers do not form a loop structure, for example, the primers do not comprise a 3' target specific portion, a stem (comprising a first loop forming region and a second loop forming region), and a loop portion. In various embodiments, the primer library, composition, kit, or method does not include an array (such as a microarray) or do no use an array (such as a microarray). In some embodiments, multiplex PCR and/or sequencing is performed without use of an array (such as a microarray). In some embodiments, the primer library, composition, kit, or method comprises a microarray. In some embodiments, the primers or the target loci do not comprise an STR allele (for example, the target loci may be non-polymorphic loci or the loci may comprise a polymorphism other than an STR allele). In some embodiments, some or all of the target loci comprise an STR allele.

It is understood that all of the aspects and embodiments of the invention described herein include "comprising," "consisting," and "consisting essentially of" aspects and embodiments. It is understood that aspects and embodiments of the invention described herein include combinations of any two or more of the aspects or embodiments of the invention.

Definitions

Single Nucleotide Polymorphism (SNP) refers to a single nucleotide that may differ between the genomes of two members of the same species. The usage of the term should not imply any limit on the frequency with which each variant occurs.

Sequence refers to a DNA sequence or a genetic sequence. It may refer to the primary, physical structure of the DNA molecule or strand in an individual. It may refer to the sequence of nucleotides found in that DNA molecule, or the complementary strand to the DNA molecule. It may refer to the information contained in the DNA molecule as its representation in silico.

Locus refers to a particular region of interest on the DNA (or corresponding RNA) of an individual, which may refer to a SNP, the site of a possible insertion or deletion, or the site of some other relevant genetic variation. Disease-linked SNPs may also refer to disease-linked loci.

Polymorphic Allele, also "Polymorphic Locus," refers to an allele or locus where the genotype varies between individuals within a given species. Some examples of polymorphic alleles include single nucleotide polymorphisms, short tandem repeats, deletions, duplications, and inversions.

Polymorphic Site refers to the specific nucleotides found in a polymorphic region that vary between individuals.

Allele refers to the alternative form or version of a gene that occupies a particular locus. Genetic Data also "Genotypic Data" refers to the data describing aspects of the genome of one or more individuals. It may refer to one or a set of loci, partial or entire sequences, partial or entire chromosomes, or the entire genome. It may refer to the identity of one or a plurality of nucleotides; it may refer to a set of sequential nucleotides, or nucleotides from different locations in the genome, or a combination thereof. Genotypic data is typically in silico, however, it is also possible to consider physical nucleotides in a sequence as chemically encoded genetic data. Genotypic Data may be said to be "on," "of," "at," "from" or "on" the individual(s). Genotypic Data may refer to output measurements from a genotyping platform where those measurements are made on genetic material.

Genetic Material also "Genetic Sample" refers to physical matter, such as tissue or blood, from one or more individuals comprising DNA or RNA Noisy Genetic Data refers to genetic data with any of the following: allele dropouts, uncertain base pair measurements, incorrect base pair measurements, missing base pair measurements, uncertain measurements of insertions or deletions, uncertain measurements of chromosome segment copy numbers, spurious signals, missing measurements, other errors, or combinations thereof.

Confidence refers to the statistical likelihood that the called SNP, allele, set of alleles, ploidy call, or determined number of chromosome segment copies correctly represents the real genetic state of the individual.

Ploidy Calling, also "Chromosome Copy Number Calling," or "Copy Number Calling" (CNC), may refer to the act of determining the quantity and/or chromosomal identity of one or more chromosomes present in a cell.

Aneuploidy refers to the state where the wrong number of chromosomes (e.g., the wrong number of full chromosomes or the wrong number of chromosome segments, such as the presence of deletions or duplications of a chromosome segment) is present in a cell. In the case of a somatic human cell it may refer to the case where a cell does not contain 22 pairs of autosomal chromosomes and one pair of sex chromosomes. In the case of a human gamete, it may refer to the case where a cell does not contain one of each of the 23 chromosomes. In the case of a single chromosome type, it may refer to the case where more or less than two homologous but non-identical chromosome copies are present, or where there are two chromosome copies present that originate from the same parent. In some embodiments, the deletion of a chromosome segment is a microdeletion.

Ploidy State refers to the quantity and/or chromosomal identity of one or more chromosomes types in a cell.

Chromosome may refer to a single chromosome copy, meaning a single molecule of DNA of which there are 46 in a normal somatic cell; an example is 'the maternally derived chromosome 18'. Chromosome may also refer to a chromosome type, of which there are 23 in a normal human somatic cell; an example is 'chromosome 18'.

Chromosomal Identity may refer to the referent chromosome number, i.e. the chromosome type. Normal humans have 22 types of numbered autosomal chromosome types, and two types of sex chromosomes. It may also refer to the parental origin of the chromosome. It may also refer to a specific chromosome inherited from the parent. It may also refer to other identifying features of a chromosome.

The State of the Genetic Material or simply "Genetic State" may refer to the identity of a set of SNPs on the DNA, to the phased haplotypes of the genetic material, and to the sequence of the DNA, including insertions, deletions, repeats and mutations. It may also refer to the ploidy state of one or more chromosomes, chromosomal segments, or set of chromosomal segments.

Allelic Data refers to a set of genotypic data concerning a set of one or more alleles. It may refer to the phased, haplotypic data. It may refer to SNP identities, and it may refer to the sequence data of the DNA, including insertions, deletions, repeats and mutations. It may include the parental origin of each allele.

Allelic State refers to the actual state of the genes in a set of one or more alleles. It may refer to the actual state of the genes described by the allelic data.

Allelic Ratio or allele ratio, refers to the ratio between the amount of each allele at a locus that is present in a sample or in an individual. When the sample was measured by sequencing, the allelic ratio may refer to the ratio of sequence reads that map to each allele at the locus. When the sample was measured by an intensity based measurement method, the allele ratio may refer to the ratio of the amounts of each allele present at that locus as estimated by the measurement method.

Allele Count refers to the number of sequences that map to a particular locus, and if that locus is polymorphic, it refers to the number of sequences that map to each of the alleles. If each allele is counted in a binary fashion, then the allele count will be whole number. If the alleles are counted probabilistically, then the allele count can be a fractional number.

Allele Count Probability refers to the number of sequences that are likely to map to a particular locus or a set of alleles at a polymorphic locus, combined with the probability of the mapping. Note that allele counts are equivalent to allele count probabilities where the probability of the mapping for each counted sequence is binary (zero or one). In some embodiments, the allele count probabilities may be binary. In some embodiments, the allele count probabilities may be set to be equal to the DNA measurements.

Allelic Distribution, or 'allele count distribution' refers to the relative amount of each allele that is present for each locus in a set of loci. An allelic distribution can refer to an individual, to a sample, or to a set of measurements made on a sample. In the context of sequencing, the allelic distribution refers to the number or probable number of reads that map to a particular allele for each allele in a set of polymorphic loci. The allele measurements may be treated probabilistically, that is, the likelihood that a given allele is present for a give sequence read is a fraction between 0 and 1, or they may be treated in a binary fashion, that is, any given read is considered to be exactly zero or one copies of a particular allele.

Allelic Distribution Pattern refers to a set of different allele distributions for different parental contexts. Certain allelic distribution patterns may be indicative of certain ploidy states.

Allelic Bias refers to the degree to which the measured ratio of alleles at a heterozygous locus is different to the ratio that was present in the original sample, such as a sample of DNA. The degree of allelic bias at a particular locus is equal to the observed allelic ratio at that locus, as measured, divided by the ratio of alleles in the original DNA or RNA sample at that locus. Allelic bias may be defined to be greater than one, such that if the calculation of the degree of allelic bias returns a value, x, that is less than 1, then the degree of allelic bias may be restated as 1/x. Allelic bias maybe due to amplification bias, purification bias, or some other phenomenon that affects different alleles differently.

Allelic imbalance for aneuploidy determinations, such as CNV determinations, refers to the difference between the frequencies of the alleles for a locus. It is an estimate of the difference in the copy numbers of the homologs. Allelic imbalance can arise from the complete loss of an allele or from an increase in copy number of one allele relative to the other. Allelic imbalances can be detected by measuring the proportion of one allele relative to the other in fluids or cells from individuals that are constitutionally heterozygous at a given locus. (Mei et al, Genome Res, 10:1126-37 (2000)). For dimorphic SNPs that have alleles arbitrarily designated 'A' and 'B', the allele ratio of the A allele is $n_A/(n_A+n_B)$, where $n_A$ and $n_B$ are the number of sequencing reads for alleles A and B, respectively. Allelic imbalance is the difference between the allele ratios of A and B for loci that are heterozygous in the germline. This definition is analogous to that for SNVs, where the proportion of abnormal DNA is typically measured using mutant allele frequency, or $n_m/(n_m+n_r)$, where $n_m$ and $n_r$ are the number of sequencing reads for the mutant allele and the reference allele, respectively. Accordingly, the proportion of abnormal DNA for a CNV can be measured by the average allelic imbalance (AAI), defined as $|(H1-H2)|/(H1+H2)$, where Hi is the average number of copies of homolog i in the sample and $Hi/(H1+H2)$ is the fractional abundance, or homolog ratio, of homolog i. The maximum homolog ratio is the homolog ratio of the more abundant homolog.

Primer, also "PCR probe" refers to a single DNA molecule (a DNA oligomer) or a collection of DNA molecules (DNA oligomers) where the DNA molecules are identical, or nearly so, and where the primer contains a region that is designed to hybridize to a targeted locus (e.g, a targeted polymorphic locus or a nonpolymorphic locus), and may contain a priming sequence designed to allow PCR amplification. A primer may also contain a molecular barcode. A primer may contain a random region that differs for each individual molecule. The terms "test primer" and "candidate primer" are not meant to be limiting and may refer to any of the primers disclosed herein.

Library of primers refers to a population of two or more primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers. In various embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different individual primers that each hybridize to a different target locus, wherein the individual primers are not part of primer pairs. In some embodiments, the library has both (i) primer pairs and (ii) individual primers (such as universal primers) that are not part of primer pairs.

Different primers refers to non-identical primers.
Different pools refers to non-identical pools.
Different target loci refers to non-identical target loci.
Different amplicons refers to non-identical amplicons.
Hybrid Capture Probe refers to any nucleic acid sequence, possibly modified, that is generated by various methods such as PCR or direct synthesis and intended to be complementary to one strand of a specific target DNA sequence in a sample. The exogenous hybrid capture probes may be added to a prepared sample and hybridized through a denature-reannealing process to form duplexes of exogenous-endogenous fragments. These duplexes may then be physically separated from the sample by various means.

Sequence Read refers to data representing a sequence of nucleotide bases that were measured using a clonal sequencing method. Clonal sequencing may produce sequence data representing single, or clones, or clusters of one original DNA molecule. A sequence read may also have associated quality score at each base position of the sequence indicating the probability that nucleotide has been called correctly.

Mapping a sequence read is the process of determining a sequence read's location of origin in the genome sequence of a particular organism. The location of origin of sequence reads is based on similarity of nucleotide sequence of the read and the genome sequence.

Matched Copy Error, also "Matching Chromosome Aneuploidy" (MCA), refers to a state of aneuploidy where one cell contains two identical or nearly identical chromosomes. This type of aneuploidy may arise during the formation of the gametes in meiosis, and may be referred to as a meiotic non-disjunction error. This type of error may arise in mitosis. Matching trisomy may refer to the case where three copies of a given chromosome are present in an individual and two of the copies are identical.

Unmatched Copy Error, also "Unique Chromosome Aneuploidy" (UCA), refers to a state of aneuploidy where one cell contains two chromosomes that are from the same parent, and that may be homologous but not identical. This type of aneuploidy may arise during meiosis, and may be referred to as a meiotic error. Unmatching trisomy may refer to the case where three copies of a given chromosome are present in an individual and two of the copies are from the same parent, and are homologous, but are not identical. Note that unmatching trisomy may refer to the case where two homologous chromosomes from one parent are present, and where some segments of the chromosomes are identical while other segments are merely homologous.

Homologous Chromosomes refers to chromosome copies that contain the same set of genes that normally pair up during meiosis.

Identical Chromosomes refers to chromosome copies that contain the same set of genes, and for each gene they have the same set of alleles that are identical, or nearly identical.

Allele Drop Out (ADO) refers to the situation where at least one of the base pairs in a set of base pairs from homologous chromosomes at a given allele is not detected.

Locus Drop Out (LDO) refers to the situation where both base pairs in a set of base pairs from homologous chromosomes at a given allele are not detected.

Homozygous refers to having similar alleles as corresponding chromosomal loci.

Heterozygous refers to having dissimilar alleles as corresponding chromosomal loci.

Heterozygosity Rate refers to the rate of individuals in the population having heterozygous alleles at a given locus. The heterozygosity rate may also refer to the expected or measured ratio of alleles, at a given locus in an individual, or a sample of DNA.

Highly Informative Single Nucleotide Polymorphism (HISNP) refers to a SNP where the fetus has an allele that is not present in the mother's genotype.

Chromosomal Region refers to a segment of a chromosome, or a full chromosome.

Segment of a Chromosome refers to a section of a chromosome that can range in size from one base pair to the entire chromosome.

Chromosome refers to either a full chromosome, or a segment or section of a chromosome.

Copies refers to the number of copies of a chromosome segment. It may refer to identical copies, or to non-identical, homologous copies of a chromosome segment wherein the different copies of the chromosome segment contain a substantially similar set of loci, and where one or more of the alleles are different. Note that in some cases of aneuploidy, such as the M2 copy error, it is possible to have some copies of the given chromosome segment that are identical as well as some copies of the same chromosome segment that are not identical.

Haplotype refers to a combination of alleles at multiple loci that are typically inherited together on the same chromosome. Haplotype may refer to as few as two loci or to an entire chromosome depending on the number of recombination events that have occurred between a given set of loci. Haplotype can also refer to a set of single nucleotide polymorphisms (SNPs) on a single chromatid that are statistically associated.

Haplotypic Data, also "Phased Data" or "Ordered Genetic Data," refers to data from a single chromosome in a diploid or polyploid genome, i.e., either the segregated maternal or paternal copy of a chromosome in a diploid genome.

Phasing refers to the act of determining the haplotypic genetic data of an individual given unordered, diploid (or polyploidy) genetic data. It may refer to the act of determining which of two genes at an allele, for a set of alleles found on one chromosome, are associated with each of the two homologous chromosomes in an individual.

Phased Data refers to genetic data where one or more haplotypes have been determined.

Hypothesis refers to a possible ploidy state at a given set of chromosomes, or a set of possible allelic states at a given set of loci. The set of possibilities may comprise one or more elements.

Copy Number Hypothesis, also "Ploidy State Hypothesis," refers to a hypothesis concerning the number of copies of a chromosome in an individual. It may also refer to a hypothesis concerning the identity of each of the chromosomes, including the parent of origin of each chromosome, and which of the parent's two chromosomes are present in the individual. It may also refer to a hypothesis concerning which chromosomes, or chromosome segments, if any, from a related individual correspond genetically to a given chromosome from an individual.

Target Individual refers to the individual whose genetic state is being determined. In some embodiments, only a limited amount of DNA is available from the target individual. In some embodiments, the target individual is a fetus. In some embodiments, there may be more than one target individual. In some embodiments, each fetus that originated from a pair of parents may be considered to be target individuals. In some embodiments, the genetic data that is being determined is one or a set of allele calls. In some embodiments, the genetic data that is being determined is a ploidy call.

Related Individual refers to any individual who is genetically related to, and thus shares haplotype blocks with, the target individual. In one context, the related individual may be a genetic parent of the target individual, or any genetic material derived from a parent, such as a sperm, a polar body, an embryo, a fetus, or a child. It may also refer to a sibling, parent or a grandparent.

Sibling refers to any individual whose genetic parents are the same as the individual in question. In some embodiments, it may refer to a born child, an embryo, or a fetus, or one or more cells originating from a born child, an embryo, or a fetus. A sibling may also refer to a haploid individual that originates from one of the parents, such as a sperm, a polar body, or any other set of haplotypic genetic matter. An individual may be considered to be a sibling of itself.

Fetal refers to "of the fetus," or "of the region of the placenta that is genetically similar to the fetus". In a pregnant woman, some portion of the placenta is genetically similar to the fetus, and the free floating fetal DNA found in maternal blood may have originated from the portion of the placenta with a genotype that matches the fetus. Note that the genetic information in half of the chromosomes in a fetus is inherited from the mother of the fetus. In some embodiments, the DNA from these maternally inherited chromosomes that came from a fetal cell is considered to be "of fetal origin," not "of maternal origin."

DNA of Fetal Origin refers to DNA that was originally part of a cell whose genotype was essentially equivalent to that of the fetus.

DNA of Maternal Origin refers to DNA that was originally part of a cell whose genotype was essentially equivalent to that of the mother.

Child may refer to an embryo, a blastomere, or a fetus. Note that in the presently disclosed embodiments, the concepts described apply equally well to individuals who are a born child, a fetus, an embryo or a set of cells therefrom. The use of the term child may simply be meant to connote that the individual referred to as the child is the genetic offspring of the parents.

Parent refers to the genetic mother or father of an individual. An individual typically has two parents, a mother and a father, though this may not necessarily be the case such as in genetic or chromosomal chimerism. A parent may be considered to be an individual.

Parental Context refers to the genetic state of a given SNP, on each of the two relevant chromosomes for one or both of the two parents of the target.

Develop As Desired, also "Develop Normally," refers to a viable embryo implanting in a uterus and resulting in a pregnancy, and/or to a pregnancy continuing and resulting in a live birth, and/or to a born child being free of chromosomal abnormalities, and/or to a born child being free of other undesired genetic conditions such as disease-linked genes. The term "develop as desired" is meant to encompass anything that may be desired by parents or healthcare facilitators. In some cases, "develop as desired" may refer to an unviable or viable embryo that is useful for medical research or other purposes.

Insertion into a Uterus refers to the process of transferring an embryo into the uterine cavity in the context of in vitro fertilization.

Maternal Plasma refers to the plasma portion of the blood from a female who is pregnant.

Clinical Decision refers to any decision to take or not take an action that has an outcome that affects the health or survival of an individual. In the context of prenatal diagnosis, a clinical decision may refer to a decision to abort or not abort a fetus. A clinical decision may also refer to a decision to conduct further testing, to take actions to mitigate an undesirable phenotype, or to take actions to prepare for the birth of a child with abnormalities.

Diagnostic Box refers to one or a combination of machines designed to perform one or a plurality of aspects of the methods disclosed herein. In an embodiment, the diagnostic box may be placed at a point of patient care. In an embodiment, the diagnostic box may perform targeted amplification followed by sequencing. In an embodiment the diagnostic box may function alone or with the help of a technician.

Informatics Based Method refers to a method that relies heavily on statistics to make sense of a large amount of data. In the context of prenatal diagnosis, it refers to a method designed to determine the ploidy state at one or more chromosomes or the allelic state at one or more alleles by statistically inferring the most likely state, rather than by directly physically measuring the state, given a large amount of genetic data, for example from a molecular array or sequencing. In an embodiment of the present disclosure, the informatics based technique may be one disclosed in this patent. In an embodiment of the present disclosure it may be PARENTAL SUPPORT™.

Primary Genetic Data refers to the analog intensity signals that are output by a genotyping platform. In the context of SNP arrays, primary genetic data refers to the intensity signals before any genotype calling has been done. In the context of sequencing, primary genetic data refers to the analog measurements, analogous to the chromatogram, that comes off the sequencer before the identity of any base pairs have been determined, and before the sequence has been mapped to the genome.

Secondary Genetic Data refers to processed genetic data that are output by a genotyping platform. In the context of a SNP array, the secondary genetic data refers to the allele calls made by software associated with the SNP array reader, wherein the software has made a call whether a given allele is present or not present in the sample. In the context of sequencing, the secondary genetic data refers to the base pair identities of the sequences have been determined, and possibly also where the sequences have been mapped to the genome.

Non-Invasive Prenatal Diagnosis (NPD), or also "Non-Invasive Prenatal Screening" (NPS), refers to a method of determining the genetic state of a fetus that is gestating in a mother using genetic material found in the mother's blood, where the genetic material is obtained by drawing the mother's intravenous blood.

Preferential Enrichment of DNA that corresponds to a locus, or preferential enrichment of DNA at a locus, refers to any method that results in the percentage of molecules of DNA in a post-enrichment DNA mixture that correspond to the locus being higher than the percentage of molecules of DNA in the pre-enrichment DNA mixture that correspond to the locus. The method may involve selective amplification of DNA molecules that correspond to a locus. The method may involve removing DNA molecules that do not correspond to the locus. The method may involve a combination of methods. The degree of enrichment is defined as the percentage of molecules of DNA in the post-enrichment mixture that correspond to the locus divided by the percentage of molecules of DNA in the pre-enrichment mixture that correspond to the locus. Preferential enrichment may be carried out at a plurality of loci. In some embodiments of the present disclosure, the degree of enrichment is greater than 20. In some embodiments of the present disclosure, the degree of enrichment is greater than 200. In some embodiments of the present disclosure, the degree of enrichment is greater than 2,000. When preferential enrichment is carried out at a plurality of loci, the degree of enrichment may refer to the average degree of enrichment of all of the loci in the set of loci.

Amplification refers to a method that increases the number of copies of a molecule, such as a molecule of DNA.

Selective Amplification may refer to a method that increases the number of copies of a particular molecule of DNA, or molecules of DNA that correspond to a particular region of DNA. It may also refer to a method that increases the number of copies of a particular targeted molecule of DNA, or targeted region of DNA more than it increases non-targeted molecules or regions of DNA. Selective amplification may be a method of preferential enrichment.

Universal Priming Sequence refers to a DNA sequence that may be appended to a population of target DNA molecules, for example by ligation, PCR, or ligation mediated PCR. Once added to the population of target molecules, primers specific to the universal priming sequences can be used to amplify the target population using a single pair of amplification primers. Universal priming sequences are typically not related to the target sequences.

Universal Adapters, or 'ligation adaptors' or 'library tags' are DNA molecules containing a universal priming sequence that can be covalently linked to the 5-prime and 3-prime end of a population of target double stranded DNA molecules. The addition of the adapters provides universal priming sequences to the 5-prime and 3-prime end of the target population from which PCR amplification can take place, amplifying all molecules from the target population, using a single pair of amplification primers.

Targeting refers to a method used to selectively amplify or otherwise preferentially enrich those molecules of DNA that correspond to a set of loci, in a mixture of DNA.

Joint Distribution Model refers to a model that defines the probability of events defined in terms of multiple random variables, given a plurality of random variables defined on the same probability space, where the probabilities of the variable are linked. In some embodiments, the degenerate case where the probabilities of the variables are not linked may be used.

Percent identity in reference to nucleic acid sequences refers to the degree of sequence identity between nucleic acid sequences.

BRIEF DESCRIPTION OF THE DRAWINGS

The presently disclosed embodiments will be further explained with reference to the attached drawings, wherein like structures are referred to by like numerals throughout the several views. The drawings shown are not necessarily to scale, with emphasis instead generally being placed upon illustrating the principles of the presently disclosed embodiments.

FIG. 12: An example of some primers with internal tags (SEQ ID NOs: 44,611-44,622, respectively in order of appearance).

FIG. 30, 0% FF plot: Generated plots when two chromosomes are present and the fetal cfDNA fraction is 0%. This plot is from a non-pregnant woman, and thus represents the pattern when the genotype is entirely maternal. Allele clusters are thus centered around 1 (AA alleles), 0.5 (AB alleles), and 0 (BB alleles). FIG. 30, 12% FF plot: Generated plot when two chromosomes are present and the fetal fraction is 12%. The contribution of fetal alleles to the fraction of A allele reads shifts the position of some allele spots up or down along the y-axis, such that the bands are centered around 1 (AA|AA alleles), 0.94 (AA|AB alleles), 0.56 (AB|AA alleles), 0.50 (AB|AB alleles), 0.44 (AB|BB alleles), 0.06 (BB|AB alleles), and 0 (BB|BB alleles). FIG. 30, 26% FF Plot. Generated plot when two chromosomes are present and the fetal fraction is 26%. The pattern, including two filled circles and two filled square peripheral bands and a trio of central open triangle bands, is readily apparent. Bands are centered around 1 (AA|AA alleles), 0.87 (AA|AB alleles), 0.63 (AB|AA alleles), 0.50 (AB|AB alleles), 0.37 (AB|BB alleles), 0.13 (BB|AB alleles), and 0 (BB|BB alleles). FIG. 30D: Generated plot when one chromosome is present and the fetal fraction is 26%. The hallmark pattern of one external filled circles and one external filled square peripheral band as well as two central open triangle bands indicated maternally-inherited monosomy. Because the fetus only contributes a single allele (A or B) to the allele reads, the internal peripheral filled circles and filled square bands are not present, and the center trio of bands condenses into two bands. Bands that are centered around 1 (AA|A alleles), 0.57 (AB|A alleles), 0.43 (AB|B alleles), and 0 (BB|B alleles). FIG. 30E: Generated plot when three chromosomes are present and the fetal fraction is 27%. This pattern of two filled circles and filled square peripheral bands as well as two central open triangle bands indicates maternally-inherited meiotic trisomy. Bands are centered around 1 (AA|AAA alleles), 0.88 (AA|AAB alleles), 0.56 (AB|AAB alleles), 0.44 (AB|ABB alleles), 0.12 (BB|ABB alleles), and 0 (BB|BBB alleles). FIG. 30F: Generated plot when three chromosomes are present and the fetal fraction is 14%. This pattern of three filled circles and three filled square peripheral bands, as well as two central open triangle bands, indicates paternally-inherited meiotic trisomy. Bands are centered around 1 (AA|AAA alleles), 0.93 (AA|AAB alleles), 0.87 (AA|ABB alleles), 0.60 (AB|AAA alleles), 0.53 (AB|AAB alleles), 0.47 (AB|ABB alleles), 0.40 (AB|BBB alleles), 0.13 (BB|AAB alleles), 0.07 (BB|ABB alleles), and 0 (BB|BBB alleles). FIG. 30G: Generated plot when three chromosomes are present and the fetal fraction is 35%. This pattern of two filled circles and two filled square peripheral bands and four central open triangle bands indicates maternally-inherited mitotic trisomy. Bands are centered around 1 (AA|AAA alleles), 0.85 (AA|AAB alleles), 0.72 (AB|AAA alleles), 0.57 (AB|AAB alleles), 0.43 (AB|ABB alleles), 0.28 (AB|BBB alleles), 0.15 (BB|ABB alleles), and 0 (BB|BBB alleles). FIG. 30H: Generated plot when three chromosomes are present and the fetal fraction is 25%. This pattern of two filled circles and two filled square peripheral bands as well as four central open triangle bands indicates paternally-inherited mitotic trisomy. This pattern can be distinguished from that of maternally-inherited mitotic trisomy (as in FIG. 30G) by the position of the internal peripheral bands. Specifically, bands are centered around 1 (AA|AAA alleles), 0.78 (AA|ABB alleles), 0.67 (AB|AAA alleles), 0.56 (AB|AAB alleles), 0.44 (AB|ABB alleles), 0.33 (AB|BBB alleles), 0.22 (BB|AAB alleles), and 0 (BB|BBB alleles).

FIGS. 33A-33F: Illustrations of the calculation of an interaction score between primers in a primer library. FIG. 33A shows the first two bases (dinucleotide) of a primer that align to the other primer for calculation of ΔG. Iterate over the remainder of the primer that aligns with the other primer by sliding the bases being observing one base to the right. Continue until ΔG has been calculated for all pairs of bases that align (FIG. 33B). Shift the alignment of the two primers (FIGS. 33C and 33D). Determine ΔG for the new alignment (FIGS. 33E and 33F).

FIG. 34: Table of the percentage of reads that map to target loci for genomic DNA samples and for samples of a single cell from a cell line for both mother and child samples.

FIG. 36: Table of the percentage of reads that map to target loci for blastoceol fluid and for a single blastocyst cell.

FIG. 45 is a table of data (such as percent mapped reads and error rate) from multiplex PCR with various buffers.

Figure 1:
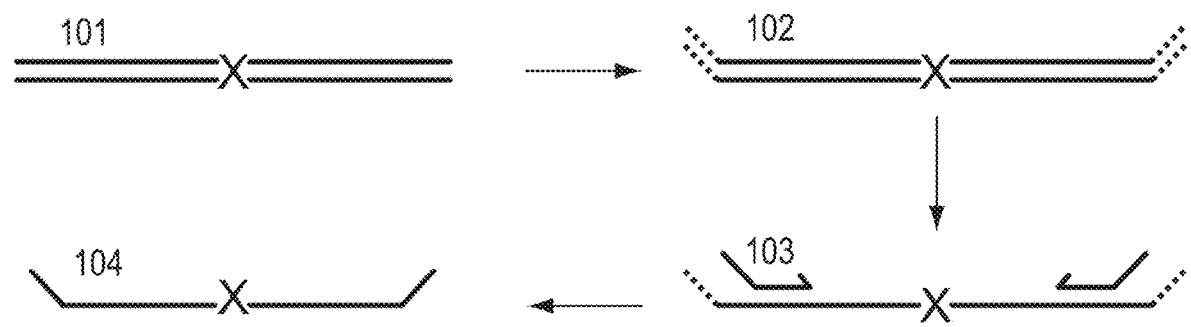
FIG. 1: Graphical representation of direct multiplexed mini-PCR method.

While the above-identified drawings set forth presently disclosed embodiments, other embodiments are also contemplated, as noted in the discussion. This disclosure presents illustrative embodiments by way of representation and not limitation. Numerous other modifications and embodiments can be devised by those skilled in the art which fall within the scope and spirit of the principles of the presently disclosed embodiments.

DETAILED DESCRIPTION

The present invention is based in part on the surprising discovery that often only a relatively small number of primers in a library of primers are responsible for a substantial amount of the amplified primer dimers that form during multiplex PCR reactions. Methods have been developed to select the most undesirable primers for removal from a library of candidate primers. By reducing the amount of primer dimers to a negligible amount (~0.1% of the PCR products), these methods allow the resulting primer libraries to simultaneously amplify a large number of target loci in a single multiplex PCR reaction. Because the primers hybridize to the target loci and amplify them rather than hybridizing to other primers and forming amplified primer dimers, the number of different target loci that can be amplified is increased. It was also discovered that using lower primer concentrations and much longer annealing times than normal increases the likelihood that the primers hybridize to the target loci instead of hybridizing to each other and forming primer dimers (see, e.g., U.S. Ser. No. 13/683,604, filed Nov. 21, 2012, which is hereby incorporated by reference in its entirety). The methods can also be used to amplify a large number of target loci even if the primers have a relatively large range of melting temperatures (in contrast to other methods that require primers to have very similar melting temperatures to successfully amplify multiple loci simultaneously due to the need for the primers to be functional under the same reaction conditions). Additionally, it was discovered that the annealing temperature can optionally be higher than the melting temperatures of the primers (in contrast to other methods that use an annealing temperature below the melting temperatures of the primers). A higher annealing temperature improves the specificity of the PCR amplification and reduces or prevents amplification of non-target loci.

During the PCR amplification and sequencing of 19,488 target loci in a genomic sample, 99.4-99.7% of the sequencing reads mapped to the genome, of those, 99.99% of the mapped to target loci. For plasma samples with 10 million sequencing reads, typically at least 19,350 of the 19,488 target loci (99.3%) were amplified and sequenced. This primer library has even been used to amplify the nucleic acids in a single cell (FIGS. 34-37).

During the PCR amplification and sequencing of ~28,000 target loci in a genomic sample, 99% of the sequencing reads mapped to target loci. This primer library has also been used to amplify nucleic acids in a single cell.

Being able to simultaneously amplify such a large number of target loci at once greatly decreases the amount of time and the amount of DNA required to analyze thousands of target loci. For example, DNA from a single cell is sufficient to simultaneously analyze thousands of target loci, which is important for applications in which the amount of DNA is low, such as genetic testing of a single cell from an embryo prior to in vitro fertilization or genetic testing of a forensic sample with little DNA. In addition, being able to analyze the target loci in one reaction volume (such as in one chamber, well, or vessel) rather than splitting the sample into multiple different reactions reduces variability that can occur between reactions. In addition, methods have been developed to use reference standards to correct for amplification bias that may occur between different target loci. For example, differences in amplification efficiency between target loci due to factors such as GC content may cause differing amounts of PCR products to be produced for target loci that are actually present in the same amount. The use of reference standards similar to the target loci allows the detection of such amplification bias so that it can be corrected for during the quantitation of the target loci.

During sequencing of PCR products, artifacts such as primer dimers are detected and thus inhibit the detection of target amplicons. Because of this limitation, microarrays with hybridization probes are often used for detection since microarrays are less sensitive to interference from primer dimers (for example, microarrays can be used as a target specific detection that uses probes to hybridize to target amplicons but does not have probes to hybridize to undesired primer dimers). The high level of multiplexing with minimal non-target amplicons that has now been achieved allows PCR followed by sequencing to be used as an alternative to microarrays. For example, the present multiplex PCR methods can be used with a non-target specific method of detection, such as sequencing that detects all amplified products (including both target amplicons and primer dimers, if any). The small amount of primer dimers that are produced allows detection of target amplicons by methods that detect all amplicons. Thus, in some embodiments, the method includes multiplex PCR followed by sequencing without use of an array. In other embodiments, the method includes multiplex PCR followed by an array for detection of the amplified products.

The multiplex-PCR methods of the invention can be in a variety of applications, such as genotyping, detection of chromosomal abnormalities (such as a fetal chromosome aneuploidy), gene mutation and polymorphism (such as single nucleotide polymorphisms, SNPs) analysis, gene deletion analysis, determination of paternity, analysis of genetic differences among populations, forensic analysis, measuring predisposition to disease, quantitative analysis of mRNA, and detection and identification of infectious agents (such as bacteria, parasite, and viruses). The multiplex PCR methods can also be used for non-invasive prenatal testing, such as paternity testing or the detection of fetal chromosome abnormalities.

Exemplary Primer Design Methods

Highly multiplexed PCR can often result in the production of a very high proportion of product DNA that results from unproductive side reactions such as primer dimer formation. In an embodiment, the particular primers that are most likely to cause unproductive side reactions may be removed from the primer library to give a primer library that will result in a greater proportion of amplified DNA that maps to the genome. The step of removing problematic primers, that is, those primers that are particularly likely to firm dimers has unexpectedly enabled extremely high PCR multiplexing levels for subsequent analysis by sequencing. In systems such as sequencing, where performance significantly degrades by primer dimers and/or other mischief products, greater than 10, greater than 50, and greater than 100 times higher multiplexing than other described multiplexing has been achieved. Note this is opposed to probe based detection methods, e.g. microarrays, TAQMAN, PCR etc. where an excess of primer dimers will not affect the outcome appreciably. Also note that the general belief in the art is that multiplexing PCR for sequencing is limited to about 100 assays in the same well. Fluidigm and Rain Dance offer platforms to perform 48 or 1000 s of PCR assays in parallel reactions for one sample.

There are a number of ways to choose primers for a library where the amount of non-mapping primer dimer or other primer mischief products are minimized. Empirical data indicate that a small number of 'bad' primers are responsible for a large amount of non-mapping primer dimer side reactions. Removing these 'bad' primers can increase the percent of sequence reads that map to targeted loci. One way to identify the 'bad' primers is to look at the sequencing data of DNA that was amplified by targeted amplification; those primer dimers that are seen with greatest frequency can be removed to give a primer library that is significantly less likely to result in side product DNA that does not map to the genome. There are also publicly available programs that can calculate the binding energy of various primer combinations, and removing those with the highest binding energy will also give a primer library that is significantly less likely to result in side product DNA that does not map to the genome.

In some embodiments for selecting primers, an initial library of candidate primers is created by designing one or more primers or primer pairs to candidate target loci. A set of candidate target loci (such as SNPs) can selected based on publically available information about desired parameters for the target loci, such as frequency of the SNPs within a target population or the heterozygosity rate of the SNPs. In one embodiment, the PCR primers may be designed using the Primer3 program (the worldwide web at primer3.sourceforge.net; libprimer3 release 2.2.3, which is hereby incorporated by reference in its entirety). If desired, the primers can be designed to anneal within a particular annealing temperature range, have a particular range of GC contents, have a particular size range, produce target amplicons in a particular size range, and/or have other parameter characteristics. Starting with multiple primers or primer pairs per candidate target locus increases the likelihood that a primer or prime pair will remain in the library for most or all of the target loci. In one embodiment, the selection criteria may require that at least one primer pair per target locus remains in the library. That way, most or all of the target loci will be amplified when using the final primer library. This is desirable for applications such as screening for deletions or duplications at a large number of locations in the genome or screening for a large number of sequences (such as polymorphisms or other mutations) associated with a disease or an increased risk for a disease. If a primer pair from the library would produces a target amplicon that overlaps with a target amplicon produced by another primer pair, one of the primer pairs may be removed from the library to prevent interference.

In some embodiments, a score such as an "undesirability score" (higher score representing least desirability) is calculated (such as calculation on a computer) for most or all of the possible combinations of two primers from a library of candidate primers. In various embodiments, a score (such as an undesirability score) is calculated for at least 80, 90, 95, 98, 99, or 99.5% of the possible combinations of candidate primers in the library. Each score (such as an undesirability score) is based at least in part on the likelihood of dimer formation between the two candidate primers. If desired, the score (such as the undesirability score) may also be based on one or more other parameters selected from the group consisting of heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, size of the target amplicon, number of SNPs within the candidate primer, location of SNPs within the candidate primer, distance from an end of the amplicon to the target bases within the amplicon, and the number of target loci in an amplicon. In some embodiments, the lower the number of SNPs with the candidate primer (such as 2, 1 or 0 SNPs) the better. In some embodiments, there are no SNPs in the candidate primer. In some embodiments, SNPs (if any) are preferably not in the last 5 nucleotides in the 3' end of the candidate primer. In some embodiments, the target bases (the bases of interest in a target locus) are preferably near an end (the 3' or 5' end) of the amplicon; this may improve the quality of sequencing data (since bases near the end of an amplicon are sequenced more accurately), and/or allow shorter sequencing reads to be performed. In some embodiments, a single amplicon includes 2 or more target loci (such as 2 or more nearby SNPs or variants). In some embodiments, the specificity of the candidate primer for the target locus includes the likelihood that the candidate primer will mis-prime by binding and amplifying a locus other than the target locus it was designed to amplify. In some embodiments, one or more or all the candidate primers that mis-prime are removed from the library. In some embodiments to increase the number of candidate primers to choose from, candidate primers that may mis-prime are not removed from the library. In some embodiments, the optimal melting temperature for selection of the candidate primers is 57° C. In some embodiments, the optimal size for selection of the candidate primers is a length of 24 nucleotides. In some embodiments, the optimal GC content for selection of the candidate primers is 50%. If multiple factors are considered, the score (such as the undesirability score) may be calculated based on a weighted average of the various parameters. The parameters may be assigned different weights based on their importance for the particular application that the primers will be used for. An exemplary score (such as an undesirability score) for a primer is shown below in which the parameters are weighted by various factors.

$$\begin{aligned}\text{score} = &(1)(\text{total number of targets} - \text{number of targets covered}) + \\ &(100)(\text{number of SNPs in GC clamp}) + \\ &(10)(\text{number of SNPs in primer binding site}) + \\ &(10)(\text{number of similar primer pair designs}) + \\ &(0.1)(\text{distance of target base from amplicon end}) + \\ &(0.1)(\text{amplicon length}) + (100)(\text{interaction score})\end{aligned}$$

where interaction score=max ($-1*\Delta G$ value) as described herein

Another exemplary score for a primer is shown below.

$$\begin{aligned}\text{score} = &(100)(\text{number of SNPs in GC clamp}) + \\ &(10)(\text{number of SNPs in primer binding site}) + \\ &(0.1)(\text{distance of target base from amplicon end}) + \\ &(0.1)(\text{amplicon length}) + (100)(\text{interaction score})\end{aligned}$$

where interaction score=max ($-1*\Delta G$ value) as described herein

In some embodiments, the score for a primer pair is the worse score out of the scores for the two primers in the pair. An exemplary score (such as an undesirability score or the score in Example 20) for a pairs of designs (in which each design is one primer pair so that a pair of designs includes two primer pairs with a total of 4 primers) is shown below.

$$\begin{aligned}\text{score} = &(10000000)(\text{amplicon overlap}) + (100)(\text{distance between designs}) + \\ &(1)(\text{total number of targets} - \text{number of targets covered}) + \\ &(100)(\text{number of SNPs in GC clamp}) + \\ &(10)(\text{number of SNPs in primer binding site}) + \\ &(10)(\text{number of similar primer pair designs}) + \\ &(0.1)(\text{distance of target base from amplicon end}) + \\ &(0.1)(\text{amplicon length}) + (100)(\text{interaction score})\end{aligned}$$

where interaction score=max ($-1*\Delta G$ value) as described herein;

where amplicon overlap=overlap between the two amplicons formed by a pair of designs In some embodiments, the score for a pair of designs is the worse score out of the scores for the four primers in the pair of designs.

In some embodiments, the primer with the highest score (such as the undesirability score) or any score representing least desirability is removed from the library. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below a minimum threshold (such as any threshold for which the primers remaining in the library all have at least that level of desirability). In some embodiments, the selection method is performed until the number of candidate primers remaining in the library is reduced to a desired number.

In various embodiments, after the score (such as the undesirability score) are calculated, the candidate primer that is part of the greatest number of combinations of two candidate primers with a score (such as an undesirability score) above a first minimum threshold (such as any threshold for which the primers remaining in the library all have at least that level of desirability) is removed from the library. This step ignores interactions equal to or below the first minimum threshold since these interactions are less significant. If the removed primer is a member of a primer pair that hybridizes to one target locus, then the other member of the primer pair may be removed from the library. The process of removing primers may be repeated as desired. In some embodiments, the selection method is performed until the score (such as the undesirability score) for the candidate primer combinations remaining in the library are all equal to or below the first minimum threshold. If the number of candidate primers remaining in the library is higher than desired, the number of primers may be reduced by decreasing the first minimum threshold to a lower second minimum threshold (such as any threshold with a stricter cutoff than the first minimum threshold so that some of the least desirable primers are removed from the library) and repeating the process of removing primers. If the number of candidate primers remaining in the library is lower than desired, the method can be continued by increasing the first minimum threshold to a higher second minimum threshold (such as any threshold with a less strict cutoff than the first minimum threshold) and repeating the process of removing primers using the original candidate primer library, thereby allowing more of the candidate primers to remain in the library. In some embodiments, the selection method is performed until the score (such as the undesirability score) for the candidate primer combinations remaining in the library are all equal to or below the second minimum threshold, or until the number of candidate primers remaining in the library is reduced to a desired number.

If desired, primer pairs that produce a target amplicon that overlaps with a target amplicon produced by another primer pair can be divided into separate amplification reactions. Multiple PCR amplification reactions may be desirable for applications in which it is desirable to analyze all of the candidate target loci (instead of omitting candidate target loci from the analysis due to overlapping target amplicons).

In various embodiments of any of the aspects of the invention, the selection method selects candidate primers and divides them into different pools (e.g., 2, 3, 4, 5, 6, or more different pools). Each pool can be used to simultaneously amplify a large number of target loci (or a subset of target loci) in a single reaction volume. In some embodiments, a graph coloring algorithm is used to divide candidate primers into different pools. If desired, this method can be used to minimize the number of different pools needed to amplify most or all of the target loci.

In some embodiments, most or all of the target loci (such as at least 70, 80, 90, 92, 94, 96, 98, 99, or 100% of the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different pools. In some embodiments, most or all of the bases in the target loci (such as at least 70, 80, 90, 92, 94, 96, 98, 99, or 100% of the bases in the target loci) are amplified by at least 2, 3, 4, 5, 6, or more different primers or primer pairs in different pools. For example, a particular base in a target locus may be amplified by at least 2, 3, 4, 5, 6, or more different primers or primer pairs; wherein each different primer or primer pair is in a different pool. Using different primers or primer pairs to amplify each base allows multiple independent measurements of the base to be made, thereby increasing the accuracy of the method. Dividing the different primers or primer pairs that amplify the same base into different pools prevents interference due to overlapping amplicons being formed by different primers or primer pairs.

In one aspect, the invention features methods of selecting test primers from a library of candidate primers to form 2 or more different primer pools. In various embodiments, the selection involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing the candidate primer with the highest or worst score (such as an undesirability score) from the library of candidate primers; and (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below a minimum threshold for the first pool. In some embodiments, the selection method is performed until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

In one aspect, the invention features methods of selecting test primers from a library of candidate primers to form 2 or more different primer pools. In various embodiments, the selection of test primers are selected from a library of candidate primers involves (i) calculating on a computer a score (such as an undesirability score) for most or all of the possible combinations of two candidate primers from the library, wherein each score (such as an undesirability score) is based at least in part on the likelihood of dimer formation between the two candidate primers; (ii) removing from the library of candidate primers the candidate primer that is part of the greatest number of combinations of two candidate primers with a score (such as an undesirability score) above a first minimum threshold; (iii) if the candidate primer removed in step (ii) is a member of a primer pair, then removing the other member of the primer pair from the library of candidate primers; and (iv) optionally repeating steps (ii) and (iii), thereby selecting a first pool. In some embodiments, the selection method is performed until the score (such as the undesirability score) for the candidate primer combinations remaining in the library are all equal to or below the first minimum threshold for the first pool. In some embodiments, the selection method is performed until the number of candidate primers remaining in the library is reduced to a desired number for the first pool. In various embodiments, the selection method involves further reducing the number of candidate primers remaining in the library by decreasing the first minimum threshold used in step (ii) to a lower second minimum threshold and optionally repeating steps (ii) and (iii). In some embodiments, the selection method involves increasing the first minimum threshold used in step (ii) to a higher second minimum threshold and optionally repeating steps (ii) and (iii). In some embodiments, the selection method is performed until the score (such as the undesirability score) for the candidate primer combinations remaining in the library are all equal to or below the second minimum threshold, or until the number of candidate primers remaining in the library is reduced to a desired number for the first pool. In some embodiments, after the first pool is selected those primers are removed from further consideration and steps of the method (such as steps (ii) and (iii)) are repeated with the remaining primers to select a second pool. If desired, this method may be repeated to select the desired number of primer pools. In some embodiments, the score is based at least in part on the current coverage of the bases in the target locus (such as the number of other primer pools that have a primer or primer pair that amplifies a particular base in the target locus).

As discussed above, in some embodiments, a library is formed by starting with a library of candidate primers and removing primers until the primers remaining in the library have the desired characteristics for use as a final primer library.

In other embodiments, candidate primers are added to a library (such as a library starting with no primers) to form a library with the desired characteristics. In some embodiments, the candidate primer or primer pair with the most desirable score (such as the lowest undesirability score) is added to a library (such as a library starting with no primers). The process of adding candidate primers may be repeated as desired. In some embodiments, the selection method is performed until the score (such as the undesirability score) for the candidate primers that have not been added to the library are all above a minimum threshold (such that all the candidate primers that have not been chosen for the library all have worse scores than the threshold). In some embodiments, the selection method is performed until the number of candidate primers that have been added to the library reaches a desired number. The library of selected primers can then be used in any of the methods of the invention.

In some embodiments, most (such as at least 50, 60, 70, 80, 90, 95, 96, 97, 98, 99, or 99.5%) or all of the possible sets of two primer pairs (two primer pairs with a total of 4 primers) are considered for inclusion in a library. In some embodiments, the set of two different candidate primer pair with the most desirable score (such as the lowest undesirability score) is added to a first pool (such as a first pool starting with no primers). In some embodiments, the set of two different candidate primer pairs with the next most desirable score is added to the first pool if it is connected to at most two sets of two different candidate primer pairs in the first pool. By "connected" for purposes of this step is meant that a single candidate primer pair in one set of two different candidate primer pairs is the same as a single candidate primer pair in another set of two different candidate primer pairs. If the set of two different candidate primer pairs is connected to more than two sets, it may be added to a different pool than the first pool. The process of set of two different candidate primer pair to pool(s) may be repeated as desired for the next set of two different candidate primer pairs with the next most desirable score. In some embodiments, the selection method is performed until the score (such as the undesirability score) for the candidate primers that have not been added to the pool(s) are all above a minimum threshold (such that all the candidate primers that have not been chosen for the pool(s) all have worse scores than the threshold). In some embodiments, the selection method is performed until the number of candidate primers that have been added to the pool(s) reaches a desired number. In some embodiments, the method involves storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. The library of selected primers can then be used in any of the methods of the invention.

In some embodiments, the minimum threshold, the first minimum threshold, or the second minimum threshold is an interaction score equal to or about 20, 18, 16, 14, 12, 10, 9, 8, 7, 6, 5, 4, 3, 2, or 1 kcal/mol. In some embodiments, the interaction score is calculated as followed as described further herein:

$$\text{Interaction score} = \max(-1 * \Delta G \text{ value}); \text{ or}$$

$$\text{interaction\_score} = \max(-\text{deltaG\_2}, 0.8 * (-\text{deltaG\_1}))$$

where
deltaG_2=Gibbs energy (energy required to break the dimer) for a dimer that is extensible by PCR on both ends, i.e., the 3' end of each primer anneals to the other primer; and
deltaG_1=Gibbs energy for a dimer that is extensible by PCR on at least one end.

These selection methods minimize the number of candidate primers that have to be removed from the library to achieve the desired reduction in primer dimers. By removing a smaller number of candidate primers from the library, more (or all) of the target loci can be amplified using the resulting primer library.

Multiplexing large numbers of primers imposes considerable constraint on the assays that can be included. Assays that unintentionally interact result in spurious amplification products. The size constraints of miniPCR may result in further constraints. In an embodiment, it is possible to begin with a very large number of potential SNP targets (between about 500 to greater than 1 million) and attempt to design primers to amplify each SNP. Where primers can be designed it is possible to attempt to identify primer pairs likely to form spurious products by evaluating the likelihood of spurious primer duplex formation between all possible pairs of primers using published thermodynamic parameters for DNA duplex formation. Primer interactions may be ranked by a scoring function related to the interaction and primers with the worst interaction scores are eliminated until the number of primers desired is met. In cases where SNPs likely to be heterozygous are most useful, it is possible to also rank the list of assays and select the most heterozygous compatible assays. Experiments have validated that primers with high interaction scores are most likely to form primer dimers. At high multiplexing it is not possible to eliminate all spurious interactions, but it is essential to remove the primers or pairs of primers with the highest interaction scores in silico as they can dominate an entire reaction, greatly limiting amplification from intended targets. We have performed this procedure to create multiplex primer sets of up to and in some cases more than 10,000 primers. The improvement due to this procedure is substantial, enabling amplification of more than 80%, more than 90%, more than 95%, more than 98%, and even more than 99% on target products as determined by sequencing of all PCR products, as compared to 10% from a reaction in which the worst primers were not removed. When combined with a partial semi-nested approach as previously described, more than 90%, and even more than 95% of amplicons may map to the targeted sequences.

Note that there are other methods for determining which PCR probes are likely to form dimers. In an embodiment, analysis of a pool of DNA that has been amplified using a non-optimized set of primers may be sufficient to determine problematic primers. For example, analysis may be done using sequencing, and those dimers which are present in the greatest number are determined to be those most likely to form dimers, and may be removed.

This method has a number of potential application, for example to SNP genotyping, heterozygosity rate determination, copy number measurement, and other targeted sequencing applications. In an embodiment, the method of primer design may be used in combination with the mini-PCR method described elsewhere in this document. In some embodiments, the primer design method may be used as part of a massive multiplexed PCR method.

The use of tags on the primers may reduce amplification and sequencing of primer dimer products. In some embodiments, the primer contains an internal region that forms a loop structure with a tag. In particular embodiments, the primers include a 5' region that is specific for a target locus, an internal region that is not specific for the target locus and forms a loop structure, and a 3' region that is specific for the target locus. In some embodiments, the loop region may lie between two binding regions where the two binding regions are designed to bind to contiguous or neighboring regions of template DNA. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the primers include a 5' region that is not specific for a target locus (such as a tag or a universal primer binding site) followed by a region that is specific for a target locus, an internal region that is not specific for the target locus and forms a loop structure, and a 3' region that is specific for the target locus. Tag-primers can be used to shorten necessary target-specific sequences to below 20, below 15, below 12, and even below 10 base pairs. This can be serendipitous with standard primer design when the target sequence is fragmented within the primer binding site or, or it can be designed into the primer design. Advantages of this method include: it increases the number of assays that can be designed for a certain maximal amplicon length, and it shortens the "non-informative" sequencing of primer sequence. It may also be used in combination with internal tagging (see elsewhere in this document).

In an embodiment, the relative amount of nonproductive products in the multiplexed targeted PCR amplification can be reduced by raising the annealing temperature. In cases where one is amplifying libraries with the same tag as the target specific primers, the annealing temperature can be increased in comparison to the genomic DNA as the tags will contribute to the primer binding. In some embodiments we are using considerably lower primer concentrations than previously reported along with using longer annealing times than reported elsewhere. In some embodiments the annealing times may be longer than 3 minutes, longer than 5 minutes, longer than 8 minutes, longer than 10 minutes, longer than 15 minutes, longer than 20 minutes, longer than 30 minutes, longer than 60 minutes, longer than 120 minutes, longer than 240 minutes, longer than 480 minutes, and even longer than 960 minutes. In an embodiment, longer annealing times are used than in previous reports, allowing lower primer concentrations. In various embodiments, longer than normal extension times are used, such as greater than 3, 5, 8, 10, or 15 minutes. In some embodiments, the primer concentrations are as low as 50 nM, 20 nM, 10 nM, 5 nM, 1 nM, and lower than 1 uM. This surprisingly results in robust performance for highly multiplexed reactions, for example 1,000-plex reactions, 2,000-plex reactions, 5,000-plex reactions, 10,000-plex reactions, 20,000-plex reactions, 50,000-plex reactions, and even 100,000-plex reactions. In an embodiment, the amplification uses one, two, three, four or five cycles run with long annealing times, followed by PCR cycles with more usual annealing times with tagged primers.

To select target locations, one may start with a pool of candidate primer pair designs and create a thermodynamic model of potentially adverse interactions between primer pairs, and then use the model to eliminate designs that are incompatible with other the designs in the pool.

In an embodiment, the invention features a method of decreasing the number of target loci (such as loci that may contain a polymorphism or mutation associated with a disease or disorder or an increased risk for a disease or disorder such as cancer) that need to be detected for a diagnosis and/or increasing the disease load that is detected (e.g., increasing the number of polymorphisms or mutations that are detected). In some embodiments, the method includes ranking (such as ranking from highest to lowest) loci by frequency or reoccurrence of a polymorphism or mutation (such as a single nucleotide variation, insertion, or deletion, or any of the other variations described herein) in each locus among subjects with the disease or disorder such as cancer. In some embodiments, PCR primers are designed to some or all of the loci. During selection of PCR primers for a library of primers, primers to loci that have a higher frequency or reoccurrence (higher ranking loci) are favored over those with a lower frequency or reoccurrence (lower ranking loci). In some embodiments, this parameter is included as one of the parameters in the calculation of the scores (such as the undesirability scores) described herein. If desired, primers (such as primers to high ranking loci) that are incompatible with other designs in the library can be included in a different PCR library/pool. In some embodiments, multiple libraries/pools (such as 2, 3, 4, 5 or more) are used in separate PCR reactions to enable amplification of all (or a majority) of the loci represented by all the libraries/pools. In some embodiment, this method is continued until sufficient primers are included in one or more libraries/pools such that the primers, in aggregate, enable the desired disease load to be captured for the disease or disorder (e.g., such as by detection of at least 80, 85, 90, 95, or 99% of the disease load).

In some embodiments, the library of candidate primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs. In some embodiments, only a relatively small number of candidate primers need to be removed from the library to achieve the desired reduction in primer dimers. In some embodiments, less than 30, 20, 15, 10, 5, or 2% of the candidate primers are removed from the library prior to use of the resulting library for multiplex PCR amplification of target loci. In some embodiments, a relatively large number of candidate primers are removed from the library to achieve the desired characteristics for the resulting library. In some embodiments, at least 20, 30, 40, 50, 60, 70, 80, or 90% of the candidate primers are removed from the library prior to use of the resulting library for multiplex PCR amplification of target loci. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers or different primer pairs remain in the library (after removal of some candidate primers from the library).

After the selection process, the primers remaining in the library may be used in any of the methods of the invention.

Exemplary Methods for Determining Interaction Scores

Exemplary methods of determining a ΔG value (such as the change in Gibbs free energy for primer dimer formation) or an interaction score that indicates the likelihood of dimer formation between candidate primers are described below. In some embodiments, a thermodynamic Nearest-Neighbors approach is used to calculate the likelihood of dimer formation between any two primers (see, e.g., Rahmann and Grafe (2004), "Mean and variance of the Gibbs free energy of oligonucleotides in the nearest neighbor model under varying conditions" Bioinformatics 20, 2928-2933; Allawi, H. T. & SantaLucia, J., Jr. (1998), "Thermodynamics of Internal C-T Mismatches in DNA", *Nucleic Acids Res.* 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444.; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21 (8): 1701-2, which are each hereby incorporated by reference in its entirety).

In some embodiments, the following steps are performed.

Step 1

Figure 33A:
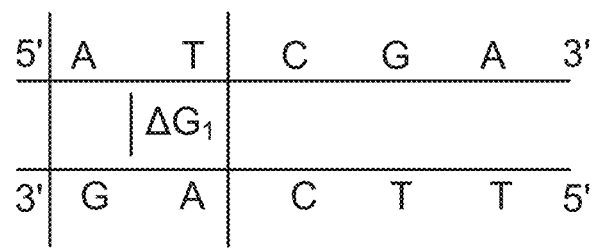

For each primer in a set of candidate primers, compare to every other candidate primer in the following way. Implement an ungapped thermodynamic alignment between the two primers, matching the 5' end of the first primer to the 3' end of the second primer. Taking the first two bases (dinucleotide) that align to the other primer and vice versa, determine the ΔH and ΔS values for the dinucleotide in one primer hybridizing to the dinucleotide in the other primer (see the "AT" hybridizing to "GA" in FIG. 33A). ΔH and ΔS values for various combinations of dinucleotides are known and can be determined, for example, using a thermodynamic look up table (such as the Unified NN model parameters according to Allawi and SantaLucia (1997) "Thermodynamics and NMR of internal G-T mismatches in DNA". *Biochemistry*, 36:10581-10594, which is hereby incorporated by reference in its entirety). Use the ΔH and ΔS values to calculate ΔG for that interaction as follows or as described in any known equation for this.

$$\Delta G = (1000.0 * \Delta H - (\text{temperature} * (\Delta S + 0.368 * (numPhosphates/2) * \log(saltConcentration))))/1000.0$$

Figure 33B:
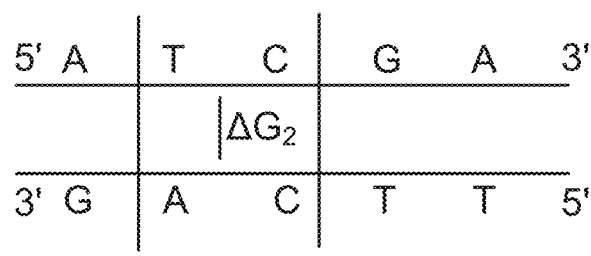

In some embodiments, one or more of the following conditions are assumed for this calculation: temperature: of 60.0° C., primer concentration of 100 nM, or salt concentration of 100 mM. In some embodiments, other conditions are assumed for this calculation, such as the conditions that will be used for multiplex PCR with the pool. Iterate over the remainder of the primer that aligns with the other primer by sliding the bases being observing one base to the right. Continue until ΔG has been calculated for all dinucleotides that align (FIG. 33B). The AG for that alignment of the primer pair is the sum of the ΔG values for the various dinucleotides.

Step 2

Shift the alignment of the two primers (FIGS. 33C and 33D).

Step 3

Figure 33E:
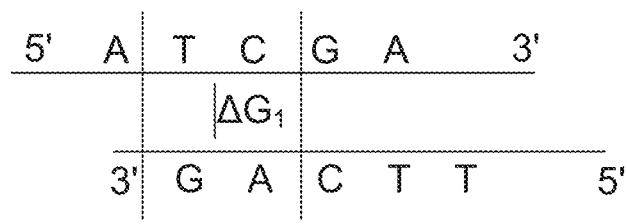
Figure 33F:
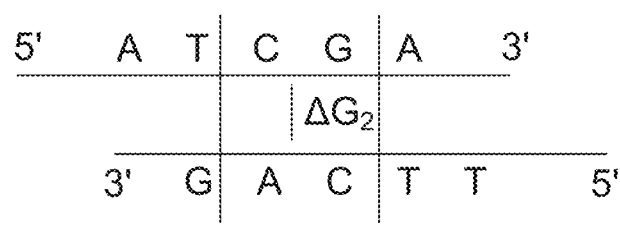

Repeat step 1 again for the new alignment (FIGS. 33E and 33F).

Step 4

After aligning all possible alignments between the two primers, determine the final ΔG value and the interaction score.

In some embodiments, the ΔG value for a combination of primers is the lowest ΔG value (the lowest numerical value, which is indicative of the greatest likelihood of primer dimer formation) out of the ΔG values for all possible alignments between the two primers. For example, if one alignment has a ΔG value of −12 kcal/mol and another alignment has a ΔG value of −2 kcal/mol then −12 kcal/mol (worse value) is used as the ΔG value for that combination of primers.

For algorithms such as the one in Example 16 in which it is easiest to rank primers based on assigning the worse combination of primers (those with the greatest likelihood of dimer formation) the highest interaction score, then the interaction score can be calculated as follows.

$$\text{Interaction score} = \max(-1 * \Delta G \text{ value})$$

For example, if one alignment has a ΔG value of −12 kcal/mol and another alignment has a ΔG value of −2 kcal/mol, then 12 kcal/mol is used as the interaction score. In this case, the interaction score with the largest numerical positive number indicates the least desirable combination of primers due to the greatest likelihood of primer dimer formation.

In some embodiments, the interaction score is calculated as follows (this score weights the ΔG values depending on the number of ends that a dimer can be extended by PCR).

$$\text{interaction\_score} = \max(-deltaG\_2, 0.8 * (-deltaG\_1))$$

where
deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

In some embodiments, deltaG_2 is determined by performing steps 1-4 above for all the alignments in which a dimer is extensible by PCR on both ends. The deltaG_2 value is the lowest ΔG value (the lowest numerical value, which is indicative of the greatest likelihood of primer dimer formation) for all the alignments in which a dimer is extensible by PCR on both ends.

In some embodiments, deltaG_1 is determined by performing steps 1-4 above for all the alignments in which a dimer is extensible by PCR on at least one end (such as by PCR on one end or by PCR on both ends). The deltaG_1 value is the lowest ΔG value (the lowest numerical value, which is indicative of the greatest likelihood of primer dimer formation) for all the alignments in which a dimer is extensible by PCR on at least one end.

In some embodiments, possible loop structures or gaps in alignment between primers are also considered.

In some embodiments, ΔG values from step 4 for each possible combination of two primers (each possible primer dimer) in a library are all equal to or greater than −20, −18, −16, −14, −12, −10, −9, −8, −7, −6, −5, −4, −3, −2, or −1 kcal/mol. In some embodiments, ΔG values from step 4 for at least 80, 85, 90, 92, 94, 96, 98, 99, or 100% of the primers in the library for possible combinations of that primer with other primers in the library are all equal to or greater than −20, −18, −16, −14, −12, −10, −9, −8, −7, −6, −5, −4, −3, −2, or −1 kcal/mol. In some embodiments, possible combinations of two primers in a library that have positive ΔG values are ignored since these values are indicative of no likelihood to for primer dimers. In some embodiments for the possible combination of two primers in a library that have negative ΔG values, the ΔG values are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive.

In some embodiments, the interaction scores from step 4 for each possible combination of two primers in a library are all equal to or less than 20, 18, 16, 14, 12, 10, 9, 8, 7, 6, 5, 4, 3, 2, or 1 kcal/mol. In some embodiments, the interaction scores from step 4 for at least 80, 85, 90, 92, 94, 96, 98, 99, or 100% of the primers in the library for possible combinations of that primer with other primers in the library are all equal to or less than 20, 18, 16, 14, 12, 10, 9, 8, 7, 6, 5, 4, 3, 2, or 1 kcal/mol. In some embodiments, possible combination of two primers in a library that have negative interaction scores are ignored since these values are indicative of no likelihood to for primer dimers. In some embodiments for the possible combination of two primers in a library that have positive interaction scores, the interaction scores are between 20 and 0 kcal/mol, such as between 15 and 0 kcal/mol, 10 and 0 kcal/mol, 8 and 0 kcal/mol, 7 and 0 kcal/mol, 6 and 0 kcal/mol, 5.5 and 0 kcal/mol, 5 and 0 kcal/mol, 4.5 and 0 kcal/mol, 4 and 0 kcal/mol, 3.5 and 0 kcal/mol, 3 and 0 kcal/mol, 2.5 and 0 kcal/mol, 2 and 0 kcal/mol, or 1.5 and 0 kcal/mol, inclusive.

In some embodiments, the score (such as the undesirability score) for candidate primers is based at least in part on the ΔG value or the interaction score that indicates the likelihood of dimer formation between candidate primers as calculated using any of these methods.

Exemplary Primer Libraries

In one aspect, the invention features libraries of primers, such as primers selected from a library of candidate primers using any of the methods of the invention. In some embodiments, the library includes primers that simultaneously hybridize (or are capable of simultaneously hybridizing) to or that simultaneously amplify (or are capable of simultaneously amplifying) at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci in one reaction volume. In various embodiments, the library includes primers that simultaneously amplify (or are capable of simultaneously amplifying) between 1,000 to 2,000; 2,000 to 5,000; 5,000 to 7,500; 7,500 to 10,000; 10,000 to 20,000; 20,000 to 25,000; 25,000 to 30,000; 30,000 to 40,000; 40,000 to 50,000; 50,000 to 75,000; or 75,000 to 100,000 different target loci in one reaction volume, inclusive. In various embodiments, the library includes primers that simultaneously amplify (or are capable of simultaneously amplifying) between 1,000 to 100,000 different target loci in one reaction volume, such as between 1,000 to 50,000; 1,000 to 30,000; 1,000 to 20,000; 1,000 to 10,000; 2,000 to 30,000; 2,000 to 20,000; 2,000 to 10,000; 5,000 to 30,000; 5,000 to 20,000; or 5,000 to 10,000 different target loci, inclusive. In some embodiments, the library includes primers that simultaneously amplify (or are capable of simultaneously amplifying) the target loci in one reaction volume such that less than 60, 40, 30, 20, 10, 5, 4, 3, 2, 1, 0.5, 0.25, 0.1, or 0.5% of the amplified products are primer dimers. The various embodiments, the amount of amplified products that are primer dimers is between 0.5 to 60%, such as between 0.1 to 40%, 0.1 to 20%, 0.25 to 20%, 0.25 to 10%, 0.5 to 20%, 0.5 to 10%, 1 to 20%, or 1 to 10%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, the primers simultaneously amplify (or are capable of simultaneously amplifying) the target loci in one reaction volume such that at least 50, 60, 70, 80, 90, 95, 96, 97, 98, 99, or 99.5% of the target loci are amplified. In various embodiments, the amount target loci that are amplified is between 50 to 99.5%, such as between 60 to 99%, 70 to 98%, 80 to 99%, 90 to 99.5%, 95 to 99.9%, or 98 to 99.99% inclusive. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primer pairs, wherein each pair of primers includes a forward test primer and a reverse test primer where each pair of test primers hybridize to a target locus. In some embodiments, the library of primers includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 individual primers that each hybridize to a different target locus, wherein the individual primers are not part of primer pairs.

In some embodiments, the library includes primers (such as at least 25; 50; 75; 100; 300; 500; 750; 1,000; 2,000; 5,000; 7,500; 10,000; 15,000; 19,000; 20,000; 25,000;

27,000; 28,000; 30,000; 40,000; 50,000; 75,000; or 100,000 different primers or different primer pairs) that simultaneously amplify (or are capable of simultaneously amplifying) the target loci (such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60, 40, 30, 20, 10, 5, 4, 3, 2, 1, 0.5, 0.25, 0.1, or 0.5% of the amplified products are primer dimers, (ii) at least 50, 60, 70, 80, 90, 95, 96, 97, 98, 99, or 99.5% of the amplified products are target amplicons, (iii) at least 50, 60, 70, 80, 90, 95, 96, 97, 98, 99, or 99.5% of the target loci are amplified, (iv) at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold, (v) at least 60, 70, 80, 90, 95, 96, 97, 98, 99, 99.5, or 100% of the amplified products map to the human genome, or (vi) any combination thereof.

In some embodiments, the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments for the amplification of nucleic acids (such as DNA or RNA) from a single cell (such as a fetal or embryonic cell), the library includes at least 1,000 different primers or different primer pairs (such as at least 2,000; 5,000; 7,500; 10,000; 15,000; 19,000; 20,000; 25,000; 27,000; 28,000; 30,000; 40,000; 50,000; 75,000; or 100,000 different primers or different primer pairs) that simultaneously amplify (or are capable of simultaneously amplifying) at least 1,000 different target loci (such as at least 2,000; 5,000; 7,500; 10,000; 15,000; 19,000; 20,000; 25,000; 27,000; 28,000; 30,000; 40,000; 50,000; 75,000; or 100,000 different target loci) in one reaction volume such that one or more of the following: (i) less than 60% of the amplified products are primer dimers and at least 10% of the amplified products are target amplicons, (ii) less than 40% of the amplified products are primer dimers and at least 10% of the amplified products are target amplicons, (iii) less than 20% of the amplified products are primer dimers and at least 10% of the amplified products are target amplicons, (iv) less than 10% of the amplified products are primer dimers and at least 10% of the amplified products are target amplicons, (v) less than 5% of the amplified products are primer dimers and at least 15% of the amplified products are target amplicons; (vi) less than 60% of the amplified products are primer dimers and at least 20% of the amplified products are target amplicons, (vii) less than 40% of the amplified products are primer dimers and at least 20% of the amplified products are target amplicons, (viii) less than 20% of the amplified products are primer dimers and at least 20% of the amplified products are target amplicons, (ix) less than 10% of the amplified products are primer dimers and at least 20% of the amplified products are target amplicons, (x) less than 5% of the amplified products are primer dimers and at least 20% of the amplified products are target amplicons; (xi) less than 60% of the amplified products are primer dimers and at least 40% of the amplified products are target amplicons, (xii) less than 40% of the amplified products are primer dimers and at least 40% of the amplified products are target amplicons, (xiii) less than 20% of the amplified products are primer dimers and at least 40% of the amplified products are target amplicons, (xiv) less than 10% of the amplified products are primer dimers and at least 40% of the amplified products are target amplicons, (xv) less than 5% of the amplified products are primer dimers and at least 45% of the amplified products are target amplicons; (xvi) less than 40% of the amplified products are primer dimers and at least 60% of the amplified products are target amplicons, (xvii) less than 20% of the amplified products are primer dimers and at least 80% of the amplified products are target amplicons, (xviii) less than 10% of the amplified products are primer dimers and at least 90% of the amplified products are target amplicons, or (xviiii) less than 5% of the amplified products are primer dimers and at least 95% of the amplified products are target amplicons. In some embodiments, at least 50, 60, 70, 80, 90, 95, 96, 97, 98, 99, or 99.5% of the target loci are amplified at least 5, 10, 20, 40, 50, 60, 80, 100, 120, 150, 200, 300, or 400-fold. In some embodiments, one or more of these embodiments (e.g., percent of primer dimers, target amplicons, or amplified target loci) is achieved after greater than or equal to 5, 10, 20, 30, 40, 50, or 60 cycles of PCR are performed. In some embodiments for a library that amplifies human target loci, at least 60, 70, 80, 90, 95, 96, 97, 98, 99, 99.5, or 100% of the amplified products map to the human genome.

In various embodiments, the concentration of each primer is less than 100, 75, 50, 25, 20, 10, 5, 2, 1, 0.5, 0.1, or 0.05 nM, or less than 500, 100, 10, or 1 uM. In various embodiments, the concentration of each primer is between 1 uM to 100 nM, such as between 1 uM to 1 nM, 1 to 75 nM, 1 to 20 nM, 1 to 10 nM, 2 to 50 nM or 5 to 50 nM, inclusive. In some embodiments, the concentration of one or more universal primers is between 0.2 to 3 µM, such as between 0.5 and 2.5 µM, 0.5 to 1 µM, or 1 to 2.5 µM per primer, inclusive, and the concentration of each primer except the universal primer(s) is between 1 uM to 100 nM, such as between 1 uM to 1 nM, 1 to 75 nM, 1 to 20 nM, 1 to 10 nM, 2 to 50 nM or 5 to 50 nM, inclusive. In various embodiments, the GC content of the primers is between 30 to 80%, such as between 20 to 70%, 40 to 70%, or 50 to 60%, inclusive. In some embodiments, the range of GC content of the primers is less than 30, 20, 10, or 5%. In some embodiments, the range of GC content of the primers is between 5 to 30%, such as 5 to 20% or 5 to 10%, inclusive. In some embodiments, there is a high GC content in the 3' end of the primers. In some embodiments, there are at least 2 (such as 3, 4, or 5) guanines or cytosines in the last 5 bases at the 3' end of the primers. In some embodiments, there are at least 1 (such as 2 or 3) guanines or cytosines in the last 3 bases at the 3' end of the primers. In some embodiments, a maximum of 2 (such as 2, 1, or 0) bases in the last 5 bases at the 3' end of the primers are guanines or cytosines. In some embodiments, a maximum of 1 (such as 1 or 0) base in the last 5 bases at the 3' end of the primers is a guanine or cytosine. In some embodiments, the maximum length of a homopolymer (the same base in a row) in the primers is 12, 10, 8, 6, 5, 4, 3, or 2 consecutive nucleotides. In some embodiments, the melting temperature ($T_m$) of the test primers is between 40 to 80° C., such as 50 to 70° C., 55 to 65° C., 54 to 60.5° C., or 57 to 60.5° C., inclusive. In some embodiments, the $T_m$ is calculated using the Primer3 program (libprimer3 release 2.2.3) using the built-in SantaLucia parameters (the World Wide Web at primer3.sourceforge.net). In some embodiments, the range of melting temperature of the primers is less than 15, 10, 5, 3, or 1° C. In some embodiments, the range of melting temperature of the primers is between 1 to 15° C., such as between 1 to 10° C., 1 to 5° C., or 1 to 3° C., inclusive. In some embodiments, the range of melting temperatures of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the primers is between 1 to 15° C., such as between 1 to 10° C., 1 to 5° C., 1 to 3° C., 2 to 5° C., 3 to 10° C., or 3 to 5° C., inclusive. In some embodiments, the length of the primers is between 15 to 100 nucleotides, such as between 15 to 75 nucleotides, 15 to 40 nucleotides, 17 to 35 nucleotides, 18 to 30 nucleotides, 20 to 65 nucleotides, inclusive. In some embodiments, the range of the length of the primers is less than 50, 40, 30, 20, 10, or 5 nucleotides. In some embodiments, the range of the length of the primers is between 5 to 50 nucleotides, such as 5 to 40 nucleotides, 5 to 20 nucleotides, or 5 to 10 nucleotides, inclusive. In some embodiments, the length of the target amplicons is between 50 and 100 nucleotides, such as between 60 and 80 nucleotides, or 60 to 75 nucleotides, inclusive. In some embodiments, the length of the target amplicons is between 30 and 400 nucleotides, such as between 30 and 200 nucleotides, or 100 and 400 nucleotides, inclusive. In some embodiments, the length of the target amplicons is at least 100; 200; 300; 400; 500; 600; 700; 800; 900; 1,000; 1,200; 1,500; 2,000; or 3,000 nucleotides. In some embodiments, the length of the target amplicons is between 100 and 1,500 nucleotides, such as between 100 to 1,000; 100 to 500, 500 to 750, or 750 to 1,000 nucleotides, inclusive. Longer amplicons may be desirable, e.g., for applications in which is it desirable to screen for multiple potential mutations in one amplicon, such as carrier screening. In some embodiments, one round of PCR is performed to produce relatively long amplicons (such as at least 250 or 500 nucleotides in length) and then a second round of PCR is performed to produce shorter amplicons (to amplify regions within the amplicons amplified in the first round of PCR, such as regions of less than 200 or 100 nucleotides in length). In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or all of the target amplicons have a length that falls within the range of the average length of the amplicons ±5% of the average length, average length ±20%, average length ±20%, or average length ±30%, or average length ±50%.

In some embodiments, library includes at least at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers that each includes a target specific sequence, such as a sequence that binds a target locus but does not substantially bind to other nucleic acids (such as non-target loci) in a sample, e.g., a biological sample, which naturally includes other nucleic acids. In some embodiments, each primer binds and amplifies a target locus by at least 2, 4, 6, 8, 10, 20, 50-fold or more than one or more (or all) other nucleic acids (such as non-target loci) in a sample. In some embodiments, the library includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target specific primers (e.g., primers that are specific for a target locus). In some embodiments, part or all of the polynucleotide sequence is a non-random sequence for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different primers in the library. In some embodiments, library also includes a universal primer, a random primer, and a primer with a non-naturally occurring polynucleotide sequence, or a primer with a polynucleotide sequence not naturally found in a human in some embodiments, the universal or random primer has a non-naturally occurring polynucleotide sequence or a polynucleotide sequence not naturally found in a human.

In some embodiments, the composition includes at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence of a human nucleic acid and at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) with a polynucleotide sequence that is not found in a human (such as a universal primer, a primer that comprises a region or consists entirely of random nucleotides, or a primer with a region such as a tag or barcode of one or more nucleotides that are not found in a human or are not found in nature as part of the polynucleotide sequence of the primer). In some embodiments, at least one primer (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers) includes a region of one or more nucleotides that is not naturally part of the primer sequence (such as a region added to the 5' end of the target specific sequence in the primer or an internal region added between the 5' and 3' ends of the primer). In some embodiments, the primer is free of the nucleic acids (such as genes) which, in the naturally-occurring genome of the organism from which the nucleic acid of the invention is derived, flank the gene. In some embodiments, the primer has been separated from one or more components that naturally accompany the corresponding sequence in nature (such as in the genome of a human). Typically, each primer is at least 90, 95, 98, 99, 99.9, or 100%, by weight, free from the molecules (such as proteins, nucleic acids, and naturally-occurring organic molecules) that naturally accompany the corresponding sequence in nature (such as in the genome of a human). Purity can be assayed by any appropriate method, e.g., by electrophoresis or HPLC analysis.

In some embodiments, the primers in the library are not immobilized (such as not immobilized to a solid support) or not part of a microarray. In some embodiments, the primers are dissolved in solution (such as dissolved in the liquid phase). In some embodiments, the library comprises a microarray. In some embodiments, the amplified products are detected using an array, such as an array with probes to one or more chromosomes of interest (e.g., chromosome 13, 18, 21, X, Y, or any combination thereof).

In some embodiments, at least one of the primers (such as at least 20, 40, 80, 90, 95, 98, 99, 99.5, or 100% of the primers) in a library are nucleic acid analogs that have a lower likelihood of primer dimerization compared to the naturally-occurring nucleic acids (see, e.g., U.S. Pat. Nos. 7,414,118 and 6,001,611; which are each hereby incorporated by reference in its entirety). Exemplary nucleic acid analogs have a modified pyrimidine nucleobase, or a purine or pyrimidine base that contains an exocyclic amine.

In some embodiments, the primer library includes a small number of primers (such as less than 5, 2, 1, or 0.5% of the primers in the library) that do not have one or more of the properties described herein. In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −20, −18, −16, −14, −12, −10, −9, −8, −7, −6, −5, −4, −3, −2, or −1 kcal/mol; (ii) ΔG values for the possible combination of that primer with other primers in the library that have negative ΔG are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive; (iii) the GC content is between 30 to 80%, such as between 20 to 70%, 40 to 70%, or 50 to 60%, inclusive; (iv) the range of GC content is less than 30, 20, 10, or 5% or the range of GC content of the primers is between 5 to 30%, such as 5 to 20%, or 5 to 10%, inclusive; (v) a maximum of 2 (such as 2, 1, or 0) bases in the last 5 bases at the 3' end of the primers are guanines or cytosines; (vi) the melting temperature ($T_m$) of the primers is between 40 to 80° C., such as 50 to 70° C., 55 to 65° C., 54 to 60.5° C., or 57 to 60.5° C., inclusive; (vii) the range of melting temperature of the primers is less than 15, 10, 5, 3, or 1° C.; (viii) the range of melting temperature of the primers is between 1 to 15° C., such as between 1 to 10° C., 1 to 5° C., 1 to 3° C., 2 to 5° C., 3 to 10° C., or 3 to 5° C., inclusive; (ix) the length of the primers is between 15 to 100 nucleotides, such as between 15 to 75 nucleotides, 15 to 40 nucleotides, 17 to 35 nucleotides, 18 to 30 nucleotides, or 20 to 65 nucleotides, inclusive; (x) the range of the length of the primers is less than 50, 40, 30, 20, 10, or 5 nucleotides; (xi) the range of the length of the primers is between 5 to 50 nucleotides, such as 5 to 40 nucleotides, 5 to 20 nucleotides, or 5 to 10 nucleotides, (xii) the length of the target amplicons is between 50 and 100 nucleotides, such as between 60 and 80 nucleotides, or 60 to 75 nucleotides; (xiii) the length of the target amplicons is between 30 and 400 nucleotides, such as between 30 and 200 nucleotides, or 100 and 400 nucleotides; (xiv) the range of the length of the target amplicons is less than 50, 25, 15, 10, or 5 nucleotides; (xv) the range of the length of the target amplicons is between 5 to 50 nucleotides, such as 5 to 25 nucleotides, 5 to 15 nucleotides, or 5 to 10 nucleotides; (xvi) the maximum length of a homopolymer in the primers is 12, 10, 8, 6, 5, 4, 3, or 2 consecutive nucleotides; (xvii) the concentration of each primer is less than 100, 75, 50, 25, 20, 10, 5, 2, 1, 0.5, 0.1, or 0.05 nM, or less than 500, 100, 10, or 1 uM; (xviii) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xix) at least 80, 90, 92, 94, 96, 98, 99, or 100% of the molecules of that primer are extended to form amplified products; (xx) SNPs (if any) are not in the last 5 nucleotides in the 3' end of the candidate primer; (xxi) the target bases (the bases of interest in a target locus) are near an end (the 3' or 5' end) of the amplicon; (xxii) the region of hybridization is separated from the polymorphic site by a small number of bases, where the small number is selected from the group consisting of 1, 2, 3, 4, 5, 6 to 10, 11 to 15, 16 to 20, 21 to 25, 26 to 30, and 31 to 60; (xxiii) the length of the annealing step is greater than 1, 3, 5, 8, 10, 15, 20, 30, 45, 60, 75, 90, 120, 150, or 180 minutes, (xxiv) the length of the annealing step (per PCR cycle) is between 5 and 180 minutes, such as 5 to 60, 10 to 60, 5 to 30, or 10 to 30 minutes, inclusive, (xxv) the length of the annealing step is greater than 5 minutes (such greater than 10, or 15 minutes), and the concentration of each primer is less than 20 nM, (xxvi) the length of the annealing step is greater than 5 minutes (such greater than 10, or 15 minutes), and the concentration of each primer is between 1 to 20 nM, or 1 to 10 nM, inclusive; (xxvii) the length of the annealing step is greater than 20 minutes (such as greater than 30, 45, 60, or 90 minutes), and the concentration of each primer is less than 1 nM; (xxviii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xxix) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xxx) the annealing temperature is at least 1, 2, 3, 4, 5, 6, 7, 8, 9, 10, 11, 12, 13, or 15° C. greater than the highest melting temperature of the primers; (xxxi) the annealing temperature is at least 1, 2, 3, 4, 5, 6, 7, 8, 9, 10, 11, 12, 13, or 15° C. greater than the average melting temperature of the primers, (xxxii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xxviii) any combination thereof. In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −20, −18, −16, −14, −12, −10, −9, −8, −7, −6, −5, −4, −3, −2, or −1 kcal/mol; (ii) ΔG values for the possible combination of that primer with other primers in the library that have negative ΔG are between −20 and 0 kcal/mol, such as between −15 and 0 kcal/mol, −10 and 0 kcal/mol, −8 and 0 kcal/mol, −7 and 0 kcal/mol, −6 and 0 kcal/mol, −5.5 and 0 kcal/mol, −5 and 0 kcal/mol, −4.5 and 0 kcal/mol, −4 and 0 kcal/mol, −3.5 and 0 kcal/mol, −3 and 0 kcal/mol, −2.5 and 0 kcal/mol, −2 and 0 kcal/mol, or −1.5 and 0 kcal/mol, inclusive; (iii) the melting temperature ($T_m$) of the primers is between 40 to 80° C., such as 50 to 70° C., 55 to 65° C., 54 to 60.5° C., or 57 to 60.5° C., inclusive; (iv) the range of melting temperature of the primers is less than 15, 10, 5, 3, or 1° C.; (v) the range of melting temperature of the primers is between 1 to 15° C., such as between 1 to 10° C., 1 to 5° C., 1 to 3° C., 2 to 5° C., 3 to 10° C., or 3 to 5° C., inclusive; (vi) the length of the target amplicons is between 50 and 100 nucleotides, such as between 60 and 80 nucleotides, or 60 to 75 nucleotides; (vii) the length of the target amplicons is between 30 and 400 nucleotides, such as between 30 and 200 nucleotides, or 100 and 400 nucleotides; (viii) the range of the length of the target amplicons is less than 50, 25, 15, 10, or 5 nucleotides; (ix) the range of the length of the target amplicons is between 5 to 50 nucleotides, such as 5 to 25 nucleotides, 5 to 15 nucleotides, or 5 to 10 nucleotides; (x) the concentration of each primer is less than 100, 75, 50, 25, 20, 10, 5, 2, 1, 0.5, 0.1, or 0.05 nM, or less than 500, 100, 10, or 1 uM; (xi) the concentration of each primer is between 1 uM to 100 nM, such as between 1 uM to 1 nM, 1 to 75 nM, 1 to 20 nM, 1 to 10 nM, 2 to 50 nM, or 5 to 50 nM, inclusive; (xii) the annealing temperature is at least 1, 2, 3, 4, 5, 6, 7, 8, 9, 10, 11, 12, 13, or 15° C. greater than the melting temperature (such as the empirically measured or calculated $T_m$) of the primers; (xiii) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of the primers; (xiv) the annealing temperature is at least 1, 2, 3, 4, 5, 6, 7, 8, 9, 10, 11, 12, 13, or 15° C. greater than the highest melting temperature of the primers; (xv) the annealing temperature is at least 1, 2, 3, 4, 5, 6, 7, 8, 9, 10, 11, 12, 13, or 15° C. greater than the average melting temperature of the primers, (xvi) the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature of the primers; and (xvii) any combination thereof.

In various embodiments, at least 80, 90, 95, 96, 97, 98, 99, 99.5, or 100% of the primers in the library have one or more of the following properties: (i) ΔG values for possible combinations of that primer with other primers in the library are all equal to or greater than −10 kcal/mol, (ii) the range of melting temperature of the primers is between 1 to 15° C., (iii) the length of the target amplicons is between 50 and 100 nucleotides, (iv) the concentration of each primer is less than 20 nM, (v) the length of the annealing step is greater than 5 minutes (such as greater than 10 minutes), (vi) the length of the annealing step is greater than 5 minutes (such greater than 10 minutes), and the concentration of each primer is less than 20 nM, and (vii) any combination thereof. In various embodiments, at least 80, 90, 95, 96, 97, 98, 99, 99.5, or 100% of the primers in the library have the following properties: (i) ΔG values for possible combinations of that primer with other primers in the library are all equal to or greater than −10 kcal/mol and (ii) the range of melting temperature of the primers is between 1 to 15° C. In various embodiments, at least 80, 90, 95, 96, 97, 98, 99, 99.5, or 100% of the primers in the library have the following properties: (i) the length of the target amplicons is between 50 and 100 nucleotides, and (ii) the concentration of each primer is less than 20 nM. In various embodiments, at least 80, 90, 95, 96, 97, 98, 99, 99.5, or 100% of the primers in the library have the following properties: (i) the length of the target amplicons is between 50 and 100 nucleotides and (ii) the length of the annealing step is greater than 5 minutes (such as greater than 10 minutes). In various embodiments, at least 80, 90, 95, 96, 97, 98, 99, 99.5, or 100% of the primers in the library have the following properties: (i) the length of the target amplicons is between 50 and 100 nucleotides, (ii) the length of the annealing step is greater than 5 minutes (such greater than 10 minutes), and (iii) the concentration of each primer is less than 20 nM, and (vii) any combination thereof.

In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers; (ii) the annealing temperature is between 5 and 15° C., inclusive greater than the melting temperature of the primers; (iii) the annealing temperature is at least 5° C. (such as at least 6, 8, or 10° C.) greater than the highest melting temperature of the primers; (iv) the annealing temperature is at least 5° C. (such as at least 6, 8, or 10° C.) greater than the average melting temperature of the primers, (v) the annealing temperature is between 4 and 15° C. inclusive greater than the average melting temperature of the primers; and (vi) any combination thereof. In various embodiments, at least 80, 90, 95, 96, 97, 98, 99, 99.5, or 100% of the primers in the library have one or more of the following properties: (i) the annealing temperature is at least 5° C. (such as at least 6, 8, or 10° C.) greater than the melting temperature (such as the empirically measured or calculated $T_m$) of the primers and the length of the annealing step is greater than 5 minutes (such greater than 10 minutes); (ii) the annealing temperature is between 5 and 15° C., inclusive greater than the melting temperature of the primers and the length of the annealing step is greater than 5 minutes (such greater than 10 minutes); (iii) the annealing temperature is at least 5° C. (such as at least 6, 8, or 10° C.) greater than the highest melting temperature of the primers and the length of the annealing step is greater than 5 minutes (such greater than 10 minutes); (iv) the annealing temperature is at least 5° C. (such as at least 6, 8, or 10° C.) greater than the average melting temperature of the primers and the length of the annealing step is greater than 5 minutes (such greater than 10 minutes), (v) the annealing temperature is between 4 and 15° C. inclusive greater than the average melting temperature of the primers and the length of the annealing step is greater than 5 minutes (such greater than 10 minutes); and (vii) any combination thereof. In some embodiments, the guanine-cytosine (GC) content of the primers is between 30% and 80%, inclusive; the range of melting temperatures of the primers is less than 5° C.; and the length of the primers is between 15 to 75 nucleotides, inclusive;

In some embodiments, some (such as at least 80, 90, or 95%) or all of the adaptors or primers include one or more linkages between adjacent nucleotides other than a naturally-occurring phosphodiester linkage. Examples of such linkages include phosphoramide, phosphorothioate, and phosphorodithioate linkages. In some embodiments, some (such as at least 80, 90, or 95%) or all of the adaptors or primers include a thiophosphate (such as a monothiophosphate) between the last 3' nucleotide and the second to last 3' nucleotide. In some embodiments, some (such as at least 80, 90, or 95%) or all of the adaptors or primers include a thiophosphate (such as a monothiophosphate) between the last 2, 3, 4, or 5 nucleotides at the 3' end. In some embodiments, some (such as at least 80, 90, or 95%) or all of the adaptors or primers include a thiophosphate (such as a monothiophosphate) between at least 1, 2, 3, 4, or 5 nucleotides out of the last 10 nucleotides at the 3' end. In some embodiments, such primers are less likely to be cleaved or degraded, such primers may be desirable if a polymerase with proof-reading ability is used (to reduce or prevent the polymerase from removing nucleotides from the primers). In some embodiments, any of the embodiments involving primers with at least one linkage other than a naturally-occurring phosphodiester linkage are used with a polymerase having proof-reader activity. In some embodiments, the primers do not contain an enzyme cleavage site (such as a protease cleavage site). In some embodiments, equal to or greater than 1, 10, 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 primers in the library are non-naturally occurring nucleic acids (such nucleic acids with one or more linkages between adjacent nucleotides other than a naturally-occurring phosphodiester linkage).

In some embodiments, the primers have any combination of two or more of the aspects or embodiments disclosed herein.

These primer libraries can be used in any of the methods of the invention.

Exemplary Primers

The primer design methods of the invention have been used to generate several exemplary primer libraries to human target loci. For example, the primer design methods of the invention were used to generate primer libraries. Each of these libraries is composed of three primers per target locus for 1,200; 2,686; or 10,984 different target loci, respectively. The methods of the invention can also be used to generate libraries to non-human target loci.

For an experiment using the 2,686-plex library for multiplex PCR followed by sequencing, the percent of the amplified products that were primer dimers was 11.13%, the median depth of read per target that was amplified was 799.5× coverage, the percent of amplified products that were target amplicons out of the amplified products that were not primer dimers was 93.15% (this is the percent of on target reads when reads for amplified primer dimers are ignored); the number of target loci that were not amplified (failed assay count) was 246; the percent of target loci that were not amplified (failed assay percentage) was 9.16%; the percent of target loci that were amplified was 90.84%; and the total number of reads was 2,522,742. For this primer library, the $\Delta G$ values for each possible combination of two primers (each possible primer dimer) in the library are all equal to or greater than −3.86 kcal/mol. This-3.86 kcal/mol value was used as a threshold value to select candidate primers that all had a value equal to or greater than (more desirable than) this value from an initial library of candidate primers.

For an experiment using the 10,984-plex library for multiplex PCR followed by sequencing, the percent of the amplified products that were primer dimers was 5.50%, the median depth of read per target that was amplified was 1,286.5× coverage, the percent of amplified products that were target amplicons out of the amplified products that were not primer dimers was 60.16% (this is the percent of on target reads when reads for amplified primer dimers were ignored); the number of target loci that were not amplified (failed assay count) was 3,712; the percent of target loci that were not amplified (failed assay percentage) was 33.79%; the percent of target loci that were amplified was 66.21%; and the total number of reads was 25,372,858.

For an experiment using the 1,200-plex library for multiplex PCR of a sample of only a single cell followed by sequencing, the percent of the amplified products that were primer dimers was 24.13%. This library has primers to human target loci on chromosome 1, chromosome 21, and the X chromosome. For chromosomes 1 and 21, the median depth of read per target that was amplified was 436× coverage; the percent of target loci that were not amplified (failed assay percentage) was 32.69%; and the percent of target loci that were amplified was 67.31%. The total number of reads was 808,106.

The primer design methods of the invention were also used to generate a library for ~11,000 different target loci (such as amplifying 10,732 different target human loci using 10,732 different primer pairs). For an experiment using this library for multiplex PCR followed by sequencing, the percent of the amplified products that were primer dimers was 14.75%, the median depth of read per target that was amplified was 72.27× coverage, the percent of the amplified products that were target amplicons was 84.32%; the number of target loci that were not amplified (failed assay count) was 118; the percent of target loci that were not amplified (failed assay percentage) was 1.10%; the percent of target loci that were amplified was 98.9%; and the total number of reads was 6,345,782. For this primer library, the $\Delta G$ values for each possible combination of two primers (each possible primer dimer) in the library are all equal to or greater than −4.28 kcal/mol. This-4.28 kcal/mol value was used as a threshold value to select candidate primer that all had a value equal to or greater than (more desirable than) this value from an initial library of candidate primers. For the initial candidate primers that were used to select primers for this library, the following interaction cost histogram shows the number of candidate primers for each of the following ranges of $\Delta G$ values. This illustrates how the values for the candidate primers compares to the −4.28 kcal/mol threshold value for the final library.

0 to −0.497 kcal/mol: 88357
−0.497 to −0.993 kcal/mol: 30529
−0.993 to −1.49 kcal/mol: 7862
−1.49 to −1.99 kcal/mol: 2639
−1.99 to −2.48 kcal/mol: 1086
−2.48 to −2.98 kcal/mol: 393
−2.98 to −3.48 kcal/mol: 148
−3.48 to −3.97 kcal/mol: 58
−3.97 to −4.47 kcal/mol: 18
−4.47 to −4.97 kcal/mol: 4
−4.97 to −5.46 kcal/mol: 3
−5.46 to −5.96 kcal/mol: 0
−5.96 to −6.46 kcal/mol: 2
−6.46 to −6.95 kcal/mol: 3

The primer design methods of the invention were also used to generate a library for ~14,000 different target loci (such as amplify 13,392 different target human loci with 13,392 different primer pairs). For an experiment using this library for multiplex PCR followed by sequencing, the percent of the amplified products that were primer dimers was 0.56%, the median depth of read per target that was amplified was 69.09× coverage, the percent of the amplified products that were target amplicons was 99.42%; the number of target loci that were not amplified (failed assay count) was 44; the percent of target loci that were not amplified (failed assay percentage) was 0.33%; the percent of target loci that were amplified was 99.67%; and the total number of reads was 7,772,454.

Figure 35:
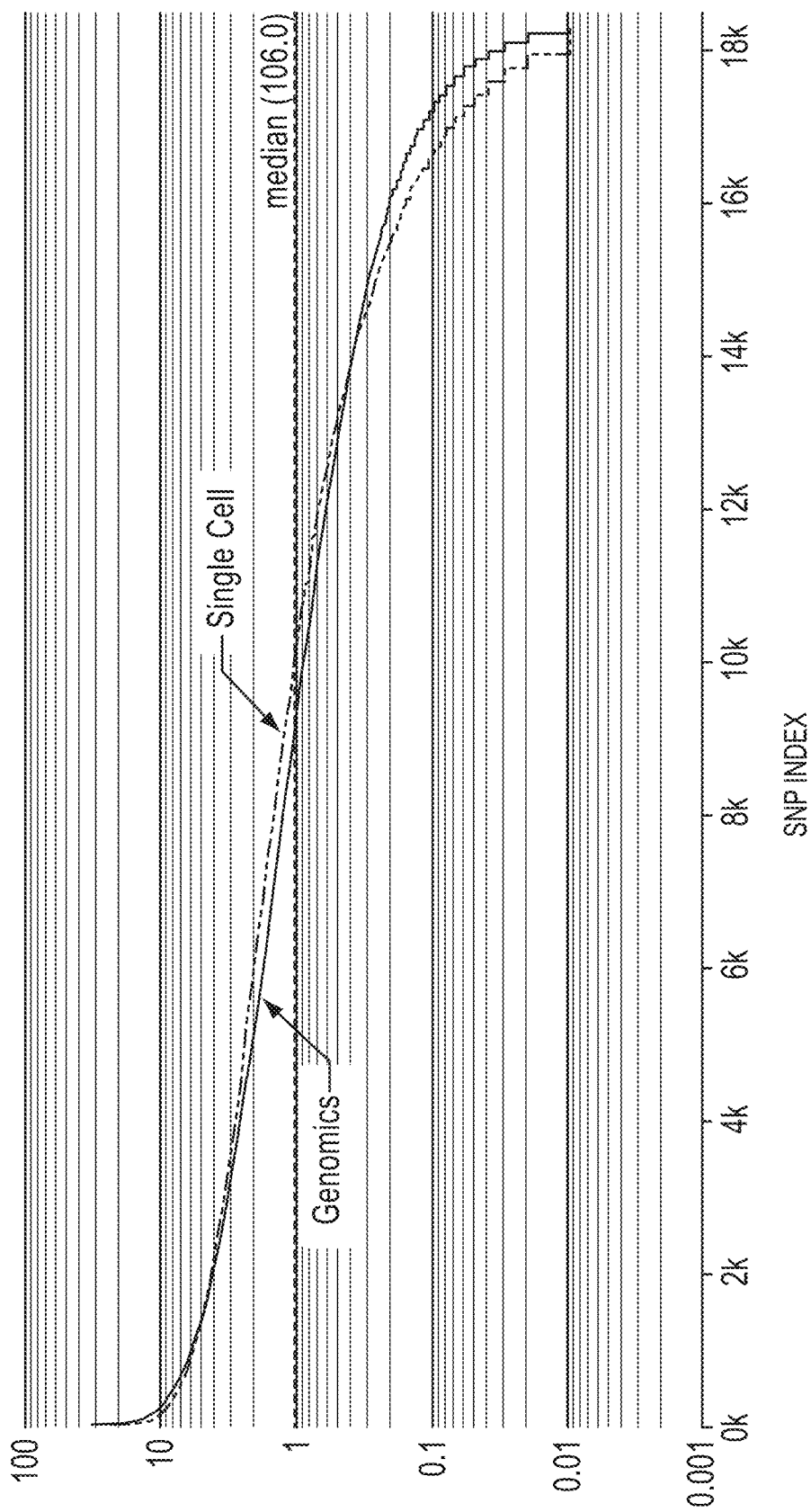
FIG. 35: Overlay of depth of read for a genomic and a single cell sample for different SNPs.
Figure 37:
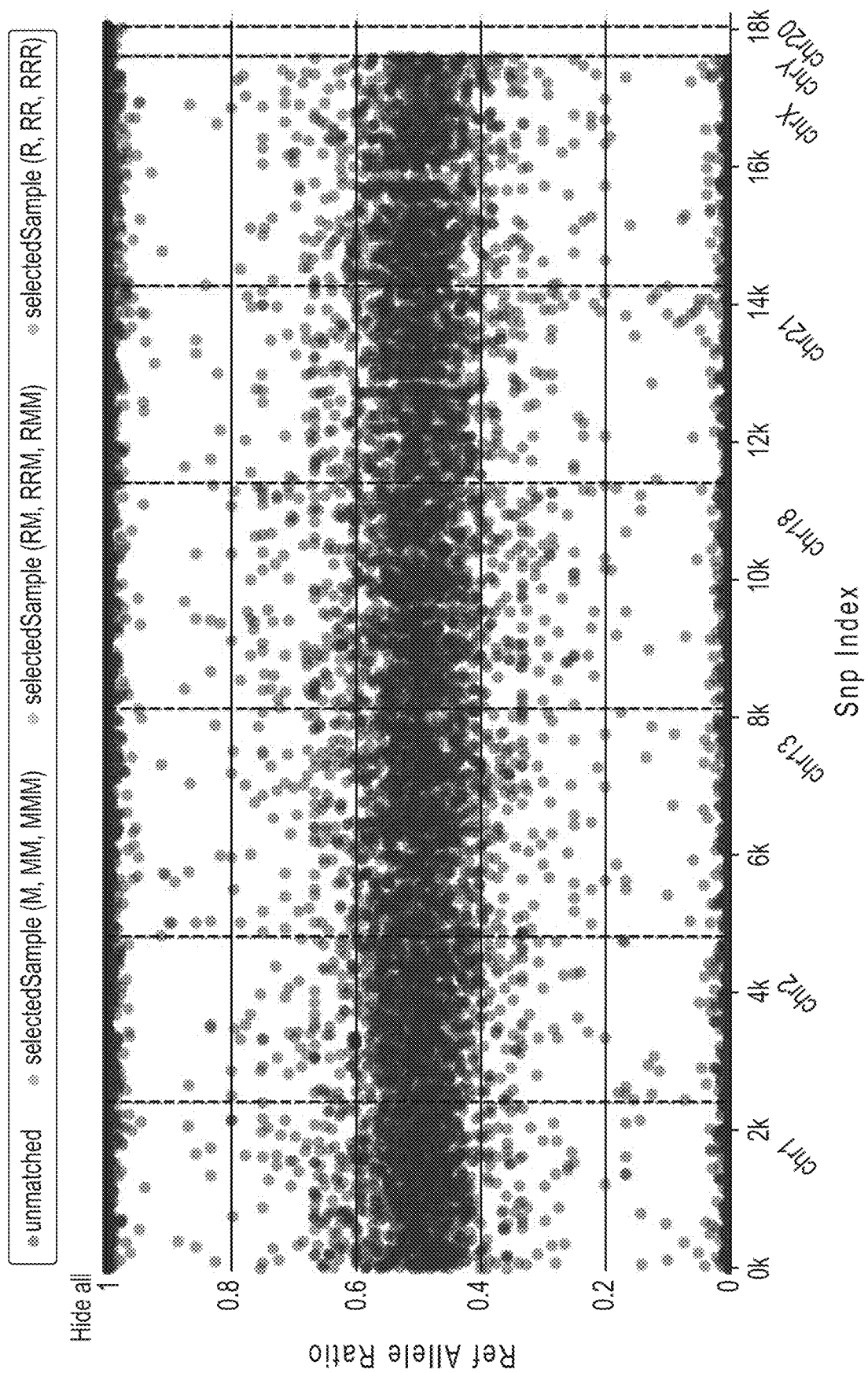
FIG. 37. Graph of reference counts (counts of one allele, such as the "A" allele) divided by total counts for that locus for a single blastocyst cell.

The primer design methods of the invention were also used to generate a library composed of three primers per target locus for 19,488 different target loci. Examples 15, 18, and 19 describe the use of this library. During the PCR amplification and sequencing of a genomic sample, 99.4-99.7% of the sequencing reads mapped to the genome, of those, 99.99% of the reads mapped to target loci. For plasma samples with 10 million sequencing reads, typically at least 19,350 of the 19,488 target loci (99.3%) were amplified and sequenced. For another experiment, the percent of the amplified products that were primer dimers was 1.62%, the median depth of read per target that was amplified was 30× coverage; the percent of the amplified products that were target amplicons was 98.15%; the number of target loci that were not amplified (failed assay count) was 736; the percent of target loci that were not amplified (failed assay percentage) was 0.56%; the percent of target loci that were amplified was 99.44%; and the total number of reads was 6,476,975. For this 19,488-plex library, FIG. 34 is a table of the percentage of reads that map to target loci for genomic DNA samples and for samples of a single cell from a cell line for both mother and child samples using this primer library. There was variability in the single cell data which may have resulted from some dead cells being selected, which may have had most of the DNA leaked out. FIG. 35 is an overlay of depth of read for genomic and a single cell sample for different SNPs. FIG. 36 is a table of the percentage of reads that map to target loci for blastoceol fluid and for a single blastocyst cell. The blastoceol fluid produced no mapped reads, possibly due to no DNA being detected. For a single blastocyst, 50-80% of the reads mapped to target loci. FIG. 37 is a graph of reference counts (counts of one allele, such as the "A" allele) divided by total counts for that locus for a single blastocyst cell. For this primer library, the ΔG values for each possible combination of two primers (each possible primer dimer) in the library are all equal to or greater than −3.86 kcal/mol. This −3.86 kcal/mol value was used as a threshold value to select candidate primer that all had a value equal to or greater than (more desirable than) this value from an initial library of candidate primers.

The primer design methods of the invention were used to generate a library for ~28,000 different target loci (such as amplifying 27,744 different loci with 27,744 different primer pairs). For multiplex PCR and sequencing of genomic DNA samples, 99% of the sequencing reads mapped to target loci. The number of different target human loci that were amplified was 23,776.

For an experiment using this library, the percent of the amplified products that were primer dimers was 0.63%, the median depth of read per target that was amplified was 20× coverage, the percent of the amplified products that were target amplicons was 99.33%; the number of target loci that were not amplified (failed assay count) was 3,968; the percent of target loci that were not amplified (failed assay percentage) was 14.29%; the percent of target loci that were amplified was 85.71%; and the total number of reads was 4,456,636. For a single cell from a cell line, between 2 and 8% of the reads mapped to target loci.

The primer design methods of the invention were used to generate a library for ~9,600 different target loci. As described in Example 10, 7.6 million (97%) of reads mapped to the genome, and 6.3 million (80%) of the reads mapped to the targeted SNPs. The average depth of read was 751, and the median depth of read was 396. As described in Example 9, another experiment produced 3.7 million reads mapping to the genome (94%), and of those, 2.9 million reads (74%) mapped to targeted SNPs with an average depth of read of 344 and a median depth of read of 255.

The primer design methods of the invention were used to generate a library for ~2,400 different target loci. As described in Example 12, when four portions were each amplified with ~2,400 primers, 4.5 million reads mapped to targeted SNPs, the average depth of read was 535 and the median depth of read was 412.

If desired, any of the results may be improved by increasing the number of cells or the amount of nucleic acid template used for the analysis or by optimizing the conditions. For example, if results from single cell samples are not as good as desired for a particular application, a sample with more cells or more nucleic acids may be used instead (such as to decrease the percentage of primer dimers, increase the percentage of target amplicons, or increase the percentage of target loci that are amplified). Samples with more nucleic acids have more template molecules for the primers to bind (instead of primers binding each other and forming primer dimers).

These primer libraries or primer pools can be used in any of the PCR methods of the invention. In some embodiments, primers from any of the primer pools are used in combination with a universal primer to amplify the target loci. In some embodiments, multiple rounds of PCR are performed in which each round of PCR uses primers from one of the primer pools and a universal primer. In some embodiments, primers from two of the primer pools are used to amplify the target loci. In some embodiments, multiple rounds of PCR are performed. In some embodiments, primers from pools C and B are used for the first round of PCR and then primers from pools A and C are used for the second of PCR. In some embodiments, primers from pools C and B are used for the first round of PCR and then primers from pools A and B are used for the second of PCR.

In some embodiments, a region that is not specific for a target locus (such as a tag, bar code, or universal binding site) is added to one or more primers of the invention. In various embodiments, the nonspecific region is added to the 5' end of the primer, to the 3' end of the primer, or to an internal region of the primer. In some embodiments, the primers are fragments (such as fragments of at least 10, 20, 30, 40, 50 or more contiguous nucleotides that are less than full-length).

In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers. In some embodiments, the invention provides a library of primers that includes at least 10; 20; 50; 75; 100; 300; 500; 750; 1,000; 2,000; 5,000; 7,500; 10,000; 15,000; 20,000; 25,000; 30,000; 40,000; or 50,000 different primers.

Percent identity in reference to nucleic acid sequences refers to the degree of sequence identity between nucleic acid sequences. Percent identity can be determined in various ways that are within the skill in the art, for instance, using publicly available computer software with the default parameters such as Smith Waterman Alignment (Smith and Waterman J. Mol. Biol. 147:195-7, 1981); "BestFit" (Smith and Waterman, Advances in Applied Mathematics, 482-489, 1981); Basic Local Alignment Search Tool (BLAST, Altschul, S. F., W. Gish, et al., J. Mol. Biol. 215:403-410, 1990; available through the U.S. government's National Center for Biotechnology Information web site at the world wide web at ncbi.nlm.nih.gov), BLAST-2, BLAST-N, WU-BLAST, WU-BLAST-2, ENTREZ (available through the National Center for Biotechnology Information), CLUSTALW, CLUSTAL Omega, or Megalign (DNASTAR, Inc. Madison, Wis.) software. In addition, those skilled in the art can determine appropriate parameters for measuring alignment, including any algorithms needed to achieve maximal alignment over the length of the sequences being compared. In general, the length of comparison will generally be at least 20, 30, 40, 45, 50, or more nucleotides.

In some embodiments, percent identity is calculated by determining the number of matched positions in aligned nucleic acid sequences, dividing the number of matched positions by the total number of aligned nucleotides, and multiplying by 100. A matched position refers to a position in which identical nucleotides occur at the same position in aligned nucleic acid sequences. The percent identity over a particular length is determined by counting the number of matched positions over that length and dividing that number by the length followed by multiplying the resulting value by 100. For example, if (i) a 500-nucleotide nucleic acid target sequence is compared to a subject nucleic acid sequence, (ii) an alignment program presents 200 nucleotides from the target sequence aligned with a region of the subject sequence where the first and last nucleotides of that 200-nucleotide region are matches, and (iii) the number of matches over those 200 aligned nucleotides is 180, then the 500-nucleotide nucleic acid target sequence contains a length of 200 and a sequence identity over that length of 90% (i.e., 180, 200×100=90).

Hybridization conditions resulting in a particular degree of stringency will vary depending upon the nature of the hybridization method and the composition and length of the hybridizing nucleic acid sequences. Generally, the temperature of hybridization and the ionic strength (such as the $Na^+$ concentration) of the hybridization buffer will determine the stringency of hybridization. Calculations regarding hybridization conditions for attaining particular degrees of stringency are discussed in Sambrook et al., (1989) Molecular Cloning, second edition, Cold Spring Harbor Laboratory, Plainview, N.Y. (chapters 9 and 11); Nucleic Acid Hybridization, A Practical Approach, Ed. Hames, B. D. and Higgins, S. J., IRL Press, 1985; Ausubel et al. Current Protocols in Molecular Biology, Wiley, New York 1994; and U.S. Pat. No. 8,357,488, filed May 16, 2008. In some embodiments, very high stringency hybridization conditions includes an overnight incubation at 42° C. in a solution comprising 50% formamide, 5×SSC (750 mM NaCl, 75 mM trisodium citrate), 50 mM sodium phosphate (pH 7.6), 5×Denhardt's solution, 10% dextran sulfate, and 20 µg/ml denatured, sheared salmon sperm DNA, followed by washing the filters in 0.1×SSC at about 65° C. The following is an exemplary set of hybridization conditions and is not limiting:

Very High Stringency (Detects Sequences that Share at Least 90% Identity)
    Hybridization: 5×SSC at 65° C. for 16 hours
    Wash twice: 2×SSC at room temperature for 15 minutes each
    Wash twice: 0.5×SSC at 65° C. for 20 minutes each High Stringency (Detects Sequences that Share at Least 80% Identity)
    Hybridization: 5×-6×SSC at 65° C.-70° C. for 16-20 hours
    Wash twice: 2×SSC at room temperature for 5-20 minutes each
    Wash twice: 1×SSC at 55° C.-70° C. for 30 minutes each Low Stringency (Detects Sequences that Share at Least 50% Identity)
    Hybridization: 6×SSC at room temperature to 55° C. for 16-20 hours
    Wash at least twice: 2×-3×SSC at room temperature to 55° C. for 20-30 minutes each These primers can be used in any of the primer libraries or methods of the invention.

Exemplary Primer Libraries for Detection of Recombination

In some embodiments, primers in the primer library are designed to determine whether or not recombination occurred at one or more known recombination hotspots (such as crossovers between homologous human chromosomes). Knowing what crossovers occurred between chromosomes allows more accurate phased genetic data to be determined for an individual. Recombination hotspots are local regions of chromosomes in which recombination events tend to be concentrated. Often they are flanked by "coldspots," regions of lower than average frequency of recombination. Recombination hotspots tend to share a similar morphology and are approximately 1 to 2 kb in length. The hotspot distribution is positively correlated with GC content and repetitive element distribution. A partially degenerated 13-mer motif CCNCCNTNNCCNC plays a role in some hotspot activity. It has been shown that the zinc finger protein called PRDM9 binds to this motif and initiates recombination at its location. The average distance between the centers of recombination hot spots is reported to be ~80 kb. In some embodiments, the distance between the centers of recombination hot spots ranges between ~3 kb to ~100 kb. Public databases include a large number of known human recombination hotspots, such as the HUMHOT and International HapMap Project databases (see, for example, Nishant et al., "HUMHOT: a database of human meiotic recombination hot spots," Nucleic Acids Research, 34: D25-D28, 2006, Database issue; Mackiewicz et al., "Distribution of Recombination Hotspots in the Human Genome-A Comparison of Computer Simulations with Real Data" PLOS ONE 8 (6): e65272, doi: 10.1371/journal.pone.0065272; and the world wide web at hapmap.ncbi.nlm.nih.gov/downloads/index.html.en, which are each hereby incorporated by reference in its entirety).

In some embodiments, primers in the primer library are clustered at or near recombination hotspots (such as known human recombination hotspots). In some embodiments, the corresponding amplicons are used to determine the sequence within or near a recombination hotspot to determine whether or not recombination occurred at that particular hotspot (such as whether the sequence of the amplicon is the sequence expected if a recombination had occurred or the sequence expected if a recombination had not occurred). In some embodiments, primers are designed to amplify part or all of a recombination hotspot (and optionally sequence flanking a recombination hotspot). In some embodiments, long read sequencing (such as sequencing using the Moleculo Technology developed by Illumina to sequence up to ~10 kb) or paired end sequencing is used to sequence part or all of a recombination hotspot. Knowledge of whether or not a recombination event occurred can be used to determine which haplotype blocks flank the hotspot. If desired, the presence of particular haplotype blocks can be confirmed using primers specific to regions within the haplotype blocks. In some embodiments, it is assumed there are no crossovers between known recombination hotspots. In some embodiments, primers in the primer library are clustered at or near the ends of chromosomes. For example, such primers can be used to determine whether or not a particular arm or section at the end of a chromosome is present. In some embodiments, primers in the primer library are clustered at or near recombination hotspots and at or near the ends of chromosomes.

In some embodiments, the primer library includes one or more primers (such as at least 5; 10; 50; 100; 200; 500; 750; 1,000; 2,000; 5,000; 7,500; 10,000; 20,000; 25,000; 30,000; 40,000; or 50,000 different primers or different primer pairs) that are specific for a recombination hotspot (such as a known human recombination hotspot) and/or are specific for a region near a recombination hotspot (such as within 10, 8, 5, 3, 2, 1, or 0.5 kb of the 5' or 3' end of a recombination hotspot). In some embodiments, at least 1, 5, 10, 20, 40, 60, 80, 100, or 150 different primer (or primer pairs) are specific for the same recombination hotspot, or are specific for the same recombination hotspot or a region near the recombination hotspot. In some embodiments, at least 1, 5, 10, 20, 40, 60, 80, 100, or 150 different primer (or primer pairs) are specific for a region between recombination hotspots (such as a region unlikely to have undergone recombination); these primers can be used to confirm the presence of haplotype blocks (such as those that would be expected depending on whether or not recombination has occurred). In some embodiments, at least 10, 20, 30, 40, 50, 60, 70, 80, or 90% of the primers in the primer library are specific for a recombination hotspot and/or are specific for a region near a recombination hotspot (such as within 10, 8, 5, 3, 2, 1, or 0.5 kb of the 5' or 3' end of the recombination hotspot). In some embodiments, the primer library is used to determine whether or not recombination has occurred at greater than or equal to 5; 10; 50; 100; 200; 500; 750; 1,000; 2,000; 5,000; 7,500; 10,000; 20,000; 25,000; 30,000; 40,000; or 50,000 different recombination hotspots (such as known human recombination hotspots). In some embodiments, the regions targeted by primers to a recombination hotspot or nearby region are approximately evenly spread out along that portion of the genome. In some embodiments, at least 1, 5, 10, 20, 40, 60, 80, 100, or 150 different primer (or primer pairs) are specific for the a region at or near the end of a chromosome (such as a region within 20, 10, 5, 1, 0.5, 0.1, 0.01, or 0.001 mb from the end of a chromosome). In some embodiments, at least 10, 20, 30, 40, 50, 60, 70, 80, or 90% of the primers in the primer library are specific for the a region at or near the end of a chromosome (such as a region within 20, 10, 5, 1, 0.5, 0.1, 0.01, or 0.001 mb from the end of a chromosome). In some embodiments, at least 1, 5, 10, 20, 40, 60, 80, 100, or 150 different primer (or primer pairs) are specific for a region within a potential microdeletion in a chromosome. In some embodiments, at least 10, 20, 30, 40, 50, 60, 70, 80, or 90% of the primers in the primer library are specific for a region within a potential microdeletion in a chromosome. In some embodiments, at least 10, 20, 30, 40, 50, 60, 70, 80, or 90% of the primers in the primer library are specific for a recombination hotspot, a region near a recombination hotspot, a region at or near the end of a chromosome, or a region within a potential microdeletion in a chromosome. In some embodiments, the primers have one or more of the properties described herein. Other embodiments are disclosed in U.S. Ser. No. 61/987,407, filed May 1, 2014 and 62/066,514, filed Oct. 21, 2014.

Exemplary Kits

In one aspect, the invention features a kit, such as a kit for amplifying target loci in a nucleic acid sample for detecting deletions and/or duplications of chromosome segments or entire chromosomes using any of the methods described herein). In some embodiments, the kit can include any of the primer libraries of the invention. In an embodiment, the kit comprises a plurality of inner forward primers and optionally a plurality of inner reverse primers, and optionally outer forward primers and outer reverse primers, where each of the primers is designed to hybridize to the region of DNA immediately upstream and/or downstream from one of the target sites (e.g., polymorphic sites) on the target chromosome(s) or chromosome segment(s), and optionally additional chromosomes or chromosome segments. In some embodiments, the kit includes instructions for using the primer library to amplify the target loci, such as for detecting one or more deletions and/or duplications of one or more chromosome segments or entire chromosomes using any of the methods described herein.

In certain embodiments, kits of the invention provide primer pairs for detecting chromosomal aneuploidy and CNV determination, such as primer pairs for massively multiplex reactions for detecting chromosomal aneuploidy such as CNV (CoNVERGe) (Copy Number Variant Events Revealed Genotypically) and/or SNVs. In these embodiments, the kits can include between at least 100, 200, 250, 300, 500, 1000, 2000, 2500, 3000, 5000, 10,000, 20,000, 25,000, 28,000, 50,000, or 75,000 and at most 200, 250, 300, 500, 1000, 2000, 2500, 3000, 5000, 10,000, 20,000, 25,000, 28,000, 50,000, 75,000, or 100,000 primer pairs that are shipped together. The primer pairs can be contained in a single vessel, such as a single tube or box, or multiple tubes or boxes. In certain embodiments, the primer pairs are pre-qualified by a commercial provider and sold together, and in other embodiments, a customer selects custom gene targets and/or primers and a commercial provider makes and ships the primer pool to the customer neither in one tube or a plurality of tubes. In certain exemplary embodiments, the kits include primers for detecting both CNVs and SNVs, especially CNVs and SNVs known to be correlated to at least one type of cancer.

Kits for circulating DNA detection according to some embodiments of the present invention, include standards and/or controls for circulating DNA detection. For example, in certain embodiments, the standards and/or controls are sold and optionally shipped and packaged together with primers used to perform the amplification reactions provided herein, such as primers for performing CoNVERGe. In certain embodiments, the controls include polynucleotides such as DNA, including isolated genomic DNA that exhibits one or more chromosomal aneuploidies such as CNV and/or includes one or more SNVs. In certain embodiments, the standards and/or controls are called PlasmArt standards and include polynucleotides having sequence identity to regions of the genome known to exhibit CNV, especially in certain inherited diseases, and in certain disease states such as cancer, as well as a size distribution that reflects that of cfDNA fragments naturally found in plasma. Exemplary methods for making PlasmArt standards are provided in the examples herein. In general, genomic DNA from a source known to include a chromosomal aneuoploidy is isolated, fragmented, purified and size selected.

Accordingly, artificial cfDNA polynucleotide standards and/or controls can be made by spiking isolated polynucleotide samples prepared as summarized above, into DNA samples known not to exhibit a chromosomal aneuploidy and/or SNVs, at concentrations similar to those observed for cfDNA in vivo, such as between, for example, 0.01% and 20%, 0.1 and 15%, or 0.4 and 10% of DNA in that fluid. These standards/controls can be used as controls for assay design, characterization, development, and/or validation, and as quality control standards during testing, such as cancer testing performed in a CLIA lab and/or as standards included in research use only or diagnostic test kits.

Exemplary Amplicons

In one aspect, the invention provides a composition comprising at least 100 different amplicons (e.g., at least 300, 500, 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using at least 100 different primers or primer pairs (e.g., at least 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition includes at least 1,000 different amplicons in solution in one reaction volume; wherein the amplicons are produced from the simultaneous PCR amplification of at least 1,000 different target human loci using at least 1,000 different primers in one reaction volume; wherein (i) less than 20% of the amplicons are primer dimers, and (ii) at least 80% of the amplicons comprise one of the target human loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof.

In some embodiments, a large percentage or substantially all of the primers used for the multiplex PCR method are consumed during the PCR reaction or are removed from the reaction volume after the PCR amplification. In some embodiments, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until all or substantially all of the primers are consumed. If desired, a higher percentage of the primers can be consumed by decreasing the initial primer concentration and/or increasing the number of PCR cycles that are performed. In some embodiments, at least 80, 90, 95, 96, 97, 98, 99, or 100% of the nucleic acids in the composition are amplicons (instead of unextended dimers).

In one aspect, the invention provides a composition comprising at least 100 different primers or primer pairs (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical primers or primer pairs) and at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) in solution in one reaction volume. In some embodiments, the amplicons are produced from the simultaneous PCR amplification of at least 100 different target loci (e.g., at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical target loci) using the primers or primer pairs in one reaction volume. In some embodiments, (i) less than 60% of the amplified products are primer dimers and at least 40% of the amplified products are target amplicons, (ii) less than 40% of the amplified products are primer dimers and at least 60% of the amplified products are target amplicons, (iii) less than 20% of the amplified products are primer dimers and at least 80% of the amplified products are target amplicons, (iv) less than 10% of the amplified products are primer dimers and at least 90% of the amplified products are target amplicons, or (v) less than 5% of the amplified products are primer dimers and at least 95% of the amplified products are target amplicons. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 50, 25, 15, 10, or 5 nucleotides. In some embodiments, the range of the length of the target amplicons is between 5 to 50 nucleotides, such as 5 to 25 nucleotides, 5 to 15 nucleotides, or 5 to 10 nucleotides, inclusive. In some embodiments, the composition comprising at least 1,000 different primers and at least 1,000 different amplicons in solution in one reaction volume; wherein the amplicons are produced from the simultaneous PCR amplification of at least 1,000 different target human loci with the primers in one reaction volume; wherein (i) less than 20% of the amplicons are primer dimers, and (ii) at least 80% of the amplicons comprise one of the target loci and are between 50 and 100 nucleotides in length, inclusive. In some embodiments, the composition consists essentially of, or consists of one or more of the following: amplicons, primers (such as any of the primers disclosed herein), free nucleotide(s), non-human or non-naturally occurring enzyme(s), buffer(s), or any combination thereof.

In some embodiments, the amplification of different target loci is substantially uniform. In some embodiments, target loci (such as nonpolymorphic target loci or polymorphic target loci that are amplified regardless of what allele is present at the polymorphic site) that were present in the same amount (or substantially the same amount) in the initial unamplified sample are also present in substantially the same amount in the PCR-amplified products. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different targets, the target loci that is amplified the most out of these targets (which can be all of the targets or a subset of the targets for a library) is amplified less than 2,000; 1,500; 1,000; 500, 400, 300, 200, 100%, 50, 20, 10, 5, or 2% more than the target loci that is amplified the least out of these targets. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons, the target amplicon in greatest abundance out of these target amplicons (which can be all of the target amplicons or a subset of the target amplicons produced by a library) is present in an amount that is less than 2,000; 1,500; 1,000; 500, 400, 300, 200, 100%, 50, 20, 10, 5, or 2% more than the target amplicon in least abundance out of these target amplicons. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target amplicons are present in an amount that is at least 5, 10, 15, 20, 40, 50, 60, 70, 80, or 90% of the amount of the target amplicon in greatest abundance. In some embodiments, for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different amplicons that are produced by multiplex PCR and then sequenced, at least 80, 90, 95, 96, 97, 98, 99, or 99.5% of the target amplicons produce a number of sequencing reads within 20, 30, 50, or 80% above or below the mean number of sequences for target amplicons. If desired, the uniformity can be increased by using primers with more similar primer lengths, target amplicon lengths, GC contents, melting temperatures, or any combination thereof. In some embodiments, the uniformity can be increased by using TMAC in the reaction volume during amplification. In some embodiments, having most or all the primers consumed in the PCR reaction increases the uniformity of amplification.

If desired, the uniformity in DOR can be measured using standard methods such as depth of read slope (DOR slope), normalized median depth of read (nmDOR), or breadth of read (BOR). DOR slope represents the slope of the line in the linear portion of a list of loci sorted in descending DOR order. Closer to zero is better, as it represents a flat line. In some embodiments, the uniformity in DOR can be measured using the Percent of reads in the $90^{th}$-$95^{th}$ Percentile. For this measurement, the loci are sorted in descending DOR order. In the ideal DOR distribution, the $90^{th}$-$95^{th}$ percentile should contain 5% of reads. The reads of all loci between the $90^{th}$ Percentile and $95^{th}$ percentile are counted and divided by the total reads for all loci. In one experiment, the DOR slope versus percent of reads in the $90^{th}$-$95^{th}$ percentile for all samples had an $R^2$=0.81.

In some embodiments, the magnitude of the DOR slope is less than 0.005, 0.001, 0.0005, 0.0001, 0.00005, 0.00001, 0.000005, or 0.000001. In some embodiments, the magnitude of the DOR slope is between 0 and 0.005, such as 0.000001 to 0.005, such as between 0.000005 to 0.00001, 0.00001 to 0.00005, 0.00005 to 0.0001, 0.0001 to 0.0005, 0.0005 to 0.001, or 0.001 to 0.005, inclusive. In some embodiments, the percent of reads in the $90^{th}$-$95^{th}$ percentile is between 0.2 and 9%, such as between 1 to 8%, 2 to 7%, 0.2 to 1.0%, 1 to 2%, 2 to 3%, 2 to 4%, 3 to 4%, 4 to 5%, 5 to 6%, or 6 to 8%, or 7 to 9& inclusive. In some embodiments, the invention features a composition comprising at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the 90th-95th percentile in any of these ranges. In some embodiments, the amplification method produces at least 100 different amplicons (e.g., at least 300, 500; 750; 1,000; 2,000; 5,000; 7,500; 10,000; 15,000; 19,000; 20,000; 25,000; 27,000; 28,000; 30,000; 40,000; 50,000; 75,000; or 100,000 non-identical amplicons) with the magnitude of the DOR slope in any of these ranges or with a percent of reads in the 90th-95th percentile in any of these ranges.

Exemplary Multiplex PCR Methods

In one aspect, the invention features methods of amplifying target loci in a nucleic acid sample that involve (i) contacting the nucleic acid sample with a library of primers that simultaneously hybridize to least 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; and (ii) subjecting the reaction mixture to primer extension reaction conditions (such as PCR conditions) to produce amplified products that include target amplicons. In some embodiments, the method also includes determining the presence or absence of at least one target amplicon (such as at least 50, 60, 70, 80, 90, 95, 96, 97, 98, 99, or 99.5% of the target amplicons). In some embodiments, the method also includes determining the sequence of at least one target amplicon (such as at least 50, 60, 70, 80, 90, 95, 96, 97, 98, 99, or 99.5% of the target amplicons). In some embodiments, at least 50, 60, 70, 80, 90, 95, 96, 97, 98, 99, or 99.5% of the target loci are amplified. In some embodiments, at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci are amplified at least 5, 10, 20, 40, 50, 60, 80, 100, 120, 150, 200, 300, or 400-fold. In some embodiments, at least 50, 60, 70, 80, 90, 95, 96, 97, 98, 99, 99.5, or 100% of the target loci are amplified at least 5, 10, 20, 40, 50, 60, 80, 100, 120, 150, 200, 300, or 400-fold. In various embodiments, less than 60, 50, 40, 30, 20, 10, 5, 4, 3, 2, 1, 0.5, 0.25, 0.1, or 0.05% of the amplified products are primer dimers. In some embodiments, the method involves multiplex PCR and sequencing (such as high throughput sequencing).

In various embodiments, long annealing times and/or low primer concentrations are used. In various embodiments, the length of the annealing step is greater than 3, 5, 8, 10, 15, 20, 30, 45, 60, 75, 90, 120, 150, or 180 minutes. In various embodiments, the length of the annealing step (per PCR cycle) is between 5 and 180 minutes, such as 5 to 60, 10 to 60, 5 to 30, or 10 to 30 minutes, inclusive. In various embodiments, the length of the annealing step is greater than 5 minutes (such greater than 10, or 15 minutes), and the concentration of each primer is less than 20 nM. In various embodiments, the length of the annealing step is greater than 5 minutes (such greater than 10, or 15 minutes), and the concentration of each primer is between 1 to 20 nM, or 1 to 10 nM, inclusive. In various embodiments, the length of the annealing step is greater than 20 minutes (such as greater than 30, 45, 60, or 90 minutes), and the concentration of each primer is less than 1 nM.

At high level of multiplexing, the solution may become viscous due to the large amount of primers in solution. If the solution is too viscous, one can reduce the primer concentration to an amount that is still sufficient for the primers to bind the template DNA. In various embodiments, less than 60,000 different primers are used and the concentration of each primer is less than 20 nM, such as less than 10 nM or between 1 and 10 nM, inclusive. In various embodiments, more than 60,000 different primers (such as between 60,000 and 120,000 different primers) are used and the concentration of each primer is less than 10 nM, such as less than 5 nM or between 1 and 10 nM, inclusive.

It was discovered that the annealing temperature can optionally be higher than the melting temperatures of some or all of the primers (in contrast to other methods that use an annealing temperature below the melting temperatures of the primers) (Example 25). The melting temperature ($T_m$) is the temperature at which one-half (50%) of a DNA duplex of an oligonucleotide (such as a primer) and its perfect complement dissociates and becomes single strand DNA. The annealing temperature ($T_A$) is the temperature one runs the PCR protocol at. For prior methods, it is usually 5 C below the lowest $T_m$ of the primers used, thus close to all possible duplexes are formed (such that essentially all the primer molecules bind the template nucleic acid). While this is highly efficient, at lower temperatures there are more unspecific reactions bound to occur. One consequence of having too low a $T_A$ is that primers may anneal to sequences other than the true target, as internal single-base mismatches or partial annealing may be tolerated. In some embodiments of the present inventions, the $T_A$ is higher than ($T_m$), where at a given moment only a small fraction of the targets have a primer annealed (such as only ~1-5%). If these get extended, they are removed from the equilibrium of annealing and dissociating primers and target (as extension increases $T_m$ quickly to above 70 C), and a new ~1-5% of targets has primers. Thus, by giving the reaction long time for annealing, one can get ~100% of the targets copied per cycle. Thus, the most stable molecule pairs (those with perfect DNA pairing between the primer and the template DNA) are preferentially extended to produce the correct target amplicons. For example, the same experiment was performed with 57° C. as the annealing temperature and with 63° C. as the annealing temperature with primers that had a melting temperature below 63° C. When the annealing temperature was 57° C., the percent of mapped reads for the amplified PCR products was as low as 50% (with ~50% of the amplified products being primer-dimer). When the annealing temperature was 63° C., the percentage of amplified products that were primer dimer dropped to ~2%.

In various embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In various embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers. In some embodiments, the annealing temperature is at least 1, 2, 3, 4, 5, 6, 7, 8, 9, 10, 11, 12, 13, or 15° C. greater than the highest melting temperature (such as the empirically measured or calculated $T_m$) of the primers, and the length of the annealing step (per PCR cycle) is greater than 1, 3, 5, 8, 10, 15, 20, 30, 45, 60, 75, 90, 120, 150, or 180 minutes In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the highest melting temperature (such as the empirically measured or calculated $T_m$) of the primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is at least 1, 2, 3, 4, 5, 6, 7, 8, 9, 10, 11, 12, 13, or 15° C. greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is greater than 1, 3, 5, 8, 10, 15, 20, 30, 45, 60, 75, 90, 120, 150, or 180 minutes.

In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers. In some embodiments, the annealing temperature is between 1 and 15° C. (such as between 1 to 10, 1 to 5, 1 to 3, 3 to 5, 5 to 10, 5 to 8, 8 to 10, 10 to 12, or 12 to 15° C., inclusive) greater than the average melting temperature (such as the empirically measured or calculated $T_m$) of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; 100,000; or all of the non-identical primers, and the length of the annealing step (per PCR cycle) is between 5 and 180 minutes, such as 5 to 60, 10 to 60, 5 to 30, or 10 to 30 minutes, inclusive.

In some embodiments, the annealing temperature is between 50 to 70° C., such as between 55 to 60, 60 to 65, or 65 to 70° C., inclusive. In some embodiments, the annealing temperature is between 50 to 70° C., such as between 55 to 60, 60 to 65, or 65 to 70° C., inclusive, and either (i) the length of the annealing step (per PCR cycle) is greater than 3, 5, 8, 10, 15, 20, 30, 45, 60, 75, 90, 120, 150, or 180 minutes or (ii) the length of the annealing step (per PCR cycle) is between 5 and 180 minutes, such as 5 to 60, 10 to 60, 5 to 30, or 10 to 30 minutes, inclusive.

In some embodiments, one or more of the following conditions are used for empirical measurement of $T_m$ or are assumed for calculation of $T_m$: temperature: of 60.0° C., primer concentration of 100 nM, and/or salt concentration of 100 mM. In some embodiments, other conditions are used, such as the conditions that will be used for multiplex PCR with the library. In some embodiments, 100 mM KCl, 50 mM $(NH_4)_2SO_4$, 3 mM $MgCl_2$, 7.5 nM of each primer, and 50 mM TMAC, at pH 8.1 is used. In some embodiments, the $T_m$ is calculated using the Primer3 program (libprimer3 release 2.2.3) using the built-in SantaLucia parameters (the world wide web at primer3.sourceforge.net, which is hereby incorporated by reference in its entirety). For example, the $T_m$ values may be calculated using the method in Example 25. In some embodiments, the calculated melting temperature for a primer is the temperature at which half of the primers molecules are expected to be annealed. As discussed above, even at a temperature higher than the calculated melting temperature, a percentage of primers will be annealed, and therefore PCR extension is possible. In some embodiments, the empirically measured $T_m$ (the actual $T_m$) is determined by using a thermostated cell in a UV spectrophotometer. In some embodiments, temperature is plotted vs. absorbance, generating an S-shaped curve with two plateaus. The absorbance reading halfway between the plateaus corresponds to $T_m$.

In some embodiments, the absorbance at 260 nm is measured as a function of temperature on an ultrospec 2100 pr UV/visible spectrophotometer (Amershambiosciences) (see, e.g., Takiya et al., "An empirical approach for thermal stability (Tm) prediction of PNA/DNA duplexes," Nucleic Acids Symp Ser (Oxf); (48): 131-2, 2004, which is hereby incorporated by reference in its entirety). In some embodiments, absorbance at 260 nm is measured by decreasing the temperature in steps of 2° C. per minute from 95 to 20° C. In some embodiments, a primer and its perfect complement (such as 2 uM of each paired oligomer) are mixed and then annealing is performed by heating the sample to 95° C., keeping it there for 5 minutes, followed by cooling to room temperature during 30 minutes, and keeping the samples at 95° C. for at least 60 minutes. In some embodiments, melting temperature is determined by analyzing the data using SWIFT Tm software. In some embodiments of any of the methods of the invention, the method includes empirically measuring or calculating (such as calculating with a computer) the melting temperature for at least 50, 80, 90, 92, 94, 96, 98, 99, or 100% of the primers in the library either before or after the primers are used for PCR amplification of target loci.

In some embodiments, the library comprises a microarray. In some embodiments, the library does not comprise a microarray.

In some embodiments, most or all of the primers are extended to form amplified products. Having all the primers consumed in the PCR reaction increases the uniformity of amplification of the different target loci since the same or similar number of primer molecules are converted to target amplicons for each target loci. In some embodiment, at least 80, 90, 92, 94, 96, 98, 99, or 100% of the primer molecules are extended to form amplified products. In some embodiments, for at least 80, 90, 92, 94, 96, 98, 99, or 100% of target loci, at least 80, 90, 92, 94, 96, 98, 99, or 100% of the primer molecules to that target loci are extended to form amplified products. In some embodiments, multiple cycles are performed until this percentage of the primers are consumed. In some embodiments, multiple cycles are performed until all or substantially all of the primers are consumed. If desired, a higher percentage of the primers can be consumed by decreasing the initial primer concentration and/or increasing the number of PCR cycles that are performed.

In some embodiments, the PCR methods may be performed with microliter reaction volumes, for which it can be harder to achieve specific PCR amplification (due to the lower local concentration of the template nucleic acids) compared to nanoliter or picoliter reaction volumes used in microfluidics applications. In some embodiments, the reaction volume is between 1 and 60 uL, such as between 5 and 50 uL, 10 and 50 uL, 10 and 20 uL, 20 and 30 uL, 30 and 40 uL, or 40 to 50 uL, inclusive.

In an embodiment, a method disclosed herein uses highly efficient highly multiplexed targeted PCR to amplify DNA followed by high throughput sequencing to determine the allele frequencies at each target locus. The ability to multiplex more than about 50 or 100 PCR primers in one reaction volume in a way that most of the resulting sequence reads map to targeted loci is novel and non-obvious. One technique that allows highly multiplexed targeted PCR to perform in a highly efficient manner involves designing primers that are unlikely to hybridize with one another. The PCR probes, typically referred to as primers, are selected by creating a thermodynamic model of potentially adverse interactions between at least 300; at least 500; at least 750; at least 1,000; at least 2,000; at least 5,000; at least 7,500; at least 10,000; at least 20,000; at least 25,000; at least 30,000; at least 40,000; at least 50,000; at least 75,000; or at least 100,000 potential primer pairs, or unintended interactions between primers and sample DNA, and then using the model to eliminate designs that are incompatible with other the designs in the pool. Another technique that allows highly multiplexed targeted PCR to perform in a highly efficient manner is using a partial or full nesting approach to the targeted PCR. Using one or a combination of these approaches allows multiplexing of at least 300, at least 800, at least 1,200, at least 4,000 or at least 10,000 primers in a single pool with the resulting amplified DNA comprising a majority of DNA molecules that, when sequenced, will map to targeted loci. Using one or a combination of these approaches allows multiplexing of a large number of primers in a single pool with the resulting amplified DNA comprising greater than 50%, greater than 60%, greater than 67%, greater than 80%, greater than 90%, greater than 95%, greater than 96%, greater than 97%, greater than 98%, greater than 99%, or greater than 99.5% DNA molecules that map to targeted loci.

In some embodiments the detection of the target genetic material may be done in a multiplexed fashion. The number of genetic target sequences that may be run in parallel can range from one to ten, ten to one hundred, one hundred to one thousand, one thousand to ten thousand, ten thousand to one hundred thousand, one hundred thousand to one million, or one million to ten million. Prior attempts to multiplex more than 100 primers per pool have resulted in significant problems with unwanted side reactions such as primer-dimer formation.

Targeted PCR

In some embodiments, PCR can be used to target specific locations of the genome. In plasma samples, the original DNA is highly fragmented (typically less than 500 bp, with an average length less than 200 bp). In PCR, both forward and reverse primers anneal to the same fragment to enable amplification. Therefore, if the fragments are short, the PCR assays must amplify relatively short regions as well. Like MIPS, if the polymorphic positions are too close the polymerase binding site, it could result in biases in the amplification from different alleles. Currently, PCR primers that target polymorphic regions, such as those containing SNPs, are typically designed such that the 3' end of the primer will hybridize to the base immediately adjacent to the polymorphic base or bases. In an embodiment of the present disclosure, the 3' ends of both the forward and reverse PCR primers are designed to hybridize to bases that are one or a few positions away from the variant positions (polymorphic sites) of the targeted allele. The number of bases between the polymorphic site (SNP or otherwise) and the base to which the 3' end of the primer is designed to hybridize may be one base, it may be two bases, it may be three bases, it may be four bases, it may be five bases, it may be six bases, it may be seven to ten bases, it may be eleven to fifteen bases, or it may be sixteen to twenty bases. The forward and reverse primers may be designed to hybridize a different number of bases away from the polymorphic site.

PCR assay can be generated in large numbers, however, the interactions between different PCR assays makes it difficult to multiplex them beyond about one hundred assays. Various complex molecular approaches can be used to increase the level of multiplexing, but it may still be limited to fewer than 100, perhaps 200, or possibly 500 assays per reaction. Samples with large quantities of DNA can be split among multiple sub-reactions and then recombined before sequencing. For samples where either the overall sample or some subpopulation of DNA molecules is limited, splitting the sample would introduce statistical noise. In an embodiment, a small or limited quantity of DNA may refer to an amount below 10 pg, between 10 and 100 pg, between 100 pg and 1 ng, between 1 and 10 ng, or between 10 and 100 ng. Note that while this method is particularly useful on small amounts of DNA where other methods that involve splitting into multiple pools can cause significant problems related to introduced stochastic noise, this method still provides the benefit of minimizing bias when it is run on samples of any quantity of DNA. In these situations a universal pre-amplification step may be used to increase the overall sample quantity. Ideally, this pre-amplification step should not appreciably alter the allelic distributions.

In an embodiment, a method of the present disclosure can generate PCR products that are specific to a large number of targeted loci, specifically 1,000 to 5,000 loci, 5,000 to 10,000 loci or more than 10,000 loci, for genotyping by sequencing or some other genotyping method, from limited samples such as single cells or DNA from body fluids. Currently, performing multiplex PCR reactions of more than 5 to 10 targets presents a major challenge and is often hindered by primer side products, such as primer dimers, and other artifacts. When detecting target sequences using microarrays with hybridization probes, primer dimers and other artifacts may be ignored, as these are not detected. However, when using sequencing as a method of detection, the vast majority of the sequencing reads would sequence such artifacts and not the desired target sequences in a sample. Methods described in the prior art used to multiplex more than 50 or 100 reactions in one reaction volume followed by sequencing will typically result in more than 20%, and often more than 50%, in many cases more than 80% and in some cases more than 90% off-target sequence reads.

In general, to perform targeted sequencing of multiple (n) targets of a sample (greater than 50, greater than 100, greater than 500, or greater than 1,000), one can split the sample into a number of parallel reactions that amplify one individual target. This has been performed in PCR multiwell plates or can be done in commercial platforms such as the FLUIDIGM ACCESS ARRAY (48 reactions per sample in microfluidic chips) or DROPLET PCR by RAIN DANCE TECHNOLOGY (100 s to a few thousands of targets). Unfortunately, these split-and-pool methods are problematic for samples with a limited amount of DNA, as there is often not enough copies of the genome to ensure that there is one copy of each region of the genome in each well. This is an especially severe problem when polymorphic loci are targeted, and the relative proportions of the alleles at the polymorphic loci are needed, as the stochastic noise introduced by the splitting and pooling will cause very poorly accurate measurements of the proportions of the alleles that were present in the original sample of DNA. Described here is a method to effectively and efficiently amplify many PCR reactions that is applicable to cases where only a limited amount of DNA is available. In an embodiment, the method may be applied for analysis of single cells, body fluids, mixtures of DNA such as the free floating DNA found in maternal plasma, biopsies, environmental and/or forensic samples.

In an embodiment, the targeted sequencing may involve one, a plurality, or all of the following steps. a) Generate and amplify a library with adaptor sequences on both ends of DNA fragments. b) Divide into multiple reactions after library amplification. c) Generate and optionally amplify a library with adaptor sequences on both ends of DNA fragments. d) Perform 1000- to 10,000-plex amplification of selected targets using one target specific "Forward" primer per target and one tag specific primer. e) Perform a second amplification from this product using "Reverse" target specific primers and one (or more) primer specific to a universal tag that was introduced as part of the target specific forward primers in the first round. f) Perform a 1000-plex preamplification of selected target for a limited number of cycles. g) Divide the product into multiple aliquots and amplify subpools of targets in individual reactions (for example, 50 to 500-plex, though this can be used all the way down to singleplex). h) Pool products of parallel subpools reactions. i) During these amplifications primers may carry sequencing compatible tags (partial or full length) such that the products can be sequenced.

Highly Multiplexed PCR

Disclosed herein are methods that permit the targeted amplification of over a hundred to tens of thousands of target sequences (e.g., SNP loci) from a nucleic acid sample such as genomic DNA obtained from plasma. The amplified sample may be relatively free of primer dimer products and have low allelic bias at target loci. If during or after amplification the products are appended with sequencing compatible adaptors, analysis of these products can be performed by sequencing.

Performing a highly multiplexed PCR amplification using methods known in the art results in the generation of primer dimer products that are in excess of the desired amplification products and not suitable for sequencing. These can be reduced empirically by eliminating primers that form these products, or by performing in silico selection of primers. However, the larger the number of assays, the more difficult this problem becomes.

One solution is to split the 5000-plex reaction into several lower-plexed amplifications, e.g. one hundred 50-plex or fifty 100-plex reactions, or to use microfluidics or even to split the sample into individual PCR reactions. However, if the sample DNA is limited, such as in non-invasive prenatal diagnostics from pregnancy plasma, dividing the sample between multiple reactions should be avoided as this will result in bottlenecking.

Described herein are methods to first globally amplify the plasma DNA of a sample and then divide the sample up into multiple multiplexed target enrichment reactions with more moderate numbers of target sequences per reaction. In an embodiment, a method of the present disclosure can be used for preferentially enriching a DNA mixture at a plurality of loci, the method comprising one or more of the following steps: generating and amplifying a library from a mixture of DNA where the molecules in the library have adaptor sequences ligated on both ends of the DNA fragments, dividing the amplified library into multiple reactions, performing a first round of multiplex amplification of selected targets using one target specific "forward" primer per target and one or a plurality of adaptor specific universal "reverse" primers. In an embodiment, a method of the present disclosure further includes performing a second amplification using "reverse" target specific primers and one or a plurality of primers specific to a universal tag that was introduced as part of the target specific forward primers in the first round. In an embodiment, the method may involve a fully nested, hemi-nested, semi-nested, one sided fully nested, one sided hemi-nested, or one sided semi-nested PCR approach. In an embodiment, a method of the present disclosure is used for preferentially enriching a DNA mixture at a plurality of loci, the method comprising performing a multiplex preamplification of selected targets for a limited number of cycles, dividing the product into multiple aliquots and amplifying subpools of targets in individual reactions, and pooling products of parallel subpools reactions. Note that this approach could be used to perform targeted amplification in a manner that would result in low levels of allelic bias for 50-500 loci, for 500 to 5,000 loci, for 5,000 to 50,000 loci, or even for 50,000 to 500,000 loci. In an embodiment, the primers carry partial or full length sequencing compatible tags.

The workflow may entail (1) extracting DNA such as plasma DNA, (2) preparing fragment library with universal adaptors on both ends of fragments, (3) amplifying the library using universal primers specific to the adaptors, (4) dividing the amplified sample "library" into multiple aliquots, (5) performing multiplex (e.g. about 100-plex, 1,000, or 10,000-plex with one target specific primer per target and a tag-specific primer) amplifications on aliquots, (6) pooling aliquots of one sample, (7) barcoding the sample, (8) mixing the samples and adjusting the concentration, (9) sequencing the sample. The workflow may comprise multiple sub-steps that contain one of the listed steps (e.g. step (2) of preparing the library step could entail three enzymatic steps (blunt ending, dA tailing and adaptor ligation) and three purification steps). Steps of the workflow may be combined, divided up or performed in different order (e.g. bar coding and pooling of samples).

It is important to note that the amplification of a library can be performed in such a way that it is biased to amplify short fragments more efficiently. In this manner it is possible to preferentially amplify shorter sequences, e.g. mononucleosomal DNA fragments as the cell free fetal DNA (of placental origin) found in the circulation of pregnant women. Note that PCR assays can have the tags, for example sequencing tags, (usually a truncated form of 15-25 bases). After multiplexing, PCR multiplexes of a sample are pooled and then the tags are completed (including bar coding) by a tag-specific PCR (could also be done by ligation). Also, the full sequencing tags can be added in the same reaction as the multiplexing. In the first cycles targets may be amplified with the target specific primers, subsequently the tag-specific primers take over to complete the SQ-adaptor sequence. The PCR primers may carry no tags. The sequencing tags may be appended to the amplification products by ligation.

In an embodiment, highly multiplex PCR followed by evaluation of amplified material by clonal sequencing may be used for various applications such as the detection of fetal aneuploidy. Whereas traditional multiplex PCRs evaluate up to fifty loci simultaneously, the approach described herein may be used to enable simultaneous evaluation of more than 50 loci simultaneously, more than 100 loci simultaneously, more than 500 loci simultaneously, more than 1,000 loci simultaneously, more than 5,000 loci simultaneously, more than 10,000 loci simultaneously, more than 50,000 loci simultaneously, and more than 100,000 loci simultaneously. Experiments have shown that up to, including and more than 10,000 distinct loci can be evaluated simultaneously, in a single reaction, with sufficiently good efficiency and specificity to make non-invasive prenatal aneuploidy diagnoses and/or copy number calls with high accuracy. Assays may be combined in a single reaction with the entirety of a sample such as a cfDNA sample isolated from maternal plasma, a fraction thereof, or a further processed derivative of the cfDNA sample. The sample (e.g., cfDNA or derivative) may also be split into multiple parallel multiplex reactions. The optimum sample splitting and multiplex is determined by trading off various performance specifications. Due to the limited amount of material, splitting the sample into multiple fractions can introduce sampling noise, handling time, and increase the possibility of error. Conversely, higher multiplexing can result in greater amounts of spurious amplification and greater inequalities in amplification both of which can reduce test performance.

Two crucial related considerations in the application of the methods described herein are the limited amount of original sample (e.g., plasma) and the number of original molecules in that material from which allele frequency or other measurements are obtained. If the number of original molecules falls below a certain level, random sampling noise becomes significant, and can affect the accuracy of the test. Typically, data of sufficient quality for making non-invasive prenatal aneuploidy diagnoses can be obtained if measurements are made on a sample comprising the equivalent of 500-1000 original molecules per target locus. There are a number of ways of increasing the number of distinct measurements, for example increasing the sample volume. Each manipulation applied to the sample also potentially results in losses of material. It is essential to characterize losses incurred by various manipulations and avoid, or as necessary improve yield of certain manipulations to avoid losses that could degrade performance of the test.

In an embodiment, it is possible to mitigate potential losses in subsequent steps by amplifying all or a fraction of the original sample (e.g., cfDNA sample). Various methods are available to amplify all of the genetic material in a sample, increasing the amount available for downstream procedures. In an embodiment, ligation mediated PCR (LM-PCR) DNA fragments are amplified by PCR after ligation of either one distinct adaptors, two distinct adapters, or many distinct adaptors. In an embodiment, multiple displacement amplification (MDA) phi-29 polymerase is used to amplify all DNA isothermally. In DOP-PCR and variations, random priming is used to amplify the original material DNA. Each method has certain characteristics such as uniformity of amplification across all represented regions of the genome, efficiency of capture and amplification of original DNA, and amplification performance as a function of the length of the fragment.

In an embodiment LM-PCR may be used with a single heteroduplexed adaptor having a 3-prime tyrosine. The heteroduplexed adaptor enables the use of a single adaptor molecule that may be converted to two distinct sequences on 5-prime and 3-prime ends of the original DNA fragment during the first round of PCR. In an embodiment, it is possible to fractionate the amplified library by size separations, or products such as AMPURE, TASS or other similar methods. Prior to ligation, sample DNA may be blunt ended, and then a single adenosine base is added to the 3-prime end. Prior to ligation the DNA may be cleaved using a restriction enzyme or some other cleavage method. During ligation the 3-prime adenosine of the sample fragments and the complementary 3-prime tyrosine overhang of adaptor can enhance ligation efficiency. The extension step of the PCR amplification may be limited from a time standpoint to reduce amplification from fragments longer than about 200 bp, about 300 bp, about 400 bp, about 500 bp or about 1,000 bp. Since longer DNA found in the maternal plasma is nearly exclusively maternal, this may result in the enrichment of fetal DNA by 10-50% and improvement of test performance. A number of reactions were run using conditions as specified by commercially available kits; the resulted in successful ligation of fewer than 10% of sample DNA molecules. A series of optimizations of the reaction conditions for this improved ligation to approximately 70%.

Mini-PCR

The following Mini-PCR method is desirable for samples containing short nucleic acids, digested nucleic acids, or fragmented nucleic acids, such as cfDNA. Traditional PCR assay design results in significant losses of distinct fetal molecules, but losses can be greatly reduced by designing very short PCR assays, termed mini-PCR assays. Fetal cfDNA in maternal serum is highly fragmented and the fragment sizes are distributed in approximately a Gaussian fashion with a mean of 160 bp, a standard deviation of 15 bp, a minimum size of about 100 bp, and a maximum size of about 220 bp. The distribution of fragment start and end positions with respect to the targeted polymorphisms, while not necessarily random, vary widely among individual targets and among all targets collectively and the polymorphic site of one particular target locus may occupy any position from the start to the end among the various fragments originating from that locus. Note that the term mini-PCR may equally well refer to normal PCR with no additional restrictions or limitations.

During PCR, amplification will only occur from template DNA fragments comprising both forward and reverse primer sites. Because fetal cfDNA fragments are short, the likelihood of both primer sites being present the likelihood of a fetal fragment of length L comprising both the forward and reverse primers sites is ratio of the length of the amplicon to the length of the fragment. Under ideal conditions, assays in which the amplicon is 45, 50, 55, 60, 65, or 70 bp will successfully amplify from 72%, 69%, 66%, 63%, 59%, or 56%, respectively, of available template fragment molecules. The amplicon length is the distance between the 5-prime ends of the forward and reverse priming sites. Amplicon length that is shorter than typically used by those known in the art may result in more efficient measurements of the desired polymorphic loci by only requiring short sequence reads. In an embodiment, a substantial fraction of the amplicons should be less than 100 bp, less than 90 bp, less than 80 bp, less than 70 bp, less than 65 bp, less than 60 bp, less than 55 bp, less than 50 bp, or less than 45 bp.

Note that in methods known in the prior art, short assays such as those described herein are usually avoided because they are not required and they impose considerable constraint on primer design by limiting primer length, annealing characteristics, and the distance between the forward and reverse primer.

Also note that there is the potential for biased amplification if the 3-prime end of the either primer is within roughly 1-6 bases of the polymorphic site. This single base difference at the site of initial polymerase binding can result in preferential amplification of one allele, which can alter observed allele frequencies and degrade performance. All of these constraints make it very challenging to identify primers that will amplify a particular locus successfully and furthermore, to design large sets of primers that are compatible in the same multiplex reaction. In an embodiment, the 3' end of the inner forward and reverse primers are designed to hybridize to a region of DNA upstream from the polymorphic site, and separated from the polymorphic site by a small number of bases. Ideally, the number of bases may be between 6 and 10 bases, but may equally well be between 4 and 15 bases, between three and 20 bases, between two and 30 bases, or between 1 and 60 bases, and achieve substantially the same end.

Multiplex PCR may involve a single round of PCR in which all targets are amplified or it may involve one round of PCR followed by one or more rounds of nested PCR or some variant of nested PCR. Nested PCR consists of a subsequent round or rounds of PCR amplification using one or more new primers that bind internally, by at least one base pair, to the primers used in a previous round. Nested PCR reduces the number of spurious amplification targets by amplifying, in subsequent reactions, only those amplification products from the previous one that have the correct internal sequence. Reducing spurious amplification targets improves the number of useful measurements that can be obtained, especially in sequencing. Nested PCR typically entails designing primers completely internal to the previous primer binding sites, necessarily increasing the minimum DNA segment size required for amplification. For samples such as maternal plasma cfDNA, in which the DNA is highly fragmented, the larger assay size reduces the number of distinct cfDNA molecules from which a measurement can be obtained. In an embodiment, to offset this effect, one may use a partial nesting approach where one or both of the second round primers overlap the first binding sites extending internally some number of bases to achieve additional specificity while minimally increasing in the total assay size.

In an embodiment, a multiplex pool of PCR assays are designed to amplify potentially heterozygous SNP or other polymorphic or non-polymorphic loci on one or more chromosomes and these assays are used in a single reaction to amplify DNA. The number of PCR assays may be between 50 and 200 PCR assays, between 200 and 1,000 PCR assays, between 1,000 and 5,000 PCR assays, or between 5,000 and 20,000 PCR assays (50 to 200-plex, 200 to 1,000-plex, 1,000 to 5,000-plex, 5,000 to 20,000-plex, more than 20,000-plex respectively). In an embodiment, a multiplex pool of about 10,000 PCR assays (10,000-plex) are designed to amplify potentially heterozygous SNP loci on chromosomes X, Y, 13, 18, and 21 and 1 or 2 and these assays are used in a single reaction to amplify cfDNA obtained from a material plasma sample, chorion villus samples, amniocentesis samples, single or a small number of cells, other bodily fluids or tissues, cancers, or other genetic matter. The SNP frequencies of each locus may be determined by clonal or some other method of sequencing of the amplicons. Statistical analysis of the allele frequency distributions or ratios of all assays may be used to determine if the sample contains a trisomy of one or more of the chromosomes included in the test. In another embodiment the original cfDNA samples is split into two samples and parallel 5,000-plex assays are performed. In another embodiment the original cfDNA samples is split into n samples and parallel (~10,000/n)-plex assays are performed where n is between 2 and 12, or between 12 and 24, or between 24 and 48, or between 48 and 96. Data is collected and analyzed in a similar manner to that already described. Note that this method is equally well applicable to detecting translocations, deletions, duplications, and other chromosomal abnormalities.

In an embodiment, tails with no homology to the target genome may also be added to the 3-prime or 5-prime end of any of the primers. These tails facilitate subsequent manipulations, procedures, or measurements. In an embodiment, the tail sequence can be the same for the forward and reverse target specific primers. In an embodiment, different tails may be used for the forward and reverse target specific primers. In an embodiment, a plurality of different tails may be used for different loci or sets of loci. Certain tails may be shared among all loci or among subsets of loci. For example, using forward and reverse tails corresponding to forward and reverse sequences required by any of the current sequencing platforms can enable direct sequencing following amplification. In an embodiment, the tails can be used as common priming sites among all amplified targets that can be used to add other useful sequences. In some embodiments, the inner primers may contain a region that is designed to hybridize either upstream or downstream of the targeted locus (e.g., a polymorphic locus). In some embodiments, the primers may contain a molecular barcode. In some embodiments, the primer may contain a universal priming sequence designed to allow PCR amplification.

In an embodiment, a 10,000-plex PCR assay pool is created such that forward and reverse primers have tails corresponding to the required forward and reverse sequences required by a high throughput sequencing instrument such as the HISEQ, GAIIX, or MYSEQ available from ILLUMINA. In addition, included 5-prime to the sequencing tails is an additional sequence that can be used as a priming site in a subsequent PCR to add nucleotide barcode sequences to the amplicons, enabling multiplex sequencing of multiple samples in a single lane of the high throughput sequencing instrument.

In an embodiment, a 10,000-plex PCR assay pool is created such that reverse primers have tails corresponding to the required reverse sequences required by a high throughput sequencing instrument. After amplification with the first 10,000-plex assay, a subsequent PCR amplification may be performed using a another 10,000-plex pool having partly nested forward primers (e.g. 6-bases nested) for all targets and a reverse primer corresponding to the reverse sequencing tail included in the first round. This subsequent round of partly nested amplification with just one target specific primer and a universal primer limits the required size of the assay, reducing sampling noise, but greatly reduces the number of spurious amplicons. The sequencing tags can be added to appended ligation adaptors and/or as part of PCR probes, such that the tag is part of the final amplicon.

Fetal fraction affects performance of the test. There are a number of ways to enrich the fetal fraction of the DNA found in maternal plasma. Fetal fraction can be increased by the previously described LM-PCR method already discussed as well as by a targeted removal of long maternal fragments. In an embodiment, prior to multiplex PCR amplification of the target loci, an additional multiplex PCR reaction may be carried out to selectively remove long and largely maternal fragments corresponding to the loci targeted in the subsequent multiplex PCR. Additional primers are designed to anneal a site a greater distance from the polymorphism than is expected to be present among cell free fetal DNA fragments. These primers may be used in a one cycle multiplex PCR reaction prior to multiplex PCR of the target polymorphic loci. These distal primers are tagged with a molecule or moiety that can allow selective recognition of the tagged pieces of DNA. In an embodiment, these molecules of DNA may be covalently modified with a biotin molecule that allows removal of newly formed double stranded DNA comprising these primers after one cycle of PCR. Double stranded DNA formed during that first round is likely maternal in origin. Removal of the hybrid material may be accomplish by the used of magnetic streptavidin beads. There are other methods of tagging that may work equally well. In an embodiment, size selection methods may be used to enrich the sample for shorter strands of DNA; for example those less than about 800 bp, less than about 500 bp, or less than about 300 bp. Amplification of short fragments can then proceed as usual.

The mini-PCR method described in this disclosure enables highly multiplexed amplification and analysis of hundreds to thousands or even millions of loci in a single reaction, from a single sample. At the same, the detection of the amplified DNA can be multiplexed; tens to hundreds of samples can be multiplexed in one sequencing lane by using barcoding PCR. This multiplexed detection has been successfully tested up to 49-plex, and a much higher degree of multiplexing is possible. In effect, this allows hundreds of samples to be genotyped at thousands of SNPs in a single sequencing run. For these samples, the method allows determination of genotype and heterozygosity rate and simultaneously determination of copy number, both of which may be used for the purpose of aneuploidy detection. This method is particularly useful in detecting aneuploidy of a gestating fetus from the free floating DNA found in maternal plasma. This method may be used as part of a method for sexing a fetus, and/or predicting the paternity of the fetus. It may be used as part of a method for mutation dosage. This method may be used for any amount of DNA or RNA, and the targeted regions may be SNPs, other polymorphic regions, non-polymorphic regions, and combinations thereof.

In some embodiments, ligation mediated universal-PCR amplification of fragmented DNA may be used. The ligation mediated universal-PCR amplification can be used to amplify plasma DNA, which can then be divided into multiple parallel reactions. It may also be used to preferentially amplify short fragments, thereby enriching fetal fraction. In some embodiments the addition of tags to the fragments by ligation can enable detection of shorter fragments, use of shorter target sequence specific portions of the primers and/or annealing at higher temperatures which reduces unspecific reactions.

The methods described herein may be used for a number of purposes where there is a target set of DNA that is mixed with an amount of contaminating DNA. In some embodiments, the target DNA and the contaminating DNA may be from individuals who are genetically related. For example, genetic abnormalities in a fetus (target) may be detected from maternal plasma which contains fetal (target) DNA and also maternal (contaminating) DNA; the abnormalities include whole chromosome abnormalities (e.g. aneuploidy) partial chromosome abnormalities (e.g. deletions, duplications, inversions, and translocations), polynucleotide polymorphisms (e.g. STRs), single nucleotide polymorphisms, and/or other genetic abnormalities or differences. In some embodiments, the target and contaminating DNA may be from the same individual, but where the target and contaminating DNA are different by one or more mutations, for example in the case of cancer. (see e.g. H. Mamon et al. *Preferential Amplification of Apoptotic DNA from Plasma: Potential for Enhancing Detection of Minor DNA Alterations in Circulating DNA*. Clinical Chemistry 54:9 (2008). In some embodiments, the DNA may be found in cell culture (apoptotic) supernatant. In some embodiments, it is possible to induce apoptosis in biological samples (e.g., blood) for subsequent library preparation, amplification and/or sequencing. A number of enabling workflows and protocols to achieve this end are presented elsewhere in this disclosure.

In some embodiments, the target DNA may originate from single cells, from samples of DNA consisting of less than one copy of the target genome, from low amounts of DNA, from DNA from mixed origin (e.g. pregnancy plasma: placental and maternal DNA; cancer patient plasma and tumors: mix between healthy and cancer DNA, transplantation etc), from other body fluids, from cell cultures, from culture supernatants, from forensic samples of DNA, from ancient samples of DNA (e.g. insects trapped in amber), from other samples of DNA, and combinations thereof.

In some embodiments, a short amplicon size may be used. Short amplicon sizes are especially suited for fragmented DNA (see e.g. A. Sikora, et sl. Detection of increased amounts of cell-free fetal DNA with short PCR amplicons. Clin Chem. 2010 January; 56 (1): 136-8.)

The use of short amplicon sizes may result in some significant benefits. Short amplicon sizes may result in optimized amplification efficiency. Short amplicon sizes typically produce shorter products, therefore there is less chance for nonspecific priming. Shorter products can be clustered more densely on sequencing flow cell, as the clusters will be smaller. Note that the methods described herein may work equally well for longer PCR amplicons. Amplicon length may be increased if necessary, for example, when sequencing larger sequence stretches. Experiments with 146-plex targeted amplification with assays of 100 bp to 200 bp length as first step in a nested-PCR protocol were run on single cells and on genomic DNA with positive results.

In some embodiments, the methods described herein may be used to amplify and/or detect SNPs, copy number, nucleotide methylation, mRNA levels, other types of RNA expression levels, other genetic and/or epigenetic features. The mini-PCR methods described herein may be used along with next-generation sequencing; it may be used with other downstream methods such as microarrays, counting by digital PCR, real-time PCR, Mass-spectrometry analysis etc.

In some embodiment, the mini-PCR amplification methods described herein may be used as part of a method for accurate quantification of minority populations. It may be used for absolute quantification using spike calibrators. It may be used for mutation/minor allele quantification through very deep sequencing, and may be run in a highly multiplexed fashion. It may be used for standard paternity and identity testing of relatives or ancestors, in human, animals, plants or other creatures. It may be used for forensic testing. It may be used for rapid genotyping and copy number analysis (CN), on any kind of material, e.g. amniotic fluid and CVS, sperm, product of conception (POC). It may be used for single cell analysis, such as genotyping on samples biopsied from embryos. It may be used for rapid embryo analysis (within less than one, one, or two days of biopsy) by targeted sequencing using min-PCR.

In some embodiments, it may be used for tumor analysis: tumor biopsies are often a mixture of health and tumor cells. Targeted PCR allows deep sequencing of SNPs and loci with close to no background sequences. It may be used for copy number and loss of heterozygosity analysis on tumor DNA. Said tumor DNA may be present in many different body fluids or tissues of tumor patients. It may be used for detection of tumor recurrence, and/or tumor screening. It may be used for quality control testing of seeds. It may be used for breeding, or fishing purposes. Note that any of these methods could equally well be used targeting non-polymorphic loci for the purpose of ploidy calling.

Some literature describing some of the fundamental methods that underlie the methods disclosed herein include: (1) Wang H Y, Luo M, Tereshchenko I V, Frikker D M, Cui X, Li J Y, Hu G, Chu Y, Azaro M A, Lin Y, Shen L, Yang Q, Kambouris M E, Gao R, Shih W, Li H. Genome Res. 2005 February; 15 (2): 276-83. Department of Molecular Genetics, Microbiology and Immunology/The Cancer Institute of New Jersey, Robert Wood Johnson Medical School, New Brunswick, New Jersey 08903, USA. (2) High-throughput genotyping of single nucleotide polymorphisms with high sensitivity. Li H, Wang H Y, Cui X, Luo M, Hu G, Greenawalt D M, Tereshchenko I V, Li J Y, Chu Y, Gao R. Methods Mol Biol. 2007; 396—PubMed PMID: 18025699. (3) A method comprising multiplexing of an average of 9 assays for sequencing is described in: Nested Patch PCR enables highly multiplexed mutation discovery in candidate genes. Varley K E, Mitra R D. Genome Res. 2008 November; 18 (11): 1844-50. Epub 2008 Oct. 10. Note that the methods disclosed herein allow multiplexing of orders of magnitude more than in the above references.

Targeted PCR Variants—Nesting

There are many workflows that are possible when conducting PCR; some workflows typical to the methods disclosed herein are described. The steps outlined herein are not meant to exclude other possible steps nor does it imply that any of the steps described herein are required for the method to work properly. A large number of parameter variations or other modifications are known in the literature, and may be made without affecting the essence of the invention. One particular generalized workflow is given below followed by a number of possible variants. The variants typically refer to possible secondary PCR reactions, for example different types of nesting that may be done (step 3). It is important to note that variants may be done at different times, or in different orders than explicitly described herein. Examples that use polymorphic loci for illustration can be readily adapted for the amplification of nonpolymorphic loci if desired.

The DNA in the sample may have ligation adapters, often referred to as library tags or ligation adaptor tags (LTs), appended, where the ligation adapters contain a universal priming sequence, followed by a universal amplification. In an embodiment, this may be done using a standard protocol designed to create sequencing libraries after fragmentation. In an embodiment, the DNA sample can be blunt ended, and then an A can be added at the 3' end. A Y-adaptor with a T-overhang can be added and ligated. In some embodiments, other sticky ends can be used other than an A or T overhang. In some embodiments, other adaptors can be added, for example looped ligation adaptors. In some embodiments, the adaptors may have tag designed for PCR amplification.

Specific Target Amplification (STA): Pre-amplification of hundreds to thousands to tens of thousands and even hundreds of thousands of targets may be multiplexed in one reaction volume. STA is typically run from 10 to 30 cycles, though it may be run from 5 to 40 cycles, from 2 to 50 cycles, and even from 1 to 100 cycles. Primers may be tailed, for example for a simpler workflow or to avoid sequencing of a large proportion of dimers. Note that typically, dimers of both primers carrying the same tag will not be amplified or sequenced efficiently. In some embodiments, between 1 and 10 cycles of PCR may be carried out; in some embodiments between 10 and 20 cycles of PCR may be carried out; in some embodiments between 20 and 30 cycles of PCR may be carried out; in some embodiments between 30 and 40 cycles of PCR may be carried out; in some embodiments more than 40 cycles of PCR may be carried out. The amplification may be a linear amplification. The number of PCR cycles may be optimized to result in an optimal depth of read (DOR) profile. Different DOR profiles may be desirable for different purposes. In some embodiments, a more even distribution of reads between all assays is desirable; if the DOR is too small for some assays, the stochastic noise can be too high for the data to be too useful, while if the depth of read is too high, the marginal usefulness of each additional read is relatively small.

Primer tails may improve the detection of fragmented DNA from universally tagged libraries. If the library tag and the primer-tails contain a homologous sequence, hybridization can be improved (for example, melting temperature ($T_M$) is lowered) and primers can be extended if only a portion of the primer target sequence is in the sample DNA fragment. In some embodiments, 13 or more target specific base pairs may be used. In some embodiments, 10 to 12 target specific base pairs may be used. In some embodiments, 8 to 9 target specific base pairs may be used. In some embodiments, 6 to 7 target specific base pairs may be used. In some embodiments, STA may be performed on pre-amplified DNA, e.g. MDA, RCA, other whole genome amplifications, or adaptor-mediated universal PCR. In some embodiments, STA may be performed on samples that are enriched or depleted of certain sequences and populations, e.g. by size selection, target capture, directed degradation.

In some embodiments, it is possible to perform secondary multiplex PCRs or primer extension reactions to increase specificity and reduce undesirable products. For example, full nesting, semi-nesting, hemi-nesting, and/or subdividing into parallel reactions of smaller assay pools are all techniques that may be used to increase specificity. Experiments have shown that splitting a sample into three 400-plex reactions resulted in product DNA with greater specificity than one 1,200-plex reaction with exactly the same primers. Similarly, experiments have shown that splitting a sample into four 2,400-plex reactions resulted in product DNA with greater specificity than one 9,600-plex reaction with exactly the same primers. In an embodiment, it is possible to use target-specific and tag specific primers of the same and opposing directionality.

In some embodiments, it is possible to amplify a DNA sample (dilution, purified or otherwise) produced by an STA reaction using tag-specific primers and "universal amplification", i.e. to amplify many or all pre-amplified and tagged targets. Primers may contain additional functional sequences, e.g. barcodes, or a full adaptor sequence necessary for sequencing on a high throughput sequencing platform.

These methods may be used for analysis of any sample of DNA, and are especially useful when the sample of DNA is particularly small, or when it is a sample of DNA where the DNA originates from more than one individual, such as in the case of maternal plasma. These methods may be used on DNA samples such as a single or small number of cells, genomic DNA, plasma DNA, amplified plasma libraries, amplified apoptotic supernatant libraries, or other samples of mixed DNA. In an embodiment, these methods may be used in the case where cells of different genetic constitution may be present in a single individual, such as with cancer or transplants. In an embodiment, some of the DNA is from the recipient of a transplant (such as recipient cell-free or cellular DNA) and some of the DNA is from the donor of the transplant (such as cell-free or cellular DNA from the transplant). In an embodiment, the method is used to amplify one or more loci that differ between the recipient and the donor (such as loci for which a different combination of alleles are present in the recipient compared to the donor). In some embodiments, the recipient is homozygous for a first allele (such as AA) and the donor is homozygous for a second allele (such as BB) or is heterozygous with the first allele and a second allele (such as AB) at one or more loci. In some embodiments, the method is used to measure the absolute or relative amount of DNA from the donor of the transplant (such as cell-free or cellular DNA from the transplant). In some embodiments, this method is used to prognose, diagnose, detect, or monitor a transplant status or outcome, such as transplant rejection, tolerance, non-rejection based allograft injury, transplant function, transplant survival, chronic transplant injury, or tittering of pharmacological immunosuppression.

Protocol Variants (Variants and/or Additions to the Workflow Above)

Direct multiplexed mini-PCR: Specific target amplification (STA) of a plurality of target sequences with tagged primers is shown in FIG. 1. 101 denotes double stranded DNA with a polymorphic locus of interest at X. 102 denotes the double stranded DNA with ligation adaptors added for universal amplification. 103 denotes the single stranded DNA that has been universally amplified with PCR primers hybridized. 104 denotes the final PCR product. In some embodiments, STA may be done on more than 100, more than 200, more than 500, more than 1,000, more than 2,000, more than 5,000, more than 10,000, more than 20,000, more than 50,000, more than 100,000 or more than 200,000 targets. In a subsequent reaction, tag-specific primers amplify all target sequences and lengthen the tags to include all necessary sequences for sequencing, including sample indexes. In an embodiment, primers may not be tagged or only certain primers may be tagged. Sequencing adaptors may be added by conventional adaptor ligation. In an embodiment, the initial primers may carry the tags.

In an embodiment, primers are designed so that the length of DNA amplified is unexpectedly short. Prior art demonstrates that ordinary people skilled in the art typically design 100+ bp amplicons. In an embodiment, the amplicons may be designed to be less than 80 bp. In an embodiment, the amplicons may be designed to be less than 70 bp. In an embodiment, the amplicons may be designed to be less than 60 bp. In an embodiment, the amplicons may be designed to be less than 50 bp. In an embodiment, the amplicons may be designed to be less than 45 bp. In an embodiment, the amplicons may be designed to be less than 40 bp. In an embodiment, the amplicons may be designed to be less than 35 bp. In an embodiment, the amplicons may be designed to be between 40 and 65 bp.

An experiment was performed using this protocol using 1200-plex amplification. Both genomic DNA and pregnancy plasma were used; about 70% of sequence reads mapped to targeted sequences. Details are given elsewhere in this document. Sequencing of a 1042-plex without design and selection of assays resulted in >99% of sequences being primer dimer products.

Sequential PCR: After STA1 multiple aliquots of the product may be amplified in parallel with pools of reduced complexity with the same primers. The first amplification can give enough material to split. This method is especially good for small samples, for example those that are about 6-100 pg, about 100 pg to 1 ng, about 1 ng to 10 ng, or about 10 ng to 100 ng. The protocol was performed with 1200-plex into three 400-plexes. Mapping of sequencing reads increased from around 60 to 70% in the 1200-plex alone to over 95%.

Figure 2:
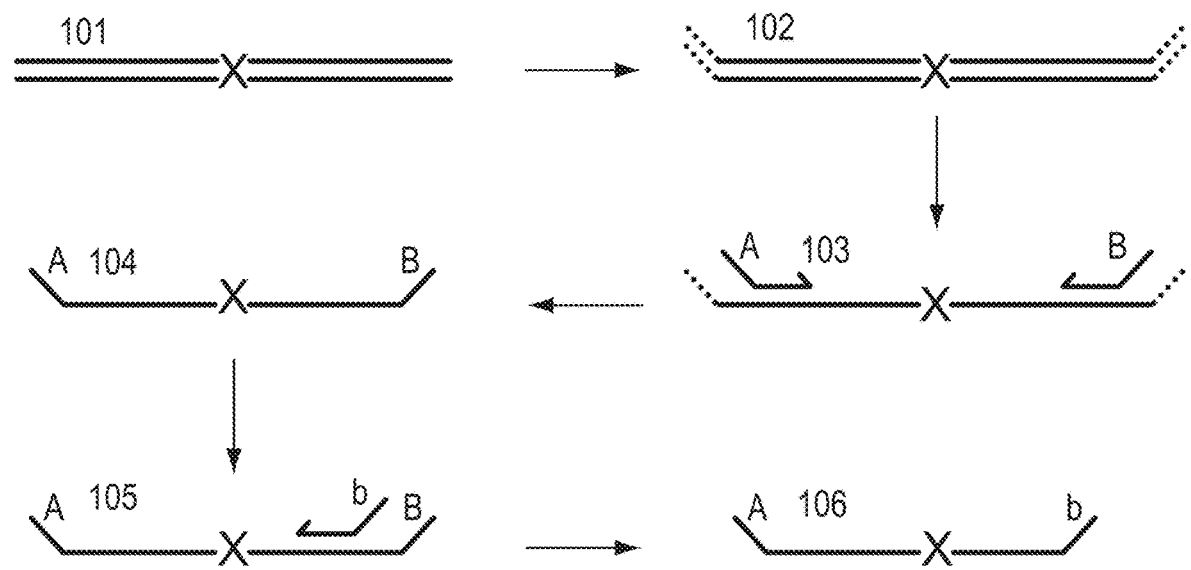
FIG. 2: Graphical representation of semi-nested mini-PCR method.

Semi-nested mini-PCR: (see FIG. 2) After STA 1 a second STA is performed comprising a multiplex set of internal nested Forward primers (103 B, 105 *b*) and one (or few)

tag-specific Reverse primers (103 A). 101 denotes double stranded DNA with a polymorphic locus of interest at X. 102 denotes the double stranded DNA with ligation adaptors added for universal amplification. 103 denotes the single stranded DNA that has been universally amplified with Forward primer B and Reverse Primer A hybridized. 104 denotes the PCR product from 103. 105 denotes the product from 104 with nested Forward primer b hybridized, and Reverse tag A already part of the molecule from the PCR that occurred between 103 and 104. 106 denotes the final PCR product. With this workflow usually greater than 95% of sequences map to the intended targets. The nested primer may overlap with the outer Forward primer sequence but introduces additional 3'-end bases. In some embodiments it is possible to use between one and 20 extra 3' bases. Experiments have shown that using 9 or more extra 3' bases in a 1200-plex designs works well. As readily apparent, the primers for the second STA can alternatively be considered a multiplex set of internal nested Reverse primers and one (or a few) tag-specific Forward primers.

Figure 3:
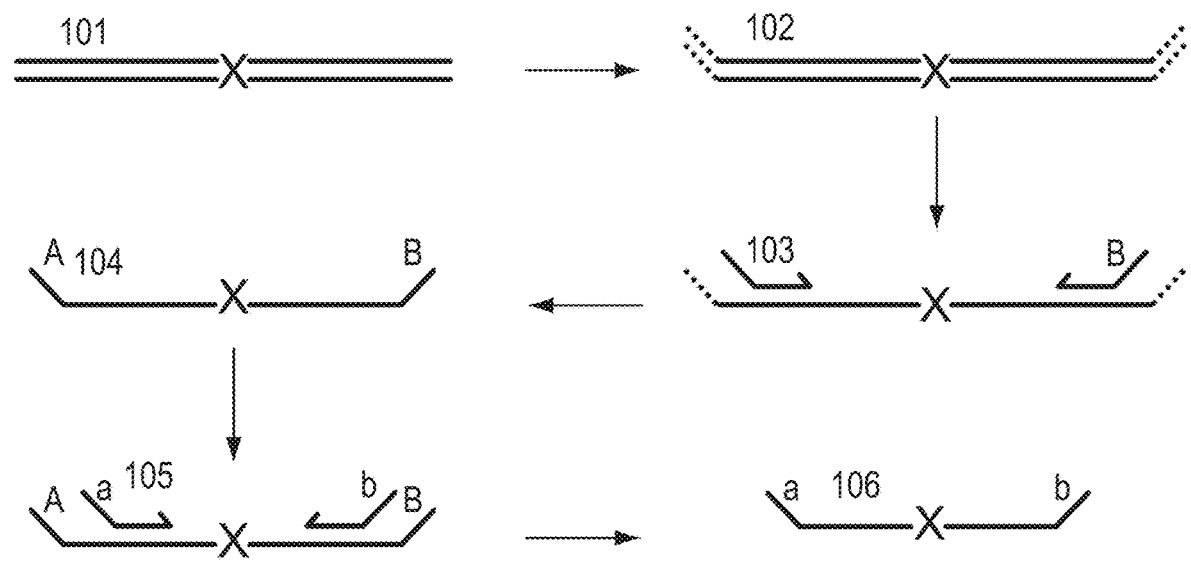
FIG. 3: Graphical representation of fully nested mini-PCR method.

Fully nested mini-PCR: (see FIG. 3) After STA step 1, it is possible to perform a second multiplex PCR (or parallel m.p. PCRs of reduced complexity) with two nested primers carrying tags (A, a, B, b). 101 denotes double stranded DNA with a polymorphic locus of interest at X. 102 denotes the double stranded DNA with ligation adaptors added for universal amplification. 103 denotes the single stranded DNA that has been universally amplified with Forward primer B and Reverse Primer A hybridized. 104 denotes the PCR product from 103. 105 denotes the product from 104 with nested Forward primer b and nested Reverse primer a hybridized. 106 denotes the final PCR product. In some embodiments, it is possible to use two full sets of primers. Experiments using a fully nested mini-PCR protocol were used to perform 146-plex amplification on single and three cells without step 102 of appending universal ligation adaptors and amplifying.

Figure 4:
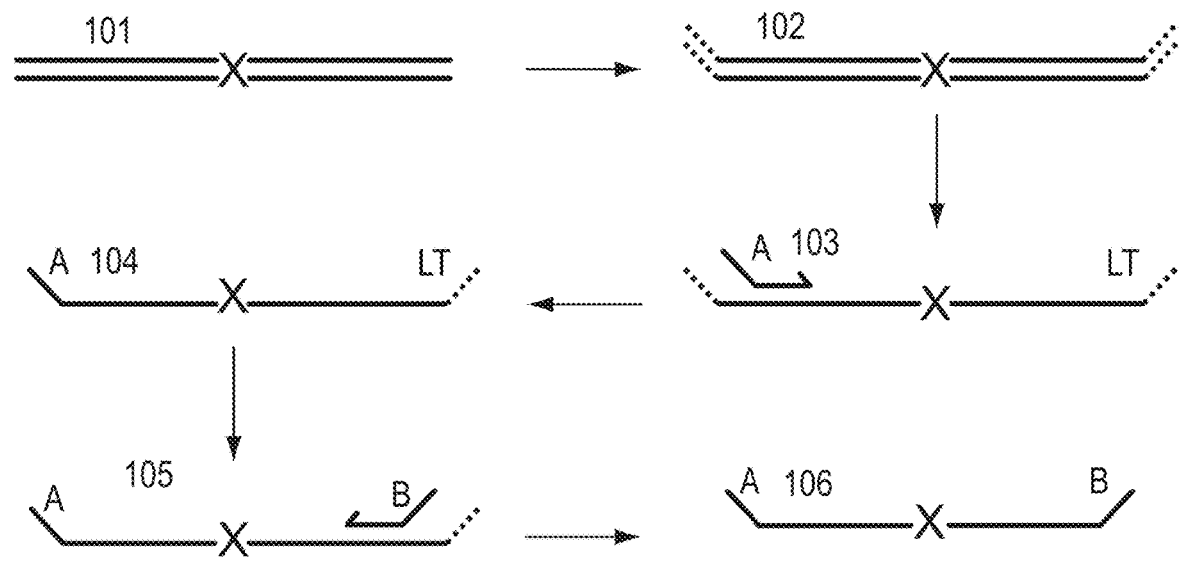
FIG. 4: Graphical representation of hemi-nested mini-PCR method.

Hemi-nested mini-PCR: (see FIG. 4) It is possible to use target DNA that has and adaptors at the fragment ends. STA is performed comprising a multiplex set of Forward primers (B) and one (or few) tag-specific Reverse primers (A). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the final PCR product. In this workflow, target specific Forward and Reverse primers are used in separate reactions, thereby reducing the complexity of the reaction and preventing dimer formation of forward and reverse primers. Note that in this example, primers A and B may be considered to be first primers, and primers 'a' and 'b' may be considered to be inner primers. This method is a big improvement on direct PCR as it is as good as direct PCR, but it avoids primer dimers. After first round of hemi nested protocol one typically sees ~99% non-targeted DNA, however, after second round there is typically a big improvement. As readily apparent, the primers for the first STA can be considered a multiplex set of Reverse primers and one (or few) tag-specific Forward primers, and the primers for the second STA can be considered a universal tag-specific Reverse primer and target specific Forward primer(s).

Figure 5:
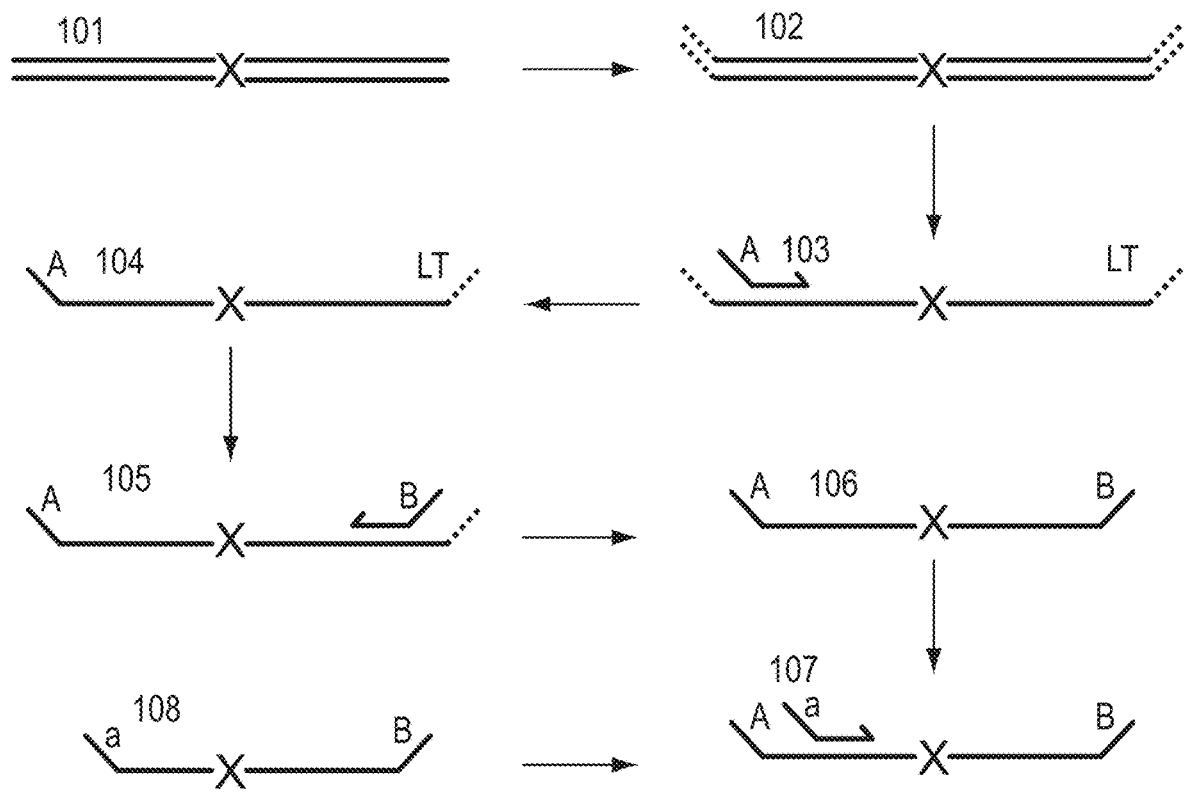
FIG. 5: Graphical representation of triply hemi-nested mini-PCR method.

Triply hemi-nested mini-PCR: (see FIG. 5) It is possible to use target DNA that has and adaptor at the fragment ends. STA is performed comprising a multiplex set of Forward primers (B) and one (or few) tag-specific Reverse primers (A) and (a). A second STA can be performed using a universal tag-specific Forward primer and target specific Reverse primer. 101 denotes double stranded DNA with a polymorphic locus of interest at X. 102 denotes the double stranded DNA with ligation adaptors added for universal amplification. 103 denotes the single stranded DNA that has been universally amplified with Reverse Primer A hybridized. 104 denotes the PCR product from 103 that was amplified using Reverse primer A and ligation adaptor tag primer LT. 105 denotes the product from 104 with Forward primer B hybridized. 106 denotes the PCR product from 105 that was amplified using Reverse primer A and Forward primer B. 107 denotes the product from 106 with Reverse primer 'a' hybridized. 108 denotes the final PCR product. Note that in this example, primers 'a' and B may be considered to be inner primers, and A may be considered to be a first primer. Optionally, both A and B may be considered to be first primers, and 'a' may be considered to be an inner primer. The designation of reverse and forward primers may be switched. In this workflow, target specific Forward and Reverse primers are used in separate reactions, thereby reducing the complexity of the reaction and preventing dimer formation of forward and reverse primers. This method is a big improvement on direct PCR as it is as good as direct PCR, but it avoids primer dimers. After first round of hemi nested protocol one typically sees ~99% non-targeted DNA, however, after second round there is typically a big improvement.

Figure 6:
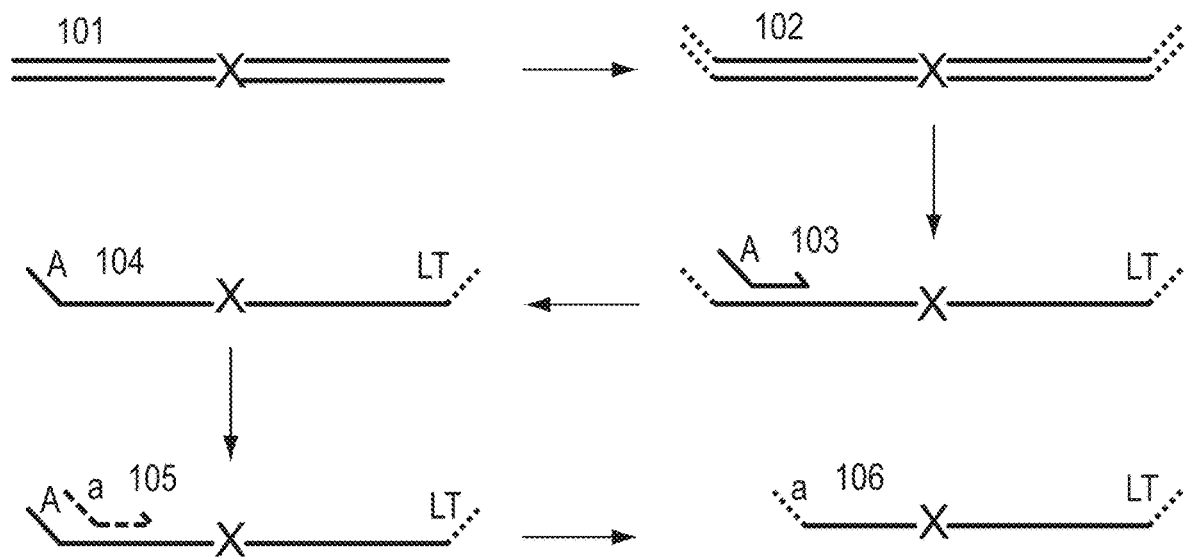
FIG. 6: Graphical representation of one-sided nested mini-PCR method.
Figure 7:
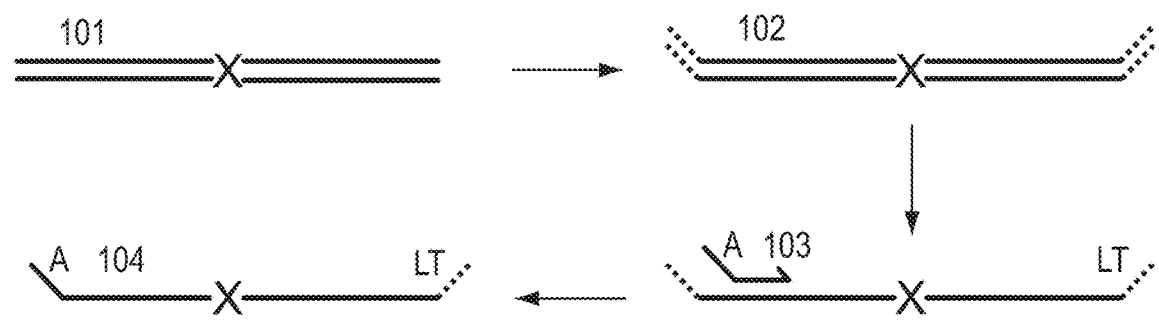
FIG. 7: Graphical representation of one-sided mini-PCR method.
Figure 8:
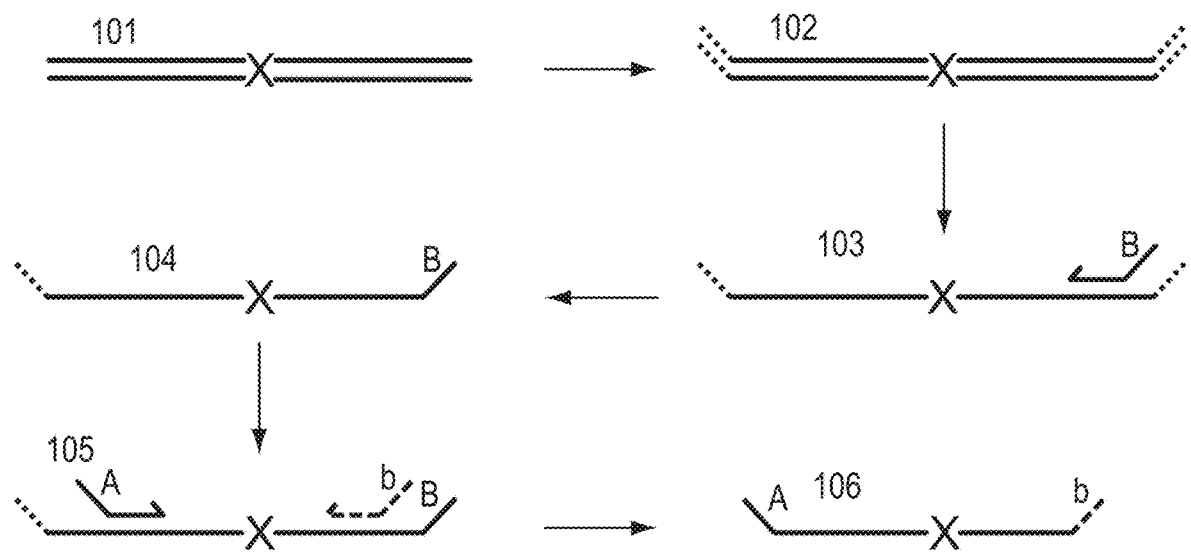
FIG. 8: Graphical representation of reverse semi-nested mini-PCR method.

One-sided nested mini-PCR: (see FIG. 6) It is possible to use target DNA that has an adaptor at the fragment ends. STA may also be performed with a multiplex set of nested Forward primers and using the ligation adapter tag as the Reverse primer. A second STA may then be performed using a set of nested Forward primers and a universal Reverse primer. 101 denotes double stranded DNA with a polymorphic locus of interest at X. 102 denotes the double stranded DNA with ligation adaptors added for universal amplification. 103 denotes the single stranded DNA that has been universally amplified with Forward Primer A hybridized. 104 denotes the PCR product from 103 that was amplified using Forward primer A and ligation adaptor tag Reverse primer LT. 105 denotes the product from 104 with nested Forward primer a hybridized. 106 denotes the final PCR product. This method can detect shorter target sequences than standard PCR by using overlapping primers in the first and second STAs. The method is typically performed off a sample of DNA that has already undergone STA step 1 above-appending of universal tags and amplification; the two nested primers are only on one side, other side uses the library tag. The method was performed on libraries of apoptotic supernatants and pregnancy plasma. With this workflow around 60% of sequences mapped to the intended targets. Note that reads that contained the reverse adaptor sequence were not mapped, so this number is expected to be higher if those reads that contain the reverse adaptor sequence are mapped One-sided mini-PCR: It is possible to use target DNA that has an adaptor at the fragment ends (see FIG. 7). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Forward Primer A hybridized. 104 denotes the PCR product from 103 that was amplified using Forward primer A and ligation adaptor tag Reverse primer LT, and which is the final PCR product. This method can detect shorter target sequences than standard PCR. However it may be relatively unspecific, as only one target specific primer is used. This protocol is effectively half of the one sided nested mini PCR Reverse semi-nested mini-PCR: It is possible to use target DNA that has an adaptor at the fragment ends (see FIG. 8). STA may be performed with a multiplex set of Forward primers and one (or few) tag-specific Reverse primer. 101 denotes double stranded DNA with a polymorphic locus of interest at X. 102 denotes the double stranded DNA with ligation adaptors added for universal amplification. 103 denotes the single stranded DNA with Reverse Primer B hybridized. 104 denotes the PCR product from 103 that was amplified using Reverse primer B and ligation adaptor tag Forward primer LT. 105 denotes the PCR product 104 with hybridized Forward Primer A, and inner Reverse primer 'b'. 106 denotes the PCR product that has been amplified from 105 using Forward primer A and Reverse primer 'b', and which is the final PCR product. This method can detect shorter target sequences than standard PCR.

There also may be more variants that are simply iterations or combinations of the above methods such as doubly nested PCR, where three sets of primers are used. Another variant is one-and-a-half sided nested mini-PCR, where STA may also be performed with a multiplex set of nested Forward primers and one (or few) tag-specific Reverse primer.

Note that in all of these variants, the identity of the Forward primer and the Reverse primer may be interchanged. Note that in some embodiments, the nested variant can equally well be run without the initial library preparation that comprises appending the adapter tags, and a universal amplification step. Note that in some embodiments, additional rounds of PCR may be included, with additional Forward and/or Reverse primers and amplification steps; these additional steps may be particularly useful if it is desirable to further increase the percent of DNA molecules that correspond to the targeted loci.

Nesting Workflows

Figure 9:
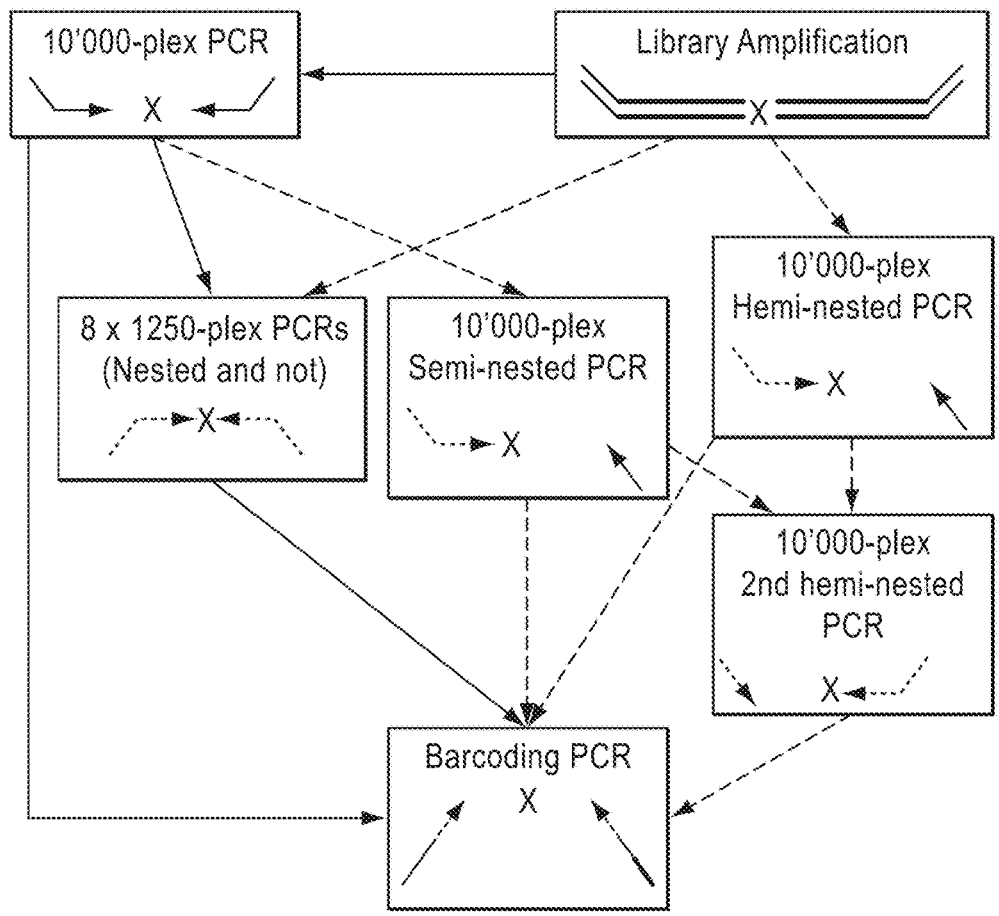
FIG. 9: Some possible workflows for semi-nested methods.

There are many ways to perform the amplification, with different degrees of nesting, and with different degrees of multiplexing. In FIG. 9, a flow chart is given with some of the possible workflows. Note that the use of 10,000-plex PCR is only meant to be an example; these flow charts would work equally well for other degrees of multiplexing.

Looped Ligation Adaptors

When adding universal tagged adaptors for example for the purpose of making a library for sequencing, there are a number of ways to ligate adaptors. One way is to blunt end the sample DNA, perform A-tailing, and ligate with adaptors that have a T-overhang. There are a number of other ways to ligate adaptors. There are also a number of adaptors that can be ligated. For example, a Y-adaptor can be used where the adaptor consists of two strands of DNA where one strand has a double strand region, and a region specified by a forward primer region, and where the other strand specified by a double strand region that is complementary to the double strand region on the first strand, and a region with a reverse primer. The double stranded region, when annealed, may contain a T-overhang for the purpose of ligating to double stranded DNA with an A overhang.

In an embodiment, the adaptor can be a loop of DNA where the terminal regions are complementary, and where the loop region contains a forward primer tagged region (LFT), a reverse primer tagged region (LRT), and a cleavage site between the two (See FIG. 10). 101 refers to the double stranded, blunt ended target DNA. 102 refers to the A-tailed target DNA. 103 refers to the looped ligation adaptor with T overhang 'T' and the cleavage site 'Z'. 104 refers to the target DNA with appended looped ligation adaptors. 105 refers to the target DNA with the ligation adaptors appended cleaved at the cleavage site. LFT refers to the ligation adaptor Forward tag, and the LRT refers to the ligation adaptor Reverse tag. The complementary region may end on a T overhang, or other feature that may be used for ligation to the target DNA. The cleavage site may be a series of uracils for cleavage by UNG, or a sequence that may be recognized and cleaved by a restriction enzyme or other method of cleavage or just a basic amplification. These adaptors can be uses for any library preparation, for example, for sequencing. These adaptors can be used in combination with any of the other methods described herein, for example the mini-PCR amplification methods.

Internally Tagged Primers

Figure 11:
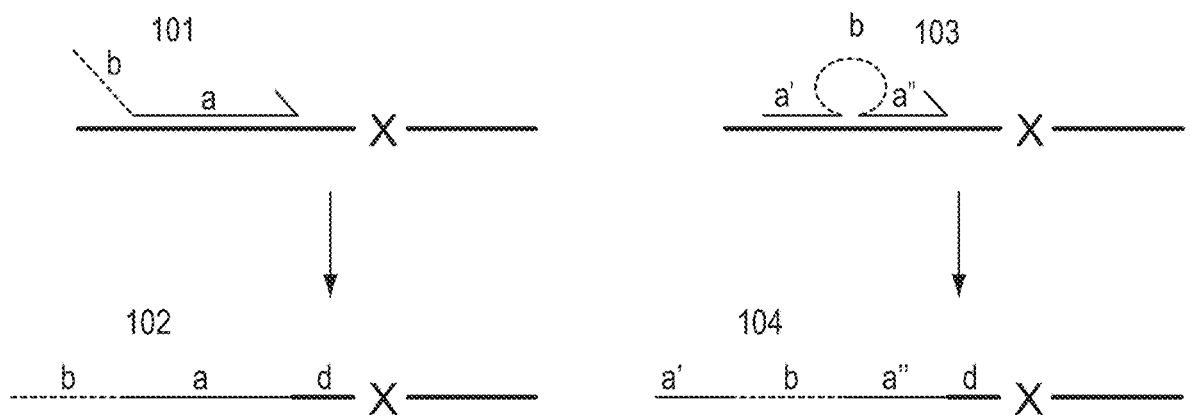
FIG. 11: Graphical representation of internally tagged primers.

When using sequencing to determine the allele present at a given polymorphic locus, the sequence read typically begins upstream of the primer binding site (a), and then to the polymorphic site (X). Tags are typically configured as shown in FIG. 11, left. 101 refers to the single stranded target DNA with polymorphic locus of interest 'X', and primer 'a' with appended tag 'b'. In order to avoid nonspecific hybridization, the primer binding site (region of target DNA complementary to 'a') is typically 18 to 30 bp in length. Sequence tag 'b' is typically about 20 bp; in theory these can be any length longer than about 15 bp, though many people use the primer sequences that are sold by the sequencing platform company. The distance 'd' between 'a' and 'X' may be at least 2 bp so as to avoid allele bias. When performing multiplexed PCR amplification using the methods disclosed herein or other methods, where careful primer design is necessary to avoid excessive primer primer interaction, the window of allowable distance 'd' between 'a' and 'X' may vary quite a bit: from 2 bp to 10 bp, from 2 bp to 20 bp, from 2 bp to 30 bp, or even from 2 bp to more than 30 bp. Therefore, when using the primer configuration shown in FIG. 11, left, sequence reads must be a minimum of 40 bp to obtain reads long enough to measure the polymorphic locus, and depending on the lengths of 'a' and 'd' the sequence reads may need to be up to 60 or 75 bp. Usually, the longer the sequence reads, the higher the cost and time of sequencing a given number of reads, therefore, minimizing the necessary read length can save both time and money. In addition, since, on average, bases read earlier on the read are read more accurately than those read later on the read, decreasing the necessary sequence read length can also increase the accuracy of the measurements of the polymorphic region.

In an embodiment, termed internally tagged primers, the primer binding site (a) is split in to a plurality of segments (a', a", a''' . . . ), and the sequence tag (b) is on a segment of DNA that is in the middle of two of the primer binding sites, as shown in FIG. 11, 103. This configuration allows the sequencer to make shorter sequence reads. In an embodiment, a'+a" should be at least about 18 bp, and can be as long as 30, 40, 50, 60, 80, 100 or more than 100 bp. In an embodiment, a" should be at least about 6 bp, and in an embodiment is between about 8 and 16 bp. All other factors being equal, using the internally tagged primers can cut the length of the sequence reads needed by at least 6 bp, as much as 8 bp, 10 bp, 12 bp, 15 bp, and even by as many as 20 or 30 bp. This can result in a significant money, time and accuracy advantage. An example of internally tagged primers is given in FIG. 12.

Primers with Ligation Adaptor Binding Region

Figure 10:
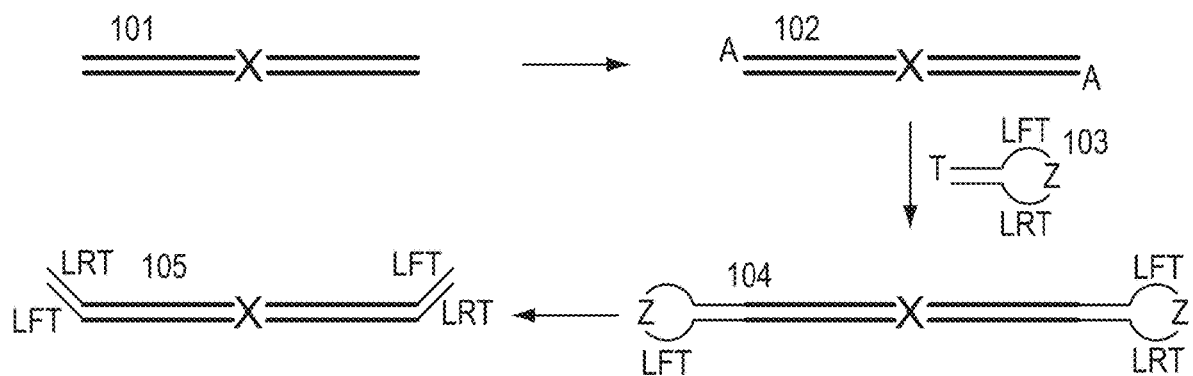
FIG. 10: Graphical representation of looped ligation adaptors.
Figure 13:
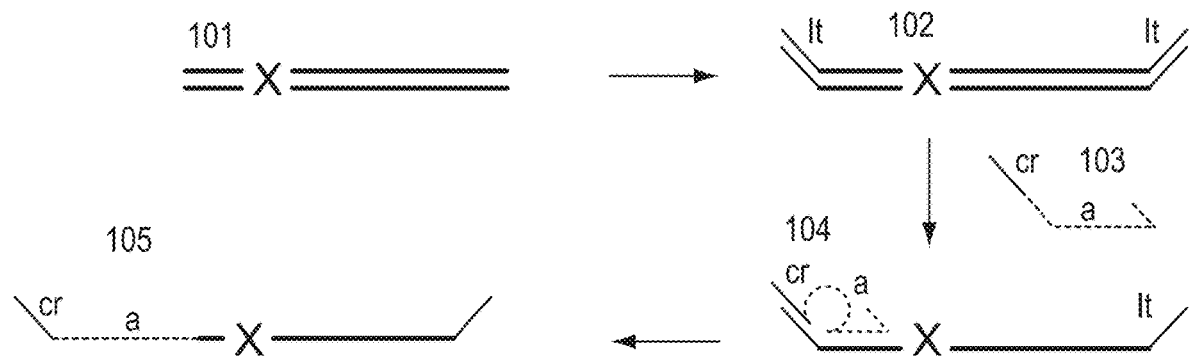
FIG. 13: Graphical representation of a method using primers with a ligation adaptor binding region.

One issue with fragmented DNA is that since it is short in length, the chance that a polymorphism is close to the end of a DNA strand is higher than for a long strand (e.g. 101, FIG. 10). Since PCR capture of a polymorphism requires a primer binding site of suitable length on both sides of the polymorphism, a significant number of strands of DNA with the targeted polymorphism will be missed due to insufficient overlap between the primer and the targeted binding site. In an embodiment, the target DNA 101 can have ligation adaptors appended 102, and the target primer 103 can have a region (cr) that is complementary to the ligation adaptor tag (lt) appended upstream of the designed binding region (a) (see FIG. 13); thus in cases where the binding region (region of 101 that is complementary to a) is shorter than the 18 bp typically required for hybridization, the region (cr) on the primer than is complementary to the library tag is able to increase the binding energy to a point where the PCR can proceed. Note that any specificity that is lost due to a shorter binding region can be made up for by other PCR primers with suitably long target binding regions. Note that this embodiment can be used in combination with direct PCR, or any of the other methods described herein, such as nested PCR, semi nested PCR, hemi nested PCR, one sided nested or semi or hemi nested PCR, or other PCR protocols.

When using the sequencing data to determine ploidy in combination with an analytical method that involves comparing the observed allele data to the expected allele distributions for various hypotheses, each additional read from alleles with a low depth of read will yield more information than a read from an allele with a high depth of read. Therefore, ideally, one would wish to see uniform depth of read (DOR) where each locus will have a similar number of representative sequence reads. Therefore, it is desirable to minimize the DOR variance. In an embodiment, it is possible to decrease the coefficient of variance of the DOR (this may be defined as the standard deviation of the DOR/the average DOR) by increasing the annealing times. In some embodiments the annealing temperatures may be longer than 2 minutes, longer than 4 minutes, longer than ten minutes, longer than 30 minutes, and longer than one hour, or even longer. Since annealing is an equilibrium process, there is no limit to the improvement of DOR variance with increasing annealing times. In an embodiment, increasing the primer concentration may decrease the DOR variance.

Exemplary Amplification Methods

Improved PCR amplification methods have also been developed that minimize or prevent interference due to the amplification of nearby or adjacent target loci in the same reaction volume (such as part of the sample multiplex PCR reaction that simultaneously amplifies all the target loci) (see, U.S. Ser. No. 61/982,245, filed Apr. 21, 2014; U.S. Ser. No. 61/987,407, filed May 1, 2014, and U.S. Ser. No. 62/066,514, filed Oct. 21, 2014, which are each hereby incorporated by reference in its entirety). These methods can be used to simultaneously amplify nearby or adjacent target loci, which is faster and cheaper than having to separate nearby target loci into different reaction volumes so that they can be amplified separately to avoid interference. In particular embodiments, these methods are used to tile a region such that the amplicons include all the nucleotides in the region (such as an exon or all the exons of a gene such as cystic fibrosis).

In some embodiments, the amplification of target loci is performed using a polymerase (e.g., a DNA polymerase, RNA polymerase, or reverse transcriptase) with low 5'→3' exonuclease and/or low strand displacement activity. In some embodiments, the low level of 5'→3' exonuclease reduces or prevents the degradation of a nearby primer (e.g., an unextended primer or a primer that has had one or more nucleotides added to during primer extension). In some embodiments, the low level of strand displacement activity reduces or prevents the displacement of a nearby primer (e.g., an unextended primer or a primer that has had one or more nucleotides added to it during primer extension). In some embodiments, target loci that are adjacent to each other (e.g., no bases between the target loci) or nearby (e.g., loci are within 50, 40, 30, 20, 15, 10, 9, 8, 7, 6, 5, 4, 3, 2, or 1 base) are amplified. In some embodiments, the 3' end of one locus is within 50, 40, 30, 20, 15, 10, 9, 8, 7, 6, 5, 4, 3, 2, or 1 base of the 5' end of next downstream locus.

In some embodiments, at least 100, 200, 500, 750, 1,000; 2,000; 5,000; 7,500; 10,000; 15,000; 19,000; 20,000; 25,000; 27,000; 28,000; 30,000; 40,000; 50,000; 75,000; or 100,000 different target loci are amplified, such as by the simultaneous amplification in one reaction volume In some embodiments, at least 50, 60, 70, 80, 90, 95, 96, 97, 98, 99, or 99.5% of the amplified products are target amplicons. In various embodiments, the amount of amplified products that are target amplicons is between 50 to 99.5%, such as between 60 to 99%, 70 to 98%, 80 to 98%, 90 to 99.5%, or 95 to 99.5%, inclusive. In some embodiments, at least 50, 60, 70, 80, 90, 95, 96, 97, 98, 99, or 99.5% of the target loci are amplified (e.g, amplified at least 5, 10, 20, 30, 50, or 100-fold compared to the amount prior to amplification), such as by the simultaneous amplification in one reaction volume. In various embodiments, the amount target loci that are amplified (e.g, amplified at least 5, 10, 20, 30, 50, or 100-fold compared to the amount prior to amplification) is between 50 to 99.5%, such as between 60 to 99%, 70 to 98%, 80 to 99%, 90 to 99.5%, 95 to 99.9%, or 98 to 99.99% inclusive. In some embodiments, fewer non-target amplicons are produced, such as fewer amplicons formed from a forward primer from a first primer pair and a reverse primer from a second primer pair. Such undesired non-target amplicons can be produced using prior amplification methods if, e.g., the reverse primer from the first primer pair and/or the forward primer from the second primer pair are degraded and/or displaced.

In some embodiments, these methods allows longer extension times to be used since the polymerase bound to a primer being extended is less likely to degrade and/or displace a nearby primer (such as the next downstream primer) given the low 5'→3' exonuclease and/or low strand displacement activity of the polymerase. In various embodiments, reaction conditions (such as the extension time and temperature) are used such that the extension rate of the polymerase allows the number of nucleotides that are added to a primer being extended to be equal to or greater than 80, 90, 95, 100, 110, 120, 130, 140, 150, 175, or 200% of the number of nucleotides between the 3' end of the primer binding site and the 5'end of the next downstream primer binding site on the same strand.

In some embodiments, a DNA polymerase is used produce DNA amplicons using DNA as a template. In some embodiments, a RNA polymerase is used produce RNA amplicons using DNA as a template. In some embodiments, a reverse transcriptase is used produce cDNA amplicons using RNA as a template.

In some embodiments, the low level of 5'→3' exonuclease of the polymerase is less than 80, 70, 60, 50, 40, 30, 20, 10, 5, 1, or 0.1% of the activity of the same amount of *Thermus aquaticus* polymerase ("Taq" polymerase, which is a commonly used DNA polymerase from a thermophilic bacterium, PDB 1BGX, EC 2.7.7.7, Murali et al., "Crystal structure of Taq DNA polymerase in complex with an inhibitory Fab: the Fab is directed against an intermediate in the helix-coil dynamics of the enzyme," Proc. Natl. Acad. Sci. USA 95:12562-12567, 1998, which is hereby incorporated by reference in its entirety) under the same conditions. In some embodiments, the low level of strand displacement activity of the polymerase is less than 80, 70, 60, 50, 40, 30, 20, 10, 5, 1, or 0.1% of the activity of the same amount of Taq polymerase under the same conditions.

In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman *BioChemica.* 2:34-35, 1995; Chester and Marshak *Analytical Biochemistry.* 209:284-290, 1993, which are each hereby incorporated by reference in its entirety). The PHUSION DNA polymerase is a *Pyrococcus*-like enzyme fused with a processivity-enhancing domain. PHUSION DNA polymerase possesses 5'→3' polymerase activity and 3'→5' exonuclease activity, and generates blunt-ended products. PHUSION DNA polymerase lacks 5'→3' exonuclease activity and strand displacement activity.

In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). Q5® High-Fidelity DNA polymerase is a high-fidelity, thermostable, DNA polymerase with 3'→5' exonuclease activity, fused to a processivity-enhancing Sso7d domain. Q5® High-Fidelity DNA polymerase lacks 5'→3' exonuclease activity and strand displacement activity.

In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology.* 3.5.10-3.5.12. New York: John Wiley & Sons, Inc., 1989; Sambrook et al. *Molecular Cloning: A Laboratory Manual.* (2nd ed.), 5.44-5.47. Cold Spring Harbor: Cold Spring Harbor Laboratory Press, 1989, which are each hereby incorporated by reference in its entirety). T4 DNA Polymerase catalyzes the synthesis of DNA in the 5'→3' direction and requires the presence of template and primer. This enzyme has a 3'→5' exonuclease activity which is much more active than that found in DNA Polymerase I. T4 DNA polymerase lacks 5'→3' exonuclease activity and strand displacement activity.

In some embodiments, the polymerase is a *Sulfolobus* DNA Polymerase IV (M0327S, New England BioLabs, Inc.; (Boudsocq, et al. (2001). *Nucleic Acids Res.,* 29:4607-4616, 2001; McDonald, et al. (2006). *Nucleic Acids Res.,* 34:1102-1111, 2006, which are each hereby incorporated by reference in its entirety). *Sulfolobus* DNA Polymerase IV is a thermostable Y-family lesion-bypass DNA Polymerase that efficiently synthesizes DNA across a variety of DNA template lesions McDonald, J. P. et al. (2006). *Nucleic Acids Res.,* 34, 1102-1111, which is hereby incorporated by reference in its entirety). *Sulfolobus* DNA Polymerase IV lacks 5'→3' exonuclease activity and strand displacement activity.

In some embodiments, if a primer binds a region with a SNP, the primer may bind and amplify the different alleles with different efficiencies or may only bind and amplify one allele. For subjects who are heterozygous, one of the alleles may not be amplified by the primer. In some embodiments, a primer is designed for each allele. For example, if there are two alleles (e.g., a biallelic SNP), then two primers can be used to bind the same location of a target locus (e.g., a forward primer to bind the "A" allele and a forward primer to bind the "B" allele). Standard methods, such as the dbSNP database, can be used to determine the location of known SNPs, such as SNP hot spots that have a high heterozygosity rate.

In some embodiments, the amplicons are similar in size. In some embodiments, the range of the length of the target amplicons is less than 100, 75, 50, 25, 15, 10, or 5 nucleotides. In some embodiments (such as the amplification of target loci in fragmented DNA or RNA), the length of the target amplicons is between 50 and 100 nucleotides, such as between 60 and 80 nucleotides, or 60 and 75 nucleotides, inclusive. In some embodiments (such as the amplification of multiple target loci throughout an exon or gene), the length of the target amplicons is between 100 and 500 nucleotides, such as between 150 and 450 nucleotides, 200 and 400 nucleotides, 200 and 300 nucleotides, or 300 and 400 nucleotides, inclusive.

In some embodiments, multiple target loci are simultaneously amplified using a primer pair that includes a forward and reverse primer for each target locus to be amplified in that reaction volume. In some embodiments, one round of PCR is performed with a single primer per target locus, and then a second round of PCR is performed with a primer pair per target locus. For example, the first round of PCR may be performed with a single primer per target locus such that all the primers bind the same strand (such as using a forward primer for each target locus). This allows the PCR to amplify in a linear manner and reduces or eliminates amplification bias between amplicons due to sequence or length differences. In some embodiments, the amplicons are then amplified using a forward and reverse primer for each target locus.

Exemplary Whole Genome Amplification Methods

In some embodiments, a method of the present disclosure may involve amplifying DNA, such as the use of whole genome application to amplify a nucleic acid sample before amplifying just the target loci. Amplification of the DNA, a process which transforms a small amount of genetic material to a larger amount of genetic material that comprises a similar set of genetic data, can be done by a wide variety of methods, including, but not limited to polymerase chain reaction (PCR). One method of amplifying DNA is whole genome amplification (WGA). There are a number of methods available for WGA: ligation-mediated PCR (LM-PCR), degenerate oligonucleotide primer PCR (DOP-PCR), and multiple displacement amplification (MDA). In LM-PCR, short DNA sequences called adapters are ligated to blunt ends of DNA. These adapters contain universal amplification sequences, which are used to amplify the DNA by PCR. In DOP-PCR, random primers that also contain universal amplification sequences are used in a first round of annealing and PCR. Then, a second round of PCR is used to amplify the sequences further with the universal primer sequences. MDA uses the phi-29 polymerase, which is a highly processive and non-specific enzyme that replicates DNA and has been used for single-cell analysis. The major limitations to amplification of material from a single cell are (1) necessity of using extremely dilute DNA concentrations or extremely small volume of reaction mixture, and (2) difficulty of reliably dissociating DNA from proteins across the whole genome. Regardless, single-cell whole genome amplification has been used successfully for a variety of applications for a number of years. There are other methods of amplifying DNA from a sample of DNA. The DNA amplification transforms the initial sample of DNA into a sample of DNA that is similar in the set of sequences, but of much greater quantity. In some cases, amplification may not be required.

In some embodiments, DNA may be amplified using a universal amplification, such as WGA or MDA. In some embodiments, DNA may be amplified by targeted amplification, for example using targeted PCR, or circularizing probes. In some embodiments, the DNA may be preferentially enriched using a targeted amplification method, or a method that results in the full or partial separation of desired from undesired DNA, such as capture by hybridization approaches. In some embodiments, DNA may be amplified by using a combination of a universal amplification method and a preferential enrichment method. A fuller description of some of these methods can be found elsewhere in this document.

Exemplary Enrichment and Sequencing Methods

In an embodiment, a method disclosed herein uses selective enrichment techniques that preserve the relative allele frequencies that are present in the original sample of DNA at each target loci (e.g., each polymorphic locus) from a set of target loci (e.g., polymorphic loci). While enrichment is particularly advantageous for methods for analyzing polymorphic loci, these enrichment methods can be readily adapted for nonpolymorphic loci if desired. In some embodiments the amplification and/or selective enrichment technique may involve PCR such as ligation mediated PCR, fragment capture by hybridization, Molecular Inversion Probes, or other circularizing probes. In some embodiments, methods for amplification or selective enrichment may involve using probes where, upon correct hybridization to the target sequence, the 3-prime end or 5-prime end of a nucleotide probe is separated from the polymorphic site of the allele by a small number of nucleotides. This separation reduces preferential amplification of one allele, termed allele bias. This is an improvement over methods that involve using probes where the 3-prime end or 5-prime end of a correctly hybridized probe are directly adjacent to or very near to the polymorphic site of an allele. In an embodiment, probes in which the hybridizing region may or certainly contains a polymorphic site are excluded. Polymorphic sites at the site of hybridization can cause unequal hybridization or inhibit hybridization altogether in some alleles, resulting in preferential amplification of certain alleles. These embodiments are improvements over other methods that involve targeted amplification and/or selective enrichment in that they better preserve the original allele frequencies of the sample at each polymorphic locus, whether the sample is pure genomic sample from a single individual or mixture of individuals.

The use of a technique to enrich a sample of DNA at a set of target loci followed by sequencing as part of a method for non-invasive prenatal allele calling or ploidy calling may confer a number of unexpected advantages. In some embodiments of the present disclosure, the method involves measuring genetic data for use with an informatics based method, such as PARENTAL SUPPORT™ (PS). The ultimate outcome of some of the embodiments is the actionable genetic data of an embryo or a fetus. There are many methods that may be used to measure the genetic data of the individual and/or the related individuals as part of embodied methods. In an embodiment, a method for enriching the concentration of a set of targeted alleles is disclosed herein, the method comprising one or more of the following steps: targeted amplification of genetic material, addition of loci specific oligonucleotide probes, ligation of specified DNA strands, isolation of sets of desired DNA, removal of unwanted components of a reaction, detection of certain sequences of DNA by hybridization, and detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

For example, a universal amplification step of the DNA prior to targeted amplification may confer several advantages, such as removing the risk of bottlenecking and reducing allelic bias. The DNA may be mixed an oligonucleotide probe that can hybridize with two neighboring regions of the target sequence, one on either side. After hybridization, the ends of the probe may be connected by adding a polymerase, a means for ligation, and any necessary reagents to allow the circularization of the probe. After circularization, an exonuclease may be added to digest to non-circularized genetic material, followed by detection of the circularized probe. The DNA may be mixed with PCR primers that can hybridize with two neighboring regions of the target sequence, one on either side. After hybridization, the ends of the probe may be connected by adding a polymerase, a means for ligation, and any necessary reagents to complete PCR amplification. Amplified or unamplified DNA may be targeted by hybrid capture probes that target a set of loci; after hybridization, the probe may be localized and separated from the mixture to provide a mixture of DNA that is enriched in target sequences.

The use of a method to target certain loci followed by sequencing as part of a method for allele calling or ploidy calling may confer a number of unexpected advantages. Some methods by which DNA may be targeted, or preferentially enriched, include using circularizing probes, linked inverted probes (LIPs, MIPs), capture by hybridization methods such as SURESELECT, and targeted PCR or ligation-mediated PCR amplification strategies.

In some embodiments, a method of the present disclosure involves measuring genetic data for use with an informatics based method, such as PARENTAL SUPPORT™ (PS), which is described further herein. PARENTAL SUPPORT™ is an informatics based approach to manipulating genetic data, aspects of which are described herein. The ultimate outcome of some of the embodiments is the actionable genetic data of an embryo or a fetus followed by a clinical decision based on the actionable data. The algorithms behind the PS method take the measured genetic data of the target individual, often an embryo or fetus, and the measured genetic data from related individuals, and are able to increase the accuracy with which the genetic state of the target individual is known. In an embodiment, the measured genetic data is used in the context of making ploidy determinations during prenatal genetic diagnosis. In an embodiment, the measured genetic data is used in the context of making ploidy determinations or allele calls on embryos during in vitro fertilization. There are many methods that may be used to measure the genetic data of the individual and/or the related individuals in the aforementioned contexts. The different methods comprise a number of steps, those steps often involving amplification of genetic material, addition of oligonucleotide probes, ligation of specified DNA strands, isolation of sets of desired DNA, removal of unwanted components of a reaction, detection of certain sequences of DNA by hybridization, detection of the sequence of one or a plurality of strands of DNA by DNA sequencing methods. In some cases the DNA strands may refer to target genetic material, in some cases they may refer to primers, in some cases they may refer to synthesized sequences, or combinations thereof. These steps may be carried out in a number of different orders.

Note that in theory it is possible to target any number loci in the genome, anywhere from one loci to well over one million loci. If a sample of DNA is subjected to targeting, and then sequenced, the percentage of the alleles that are read by the sequencer will be enriched with respect to their natural abundance in the sample. The degree of enrichment can be anywhere from one percent (or even less) to ten-fold, a hundred-fold, a thousand-fold or even many million-fold. In the human genome there are roughly 3 billion base pairs, and nucleotides, comprising approximately 75 million polymorphic loci. The more loci that are targeted, the smaller the degree of enrichment is possible. The fewer the number of loci that are targeted, the greater degree of enrichment is possible, and the greater depth of read may be achieved at those loci for a given number of sequence reads.

In an embodiment of the present disclosure, the targeting or preferential may focus entirely on SNPs. In an embodiment, the targeting or preferential may focus on any polymorphic site. A number of commercial targeting products are available to enrich exons. Surprisingly, targeting exclusively SNPs, or exclusively polymorphic loci, is particularly advantageous when using a method for NPD that relies on allele distributions. There are also published methods for NPD using sequencing, for example U.S. Pat. No. 7,888,017, involving a read count analysis where the read counting focuses on counting the number of reads that map to a given chromosome, where the analyzed sequence reads do not focused on regions of the genome that are polymorphic. Those types of methodology that do not focus on polymorphic alleles would not benefit as much from targeting or preferential enrichment of a set of alleles.

In an embodiment of the present disclosure, it is possible to use a targeting method that focuses on SNPs to enrich a genetic sample in polymorphic regions of the genome. In an embodiment, it is possible to focus on a small number of SNPs, for example between 1 and 100 SNPs, or a larger number, for example, between 100 and 1,000, between 1,000 and 10,000, between 10,000 and 100,000 or more than 100,000 SNPs. In an embodiment, it is possible to focus on one or a small number of chromosomes that are correlated with live trisomic births, for example chromosomes 13, 18, 21, X and Y, or some combination thereof. In an embodiment, it is possible to enrich the targeted SNPs by a small factor, for example between 1.01 fold and 100 fold, or by a larger factor, for example between 100 fold and 1,000,000 fold, or even by more than 1,000,000 fold. In an embodiment of the present disclosure, it is possible to use a targeting method to create a sample of DNA that is preferentially enriched in polymorphic regions of the genome. In an embodiment, it is possible to use this method to create a mixture of DNA with any of these characteristics where the mixture of DNA contains maternal DNA and also free floating fetal DNA. In an embodiment, it is possible to use this method to create a mixture of DNA that has any combination of these factors. For example, the method described herein may be used to produce a mixture of DNA that comprises maternal DNA and fetal DNA, and that is preferentially enriched in DNA that corresponds to 200 SNPs, all of which are located on either chromosome 18 or 21, and which are enriched an average of 1000 fold. In another example, it is possible to use the method to create a mixture of DNA that is preferentially enriched in 10,000 SNPs that are all or mostly located on chromosomes 13, 18, 21, X and Y, and the average enrichment per loci is greater than 500 fold. Any of the targeting methods described herein can be used to create mixtures of DNA that are preferentially enriched in certain loci.

In some embodiments, a method of the present disclosure further includes measuring the DNA in the mixed fraction using a high throughput DNA sequencer, where the DNA in the mixed fraction contains a disproportionate number of sequences from one or more chromosomes, wherein the one or more chromosomes are taken from the group comprising chromosome 13, chromosome 18, chromosome 21, chromosome X, chromosome Y and combinations thereof.

Described herein are three methods: multiplex PCR, targeted capture by hybridization, and linked inverted probes (LIPs), which may be used to obtain and analyze measurements from a sufficient number of polymorphic loci from a maternal plasma sample in order to detect fetal aneuploidy; this is not meant to exclude other methods of selective enrichment of targeted loci. Other methods may equally well be used without changing the essence of the method. In each case the polymorphism assayed may include single nucleotide polymorphisms (SNPs), small indels, or STRs. A preferred method involves the use of SNPs. Each approach produces allele frequency data; allele frequency data for each targeted locus and/or the joint allele frequency distributions from these loci may be analyzed to determine the ploidy of the fetus. Each approach has its own considerations due to the limited source material and the fact that maternal plasma consists of mixture of maternal and fetal DNA. This method may be combined with other approaches to provide a more accurate determination. In an embodiment, this method may be combined with a sequence counting approach such as that described in U.S. Pat. No. 7,888,017. The approaches described could also be used to detect fetal paternity noninvasively from maternal plasma samples. In addition each approach may be applied to other mixtures of DNA or pure DNA samples to detect the presence or absence of aneuploid chromosomes, to genotype a large number of SNP from degraded DNA samples, to detect segmental copy number variations (CNVs), to detect other genotypic states of interest, or some combination thereof.

Accurately Measuring the Allelic Distributions in a Sample

Current sequencing approaches can be used to estimate the distribution of alleles in a sample. One such method involves randomly sampling sequences from a pool DNA, termed shotgun sequencing. The proportion of a particular allele in the sequencing data is typically very low and can be determined by simple statistics. The human genome contains approximately 3 billion base pairs. So, if the sequencing method used make 100 bp reads, a particular allele will be measured about once in every 30 million sequence reads.

In an embodiment, a method of the present disclosure is used to determine the presence or absence of two or more different haplotypes that contain the same set of loci in a sample of DNA from the measured allele distributions of loci from that chromosome. The different haplotypes could represent two different homologous chromosomes from one individual, three different homologous chromosomes from a trisomic individual, three different homologous haplotypes from a mother and a fetus where one of the haplotypes is shared between the mother and the fetus, three or four haplotypes from a mother and fetus where one or two of the haplotypes are shared between the mother and the fetus, or other combinations. Alleles that are polymorphic between the haplotypes tend to be more informative, however any alleles where the mother and father are not both homozygous for the same allele will yield useful information through measured allele distributions beyond the information that is available from simple read count analysis.

Shotgun sequencing of such a sample, however, is extremely inefficient as it results in many sequences for regions that are not polymorphic between the different haplotypes in the sample, or are for chromosomes that are not of interest, and therefore reveal no information about the proportion of the target haplotypes. Described herein are methods that specifically target and/or preferentially enrich segments of DNA in the sample that are more likely to be polymorphic in the genome to increase the yield of allelic information obtained by sequencing. Note that for the measured allele distributions in an enriched sample to be truly representative of the actual amounts present in the target individual, it is critical that there is little or no preferential enrichment of one allele as compared to the other allele at a given loci in the targeted segments. Current methods known in the art to target polymorphic alleles are designed to ensure that at least some of any alleles present are detected. However, these methods were not designed for the purpose of measuring the unbiased allelic distributions of polymorphic alleles present in the original mixture. It is non-obvious that any particular method of target enrichment would be able to produce an enriched sample wherein the measured allele distributions would accurately represent the allele distributions present in the original unamplified sample better than any other method. While many enrichment methods may be expected, in theory, to accomplish such an aim, an ordinary person skilled in the art is well aware that there is a great deal of stochastic or deterministic bias in current amplification, targeting and other preferential enrichment methods. One embodiment of a method described herein allows a plurality of alleles found in a mixture of DNA that correspond to a given locus in the genome to be amplified, or preferentially enriched in a way that the degree of enrichment of each of the alleles is nearly the same. Another way to say this is that the method allows the relative quantity of the alleles present in the mixture as a whole to be increased, while the ratio between the alleles that correspond to each locus remains essentially the same as they were in the original mixture of DNA. For some reported methods, preferential enrichment of loci can result in allelic biases of more than 1%, more than 2%, more than 5% and even more than 10%. This preferential enrichment may be due to capture bias when using a capture by hybridization approach, or amplification bias which may be small for each cycle, but can become large when compounded over 20, 30 or 40 cycles. For the purposes of this disclosure, for the ratio to remain essentially the same means that the ratio of the alleles in the original mixture divided by the ratio of the alleles in the resulting mixture is between 0.95 and 1.05, between 0.98 and 1.02, between 0.99 and 1.01, between 0.995 and 1.005, between 0.998 and 1.002, between 0.999 and 1.001, or between 0.9999 and 1.0001. Note that the calculation of the allele ratios presented here may not be used in the determination of the ploidy state of the target individual, and may only a metric to be used to measure allelic bias.

In an embodiment, once a mixture has been preferentially enriched at the set of target loci, it may be sequenced using any one of the previous, current, or next generation of sequencing instruments that sequences a clonal sample (a sample generated from a single molecule; examples include ILLUMINA GAIIx, ILLUMINA HISEQ, LIFE TECHNOLOGIES SOLID, 5500XL). The ratios can be evaluated by sequencing through the specific alleles within the targeted region. These sequencing reads can be analyzed and counted according the allele type and the rations of different alleles determined accordingly. For variations that are one to a few bases in length, detection of the alleles will be performed by sequencing and it is essential that the sequencing read span the allele in question in order to evaluate the allelic composition of that captured molecule. The total number of captured molecules assayed for the genotype can be increased by increasing the length of the sequencing read. Full sequencing of all molecules would guarantee collection of the maximum amount of data available in the enriched pool. However, sequencing is currently expensive, and a method that can measure allele distributions using a lower number of sequence reads will have great value. In addition, there are technical limitations to the maximum possible length of read as well as accuracy limitations as read lengths increase. The alleles of greatest utility will be of one to a few bases in length, but theoretically any allele shorter than the length of the sequencing read can be used. While allele variations come in all types, the examples provided herein focus on SNPs or variants contained of just a few neighboring base pairs. Larger variants such as segmental copy number variants can be detected by aggregations of these smaller variations in many cases as whole collections of SNP internal to the segment are duplicated. Variants larger than a few bases, such as STRs require special consideration and some targeting approaches work while others will not.

There are multiple targeting approaches that can be used to specifically isolate and enrich a one or a plurality of variant positions in the genome. Typically, these rely on taking advantage of the invariant sequence flanking the variant sequence. There are reports by others related to targeting in the context of sequencing where the substrate is maternal plasma (see, e.g., Liao et al., Clin. Chem. 2011; 57 (1): pp. 92-101). However, these approaches use targeting probes that target exons, and do not focus on targeting polymorphic regions of the genome. In an embodiment, a method of the present disclosure involves using targeting probes that focus exclusively or almost exclusively on polymorphic regions. In an embodiment, a method of the present disclosure involves using targeting probes that focus exclusively or almost exclusively on SNPs. In some embodiments of the present disclosure, the targeted polymorphic sites consist of at least 10% SNPs, at least 20% SNPs, at least 30% SNPs, at least 40% SNPs, at least 50% SNPs, at least 60% SNPs, at least 70% SNPs, at least 80% SNPs, at least 90% SNPs, at least 95% SNPs, at least 98% SNPs, at least 99% SNPs, at least 99.9% SNPs, or exclusively SNPs.

In an embodiment, a method of the present disclosure can be used to determine genotypes (base composition of the DNA at specific loci) and relative proportions of those genotypes from a mixture of DNA molecules, where those DNA molecules may have originated from one or a number of genetically distinct individuals. In an embodiment, a method of the present disclosure can be used to determine the genotypes at a set of polymorphic loci, and the relative ratios of the amount of different alleles present at those loci. In an embodiment the polymorphic loci may consist entirely of SNPs. In an embodiment, the polymorphic loci can comprise SNPs, single tandem repeats, and other polymorphisms. In an embodiment, a method of the present disclosure can be used to determine the relative distributions of alleles at a set of polymorphic loci in a mixture of DNA, where the mixture of DNA comprises DNA that originates from a mother, and DNA that originates from a fetus. In an embodiment, the joint allele distributions can be determined on a mixture of DNA isolated from blood from a pregnant woman. In an embodiment, the allele distributions at a set of loci can be used to determine the ploidy state of one or more chromosomes on a gestating fetus.

In an embodiment, the mixture of DNA molecules could be derived from DNA extracted from multiple cells of one individual. In an embodiment, the original collection of cells from which the DNA is derived may comprise a mixture of diploid or haploid cells of the same or of different genotypes, if that individual is mosaic (germline or somatic). In an embodiment, the mixture of DNA molecules could also be derived from DNA extracted from single cells. In an embodiment, the mixture of DNA molecules could also be derived from DNA extracted from mixture of two or more cells of the same individual, or of different individuals. In an embodiment, the mixture of DNA molecules could be derived from DNA isolated from biological material that has already liberated from cells such as blood plasma, which is known to contain cell free DNA. In an embodiment, the this biological material may be a mixture of DNA from one or more individuals, as is the case during pregnancy where it has been shown that fetal DNA is present in the mixture. In an embodiment, the biological material could be from a mixture of cells that were found in maternal blood, where some of the cells are fetal in origin. In an embodiment, the biological material could be cells from the blood of a pregnant which have been enriched in fetal cells.

Circularizing Probes

Some embodiments of the present disclosure involve the use of "Linked Inverted Probes" (LIPs), which have been previously described in the literature, to amplify the target loci before or after amplification using primers that are not LIPs in the multiplex PCR methods of the invention. LIPs is a generic term meant to encompass technologies that involve the creation of a circular molecule of DNA, where the probes are designed to hybridize to targeted region of DNA on either side of a targeted allele, such that addition of appropriate polymerases and/or ligases, and the appropriate conditions, buffers and other reagents, will complete the complementary, inverted region of DNA across the targeted allele to create a circular loop of DNA that captures the information found in the targeted allele. LIPs may also be called pre-circularized probes, pre-circularizing probes, or circularizing probes. The LIPs probe may be a linear DNA molecule between 50 and 500 nucleotides in length, and in an embodiment between 70 and 100 nucleotides in length; in some embodiments, it may be longer or shorter than described herein. Others embodiments of the present disclosure involve different incarnations, of the LIPs technology, such as Padlock Probes and Molecular Inversion Probes (MIPs).

One method to target specific locations for sequencing is to synthesize probes in which the 3' and 5' ends of the probes anneal to target DNA at locations adjacent to and on either side of the targeted region, in an inverted manner, such that the addition of DNA polymerase and DNA ligase results in extension from the 3' end, adding bases to single stranded probe that are complementary to the target molecule (gap-fill), followed by ligation of the new 3' end to the 5' end of the original probe resulting in a circular DNA molecule that can be subsequently isolated from background DNA. The probe ends are designed to flank the targeted region of interest. One aspect of this approach is commonly called MIPS and has been used in conjunction with array technologies to determine the nature of the sequence filled in.

One drawback to the use of MIPs in the context of measuring allele ratios is that the hybridization, circularization and amplification steps do not happed at equal rates for different alleles at the same loci. This results in measured allele ratios that are not representative of the actual allele ratios present in the original mixture.

In an embodiment, the circularizing probes are constructed such that the region of the probe that is designed to hybridize upstream of the targeted polymorphic locus and the region of the probe that is designed to hybridize downstream of the targeted polymorphic locus are covalently connected through a non-nucleic acid backbone. This backbone can be any biocompatible molecule or combination of biocompatible molecules. Some examples of possible biocompatible molecules are poly(ethylene glycol), polycarbonates, polyurethanes, polyethylenes, polypropylenes, sulfone polymers, silicone, cellulose, fluoropolymers, acrylic compounds, styrene block copolymers, and other block copolymers.

In an embodiment of the present disclosure, this approach has been modified to be easily amenable to sequencing as a means of interrogating the filled in sequence. In order to retain the original allelic proportions of the original sample at least one key consideration must be taken into account. The variable positions among different alleles in the gap-fill region must not be too close to the probe binding sites as there can be initiation bias by the DNA polymerase resulting in differential of the variants. Another consideration is that additional variations may be present in the probe binding sites that are correlated to the variants in the gap-fill region which can result unequal amplification from different alleles. In an embodiment of the present disclosure, the 3' ends and 5' ends of the pre-circularized probe are designed to hybridize to bases that are one or a few positions away from the variant positions (polymorphic sites) of the targeted allele. The number of bases between the polymorphic site (SNP or otherwise) and the base to which the 3' end and/or 5' of the pre-circularized probe is designed to hybridize may be one base, it may be two bases, it may be three bases, it may be four bases, it may be five bases, it may be six bases, it may be seven to ten bases, it may be eleven to fifteen bases, or it may be sixteen to twenty bases, twenty to thirty bases, or thirty to sixty bases. The forward and reverse primers may be designed to hybridize a different number of bases away from the polymorphic site. Circularizing probes can be generated in large numbers with current DNA synthesis technology allowing very large numbers of probes to be generated and potentially pooled, enabling interrogation of many loci simultaneously. It has been reported to work with more than 300,000 probes. Two papers that discuss a method involving circularizing probes that can be used to measure the genomic data of the target individual include: Porreca et al., Nature Methods, 2007 4 (11), pp. 931-936.; and also Turner et al., Nature Methods, 2009, 6 (5), pp. 315-316. The methods described in these papers may be used in combination with other methods described herein. Certain steps of the method from these two papers may be used in combination with other steps from other methods described herein.

In some embodiments of the methods disclosed herein, the genetic material of the target individual is optionally amplified, followed by hybridization of the pre-circularized probes, performing a gap fill to fill in the bases between the two ends of the hybridized probes, ligating the two ends to form a circularized probe, and amplifying the circularized probe, using, for example, rolling circle amplification. Once the desired target allelic genetic information is captured by circularizing appropriately designed oligonucleotide probes, such as in the LIPs system, the genetic sequence of the circularized probes may be being measured to give the desired sequence data. In an embodiment, the appropriately designed oligonucleotides probes may be circularized directly on unamplified genetic material of the target individual, and amplified afterwards. Note that a number of amplification procedures may be used to amplify the original genetic material, or the circularized LIPs, including rolling circle amplification, MDA, or other amplification protocols. Different methods may be used to measure the genetic information on the target genome, for example using high throughput sequencing, Sanger sequencing, other sequencing methods, capture-by-hybridization, capture-by-circularization, multiplex PCR, other hybridization methods, and combinations thereof.

Once the genetic material of the individual has been measured using one or a combination of the above methods, an informatics based method, such as the PARENTAL SUPPORT™ method, along with the appropriate genetic measurements, can then be used to determination the ploidy state of one or more chromosomes on the individual, and/or the genetic state of one or a set of alleles, specifically those alleles that are correlated with a disease or genetic state of interest. Note that the use of LIPs has been reported for multiplexed capture of genetic sequences, followed by genotyping with sequencing. However, the use of sequencing data resulting from a LIPs-based strategy for the amplification of the genetic material found in a single cell, a small number of cells, or extracellular DNA, has not been used for the purpose of determining the ploidy state of a target individual.

Applying an informatics based method to determine the ploidy state of an individual from genetic data as measured by hybridization arrays, such as the ILLUMINA INFINIUM array, or the AFFYMETRIX gene chip has been described in documents references elsewhere in this document. However, the method described herein shows improvements over methods described previously in the literature. For example, the LIPs based approach followed by high throughput sequencing unexpectedly provides better genotypic data due to the approach having better capacity for multiplexing, better capture specificity, better uniformity, and low allelic bias. Greater multiplexing allows more alleles to be targeted, giving more accurate results. Better uniformity results in more of the targeted alleles being measured, giving more accurate results. Lower rates of allelic bias result in lower rates of miscalls, giving more accurate results. More accurate results result in an improvement in clinical outcomes, and better medical care.

It is important to note that LIPs may be used as a method for targeting specific loci in a sample of DNA for genotyping by methods other than sequencing. For example, LIPs may be used to target DNA for genotyping using SNP arrays or other DNA or RNA based microarrays.

Ligation-Mediated PCR

Ligation-mediated PCR may be used to amplify the target loci before or after PCR amplification using primers that are not ligated. Ligation-mediated PCR is a method of PCR used to preferentially enrich a sample of DNA by amplifying one or a plurality of loci in a mixture of DNA, the method comprising: obtaining a set of primer pairs, where each primer in the pair contains a target specific sequence and a non-target sequence, where the target specific sequence is preferably designed to anneal to a target region, one upstream and one downstream from the polymorphic site, and which can be separated from the polymorphic site by 0, 1, 2, 3, 4, 5, 6, 7, 8, 9, 10, 11-20, 21-30, 31-40, 41-50, 51-100, or more than 100; polymerization of the DNA from the 3-prime end of upstream primer to the fill the single strand region between it and the 5-prime end of the downstream primer with nucleotides complementary to the target molecule; ligation of the last polymerized base of the upstream primer to the adjacent 5-prime base of the downstream primer; and amplification of only polymerized and ligated molecules using the non-target sequences contained at the 5-prime end of the upstream primer and the 3-prime end of the downstream primer. Pairs of primers to distinct targets may be mixed in the same reaction. The non-target sequences serve as universal sequences such that of all pairs of primers that have been successfully polymerized and ligated may be amplified with a single pair of amplification primers.

Capture by Hybridization

In some embodiments, a method of the present disclosure may involve using any of the following capture by hybridization methods in addition to using multiplex PCR to amplify the target loci. Preferential enrichment of a specific set of sequences in a target genome can be accomplished in a number of ways. Elsewhere in this document is a description of how LIPs can be used to target a specific set of sequences, but in all of those applications, other targeting and/or preferential enrichment methods can be used equally well for the same ends. One example of another targeting method is the capture by hybridization approach. Some examples of commercial capture by hybridization technologies include AGILENT's SURE SELECT and ILLUMINA's TRUSEQ. In capture by hybridization, a set of oligonucleotides that is complimentary or mostly complimentary to the desired targeted sequences is allowed to hybridize to a mixture of DNA, and then physically separated from the mixture. Once the desired sequences have hybridized to the targeting oligonucleotides, the effect of physically removing the targeting oligonucleotides is to also remove the targeted sequences. Once the hybridized oligos are removed, they can be heated to above their melting temperature and they can be amplified. Some ways to physically remove the targeting oligonucleotides is by covalently bonding the targeting oligos to a solid support, for example a magnetic bead, or a chip. Another way to physically remove the targeting oligonucleotides is by covalently bonding them to a molecular moiety with a strong affinity for another molecular moiety. An example of such a molecular pair is biotin and streptavidin, such as is used in SURE SELECT. Thus that targeted sequences could be covalently attached to a biotin molecule, and after hybridization, a solid support with streptavidin affixed can be used to pull down the biotinylated oligonucleotides, to which are hybridized to the targeted sequences.

Hybrid capture involves hybridizing probes that are complementary to the targets of interest to the target molecules. Hybrid capture probes were originally developed to target and enrich large fractions of the genome with relative uniformity between targets. In that application, it was important that all targets be amplified with enough uniformity that all regions could be detected by sequencing, however, no regard was paid to retaining the proportion of alleles in original sample. Following capture, the alleles present in the sample can be determined by direct sequencing of the captured molecules. These sequencing reads can be analyzed and counted according the allele type. However, using the current technology, the measured allele distributions the captured sequences are typically not representative of the original allele distributions.

In an embodiment, detection of the alleles is performed by sequencing. In order to capture the allele identity at the polymorphic site, it is essential that the sequencing read span the allele in question in order to evaluate the allelic composition of that captured molecule. Since the capture molecules are often of variable lengths upon sequencing cannot be guaranteed to overlap the variant positions unless the entire molecule is sequenced. However, cost considerations as well as technical limitations as to the maximum possible length and accuracy of sequencing reads make sequencing the entire molecule unfeasible. In an embodiment, the read length can be increased from about 30 to about 50 or about 70 bases can greatly increase the number of reads that overlap the variant positions within the targeted sequences.

Another way to increase the number of reads that interrogate the position of interest is to decrease the length of the probe, as long as it does not result in bias in the underlying enriched alleles. The length of the synthesized probe should be long enough such that two probes designed to hybridize to two different alleles found at one locus will hybridize with near equal affinity to the various alleles in the original sample. Currently, methods known in the art describe probes that are typically longer than 120 bases. In a current embodiment, if the allele is one or a few bases then the capture probes may be less than about 110 bases, less than about 100 bases, less than about 90 bases, less than about 80 bases, less than about 70 bases, less than about 60 bases, less than about 50 bases, less than about 40 bases, less than about 30 bases, and less than about 25 bases, and this is sufficient to ensure equal enrichment from all alleles. When the mixture of DNA that is to be enriched using the hybrid capture technology is a mixture comprising free floating DNA isolated from blood, for example maternal blood, the average length of DNA is quite short, typically less than 200 bases. The use of shorter probes results in a greater chance that the hybrid capture probes will capture desired DNA fragments. Larger variations may require longer probes. In an embodiment, the variations of interest are one (a SNP) to a few bases in length. In an embodiment, targeted regions in the genome can be preferentially enriched using hybrid capture probes wherein the hybrid capture probes are of a length below 90 bases, and can be less than 80 bases, less than 70 bases, less than 60 bases, less than 50 bases, less than 40 bases, less than 30 bases, or less than 25 bases. In an embodiment, to increase the chance that the desired allele is sequenced, the length of the probe that is designed to hybridize to the regions flanking the polymorphic allele location can be decreased from above 90 bases, to about 80 bases, or to about 70 bases, or to about 60 bases, or to about 50 bases, or to about 40 bases, or to about 30 bases, or to about 25 bases.

There is a minimum overlap between the synthesized probe and the target molecule in order to enable capture. This synthesized probe can be made as short as possible while still being larger than this minimum required overlap. The effect of using a shorter probe length to target a polymorphic region is that there will be more molecules that overlap the target allele region. The state of fragmentation of the original DNA molecules also affects the number of reads that will overlap the targeted alleles. Some DNA samples such as plasma samples are already fragmented due to biological processes that take place in vivo. However, samples with longer fragments by benefit from fragmentation prior to sequencing library preparation and enrichment. When both probes and fragments are short (~60-80 bp) maximum specificity may be achieved relatively few sequence reads failing to overlap the critical region of interest.

In an embodiment, the hybridization conditions can be adjusted to maximize uniformity in the capture of different alleles present in the original sample. In an embodiment, hybridization temperatures are decreased to minimize differences in hybridization bias between alleles. Methods known in the art avoid using lower temperatures for hybridization because lowering the temperature has the effect of increasing hybridization of probes to unintended targets. However, when the goal is to preserve allele ratios with maximum fidelity, the approach of using lower hybridization temperatures provides optimally accurate allele ratios, despite the fact that the current art teaches away from this approach. Hybridization temperature can also be increased to require greater overlap between the target and the synthesized probe so that only targets with substantial overlap of the targeted region are captured. In some embodiments of the present disclosure, the hybridization temperature is lowered from the normal hybridization temperature to about 40° C., to about 45° C., to about 50° C., to about 55° C., to about 60° C., to about 65, or to about 70° C.

In an embodiment, the hybrid capture probes can be designed such that the region of the capture probe with DNA that is complementary to the DNA found in regions flanking the polymorphic allele is not immediately adjacent to the polymorphic site. Instead, the capture probe can be designed such that the region of the capture probe that is designed to hybridize to the DNA flanking the polymorphic site of the target is separated from the portion of the capture probe that will be in van der Waals contact with the polymorphic site by a small distance that is equivalent in length to one or a small number of bases. In an embodiment, the hybrid capture probe is designed to hybridize to a region that is flanking the polymorphic allele but does not cross it; this may be termed a flanking capture probe. The length of the flanking capture probe may be less than about 120 bases, less than about 110 bases, less than about 100 bases, less than about 90 bases, and can be less than about 80 bases, less than about 70 bases, less than about 60 bases, less than about 50 bases, less than about 40 bases, less than about 30 bases, or less than about 25 bases. The region of the genome that is targeted by the flanking capture probe may be separated by the polymorphic locus by 1, 2, 3, 4, 5, 6, 7, 8, 9, 10, 11-20, or more than 20 base pairs.

Description of a targeted capture based disease screening test using targeted sequence capture. Custom targeted sequence capture, like those currently offered by AGILENT (SURE SELECT), ROCHE-NIMBLEGEN, or ILLUMINA. Capture probes could be custom designed to ensure capture of various types of mutations. For point mutations, one or more probes that overlap the point mutation should be sufficient to capture and sequence the mutation.

For small insertions or deletions, one or more probes that overlap the mutation may be sufficient to capture and sequence fragments comprising the mutation. Hybridization may be less efficient between the probe-limiting capture efficiency, typically designed to the reference genome sequence. To ensure capture of fragments comprising the mutation one could design two probes, one matching the normal allele and one matching the mutant allele. A longer probe may enhance hybridization. Multiple overlapping probes may enhance capture. Finally, placing a probe immediately adjacent to, but not overlapping, the mutation may permit relatively similar capture efficiency of the normal and mutant alleles.

For Simple Tandem Repeats (STRs), a probe overlapping these highly variable sites is unlikely to capture the fragment well. To enhance capture a probe could be placed adjacent to, but not overlapping the variable site. The fragment could then be sequenced as normal to reveal the length and composition of the STR.

For large deletions, a series of overlapping probes, a common approach currently used in exon capture systems may work. However, with this approach it may be difficult to determine whether or not an individual is heterozygous. Targeting and evaluating SNPs within the captured region could potentially reveal loss of heterozygosity across the region indicating that an individual is a carrier. In an embodiment, it is possible to place non-overlapping or singleton probes across the potentially deleted region and use the number of fragments captured as a measure of heterozygosity. In the case where an individual caries a large deletion, one-half the number of fragments are expected to be available for capture relative to a non-deleted (diploid) reference locus. Consequently, the number of reads obtained from the deleted regions should be roughly half that obtained from a normal diploid locus. Aggregating and averaging the sequencing read depth from multiple singleton probes across the potentially deleted region may enhance the signal and improve confidence of the diagnosis. The two approaches, targeting SNPs to identify loss of heterozygosity and using multiple singleton probes to obtain a quantitative measure of the quantity of underlying fragments from that locus can also be combined. Either or both of these strategies may be combined with other strategies to better obtain the same end.

If during testing cfDNA detection of a male fetus, as indicated by the presence of the Y-chromosome fragments, captured and sequenced in the same test, and either an X-linked dominant mutation where mother and father are unaffected, or a dominant mutation where mother is not affected would indicated heighted risk to the fetus. Detection of two mutant recessive alleles within the same gene in an unaffected mother would imply the fetus had inherited a mutant allele from father and potentially a second mutant allele from mother. In all cases, follow-up testing by amniocentesis or chorionic villus sampling may be indicated.

A targeted capture based disease screening test could be combined with a targeted capture based non-invasive prenatal diagnostic test for aneuploidy.

There are a number of ways to decrease depth of read (DOR) variability: for example, one could increase primer concentrations, one could use longer targeted amplification probes, or one could run more STA cycles (such as more than 25, more than 30, more than 35, or even more than 40) Exemplary Methods of Determining the Number of DNA Molecules in a Sample.

A method is described herein to determine the number of DNA molecules in a sample by generating a uniquely identified molecule for each original DNA molecules in the sample during the first round of DNA amplification. Described here is a procedure to accomplish the above end followed by a single molecule or clonal sequencing method.

The approach entails targeting one or more specific loci and generating a tagged copy of the original molecules such manner that most or all of the tagged molecules from each targeted locus will have a unique tag and can be distinguished from one another upon sequencing of this barcode using clonal or single molecule sequencing. Each unique sequenced barcode represents a unique molecule in the original sample. Simultaneously, sequencing data is used to ascertain the locus from which the molecule originates. Using this information one can determine the number of unique molecules in the original sample for each locus.

This method can be used for any application in which quantitative evaluation of the number of molecules in an original sample is required. Furthermore, the number of unique molecules of one or more targets can be related to the number of unique molecules to one or more other targets to determine the relative copy number, allele distribution, or allele ratio. Alternatively, the number of copies detected from various targets can be modeled by a distribution in order to identify the mostly likely number of copies of the original targets. Applications include but are not limited to detection of insertions and deletions such as those found in carriers of Duchenne Muscular Dystrophy; quantitation of deletions or duplications segments of chromosomes such as those observed in copy number variants; chromosome copy number of samples from born individuals; chromosome copy number of samples from unborn individuals such as embryos or fetuses.

The method can be combined with simultaneous evaluation of variations contained in the targeted by sequence. This can be used to determine the number of molecules representing each allele in the original sample. This copy number method can be combined with the evaluation of SNPs or other sequence variations to determine the chromosome copy number of born and unborn individuals; the discrimination and quantification of copies from loci which have short sequence variations, but in which PCR may amplifies from multiple target regions such as in carrier detection of Spinal Muscle Atrophy; determination of copy number of different sources of molecules from samples consisting of mixtures of different individual such as in detection of fetal aneuploidy from free floating DNA obtained from maternal plasma.

In an embodiment, the method as it pertains to a single target locus may comprise one or more of the following steps: (1) Designing a standard pair of oligomers for PCR amplification of a specific locus. (2) Adding, during synthesis, a sequence of specified bases with no or minimal complementarity to the target locus or genome to the 5' end of the one of the target specific oligomer. This sequence, termed the tail, is a known sequence, to be used for subsequent amplification, followed by a sequence of random nucleotides. These random nucleotides comprise the random region. The random region comprises a randomly generated sequence of nucleic acids that probabilistically differ between each probe molecule. Consequently, following synthesis, the tailed oligomer pool will consists of a collection of oligomers beginning with a known sequence followed by unknown sequence that differs between molecules, followed by the target specific sequence. (3) Performing one round of amplification (denaturation, annealing, extension) using only the tailed oligomer. (4) Adding exonuclease to the reaction, effectively stopping the PCR reaction, and incubating the reaction at the appropriate temperature to remove forward single stranded oligos that did not anneal to temple and extend to form a double stranded product. (5) Incubating the reaction at a high temperature to denature the exonuclease and eliminate its activity. (6) Adding to the reaction a new oligonucleotide that is complementary to tail of the oligomer used in the first reaction along with the other target specific oligomer to enable PCR amplification of the product generated in the first round of PCR. (7) Continuing amplification to generate enough product for downstream clonal sequencing. (8) Measuring the amplified PCR product by a multitude of methods, for example, clonal sequencing, to a sufficient number of bases to span the sequence.

In an embodiment, a method of the present disclosure involves targeting multiple loci in parallel or otherwise. Primers to different target loci can be generated independently and mixed to create multiplex PCR pools. In an embodiment, original samples can be divided into subpools and different loci can be targeted in each sub-pool before being recombined and sequenced. In an embodiment, the tagging step and a number of amplification cycles may be performed before the pool is subdivided to ensure efficient targeting of all targets before splitting, and improving subsequent amplification by continuing amplification using smaller sets of primers in subdivided pools.

One example of an application where this technology would be particularly useful is non-invasive prenatal aneuploidy diagnosis where the ratio of alleles at a given locus or a distribution of alleles at a number of loci can be used to help determine the number of copies of a chromosome present in a fetus. In this context, it is desirable to amplify the DNA present in the initial sample while maintaining the relative amounts of the various alleles. In some circumstances, especially in cases where there is a very small amount of DNA, for example, fewer than 5,000 copies of the genome, fewer than 1,000 copies of the genome, fewer than 500 copies of the genome, and fewer than 100 copies of the genome, one can encounter a phenomenon called bottle-necking. This is where there are a small number of copies of any given allele in the initial sample, and amplification biases can result in the amplified pool of DNA having significantly different ratios of those alleles than are in the initial mixture of DNA. By applying a unique or nearly unique set of barcodes to each strand of DNA before standard PCR amplification, it is possible to exclude n−1 copies of DNA from a set of n identical molecules of sequenced DNA that originated from the same original molecule.

For example, imagine a heterozygous SNP in the genome of an individual, and a mixture of DNA from the individual where ten molecules of each allele are present in the original sample of DNA. After amplification there may be 100,000 molecules of DNA corresponding to that locus. Due to stochastic processes, the ratio of DNA could be anywhere from 1:2 to 2:1, however, since each of the original molecules was tagged with a unique tag, it would be possible to determine that the DNA in the amplified pool originated from exactly 10 molecules of DNA from each allele. This method would therefore give a more accurate measure of the relative amounts of each allele than a method not using this approach. For methods where it is desirable for the relative amount of allele bias to be minimized, this method will provide more accurate data.

Association of the sequenced fragment to the target locus can be achieved in a number of ways. In an embodiment, a sequence of sufficient length is obtained from the targeted fragment to span the molecule barcode as well a sufficient number of unique bases corresponding to the target sequence to allow unambiguous identification of the target locus. In another embodiment, the molecular bar-coding primer that contains the randomly generated molecular barcode can also contain a locus specific barcode (locus barcode) that identifies the target to which it is to be associated. This locus barcode would be identical among all molecular bar-coding primers for each individual target and hence all resulting amplicons, but different from all other targets. In an embodiment, the tagging method described herein may be combined with a one-sided nesting protocol.

In an embodiment, the design and generation of molecular barcoding primers may be reduced to practice as follows: the molecular barcoding primers may consist of a sequence that is not complementary to the target sequence followed by random molecular barcode region followed by a target specific sequence. The sequence 5' of molecular barcode may be used for subsequence PCR amplification and may comprise sequences useful in the conversion of the amplicon to a library for sequencing. The random molecular barcode sequence could be generated in a multitude of ways. The preferred method synthesize the molecule tagging primer in such a way as to include all four bases to the reaction during synthesis of the barcode region. All or various combinations of bases may be specified using the IUPAC DNA ambiguity codes. In this manner the synthesized collection of molecules will contain a random mixture of sequences in the molecular barcode region. The length of the barcode region will determine how many primers will contain unique barcodes. The number of unique sequences is related to the length of the barcode region as $N^L$ where N is the number of bases, typically 4, and L is the length of the barcode. A barcode of five bases can yield up to 1024 unique sequences; a barcode of eight bases can yield 65536 unique barcodes. In an embodiment, the DNA can be measured by a sequencing method, where the sequence data represents the sequence of a single molecule. This can include methods in which single molecules are sequenced directly or methods in which single molecules are amplified to form clones detectable by the sequence instrument, but that still represent single molecules, herein called clonal sequencing.

Exemplary Methods and Reagents for Quantification of Amplification Products

Quantitation of specific nucleic acid sequences of interest is typically done by quantitative real-time PCR techniques such as TAQMAN (LIFE TECHNOLOGIES), INVADER probes (THIRD WAVE TECHNOLOGIES), and the like. Such techniques suffer from numerous shortcomings such as limited ability to achieve the simultaneous analysis of multiple sequences in parallel (multiplexation) and the ability to provide accurate quantitative data for only a narrow range of possible amplification cycles (e.g., when the logarithm of PCR amplification production quantity versus the number of cycles is in the linear range). DNA sequencing techniques, particularly high throughput next-generation sequencing techniques (often referred to as massively parallel sequencing techniques) such as those employed in MYSEQ (ILLUMINA), HISEQ (ILLUMINA), ION TORRENT (LIFE TECHNOLOGIES), GENOME ANALYZER ILX (ILLUMINA), GS FLEX+ (ROCHE 454) etc., can be used for by quantitative measurements of the number of copies of sequence of interest present in sample, thereby providing quantitative information about the starting materials, e.g., copy number or transcription levels. High throughput genetic sequencers are amenable to the use of bar coding (i.e., sample tagging with distinctive nucleic acid sequences) so as to identify specific samples from individuals thereby permitting the simultaneous analysis of multiple samples in a single run of the DNA sequencer. The number of times a given region of the genome in a library preparation (or other nucleic preparation of interest) is sequenced (number of reads) will be proportional to the number of copies of that sequence in the genome of interest (or expression level in the case of cDNA containing preparations). However, the preparation and sequencing of genetic libraries (and similar genome derived preparations) can introduce numerous biases that interfere with obtaining an accurate quantitative reading for the nucleic acid sequence of interest. For example, different nucleic acid sequences can amplify with different efficiencies during nucleic amplification steps that take place during the genetic library preparation or sample preparation.

The problem with differential amplification efficiencies can be mitigated by using certain embodiments of the subject invention. The subject invention includes various methods and compositions that relate to the use of standards for inclusion in amplification processes that can be used to improve the accuracy of quantitation. The invention is of use in, among other areas, the detection of aneuploidy in a fetus by analyzing free floating fetal DNA in maternal blood, as described herein and as described, among other places, U.S. Pat. Nos. 8,008,018; 7,332,277; PCT Published Application WO 2012/078792A2; and PCT Published Application WO 2011/146632 A1, which are each herein incorporated by reference in its entirety Embodiments of the invention are also of use in the detection of aneuploidy in an in vitro generated embryos. Commercially significant aneuploidies that may be detected include aneuploidy of the human chromosomes 13, 18, 21, X and Y.

Embodiments of the invention may be used with either human or non-human nucleic acids, and may be applied to both animal and plant derived nucleic acids. Embodiments of the invention may also be used to detect and/or quantitate alleles for other genetic disorders characterized by deletions or insertions. The deletion containing alleles can be detected in suspected carriers of the allele of interest.

One embodiment of the subject invention includes standards that are present in a known quantity (relative or absolute). For example, consider a genetic library made from a genetic source that is diploid for chromosome 8 (containing locus A) and triploid for chromosome 21 (containing locus B). A genetic library can be produced from this sample that will contain sequences in quantities that are a function of the number of chromosomes present in the sample, e.g., 200 copies of locus A and 300 copies of locus B. However, if locus A amplifies much more efficiently than locus B, after PCR there may be 60,000 copies of the A amplicon and 30,000 copies of the B amplicon, thus obscuring the true chromosomal copy number of the initial genomic sample when analysis by high throughput DNA sequencing (or other quantitative nucleic acid detection techniques). To mitigate this problem a standard sequence for locus A is employed, wherein the standard sequence amplifies with essentially the same efficiency as locus A. Similarly, a standard sequence for locus B is created, wherein the standard sequence amplifies with the essentially the same efficiency as locus B. A standard sequence of locus A and a standard sequence for locus B are added to the mixture prior to PCR (or other amplification techniques). These standard sequences are present in known quantities, either relative quantities or absolute quantities. Thus if a 1:1 mixture of standard sequence A and standard sequence B were added (prior to amplification) to the mixture in the previous example, 3000 copies of the standard A amplicon would be produced and 1000 copies of the standard B amplicon would be produced, showing that locus A is amplified 3 times more efficiently than locus B, under the same set of conditions.

In various embodiments one or more selected regions of a genome containing a SNP (or other polymorphism) of interest can be specifically amplified and subsequently sequenced. This target specific amplification can take place during the formation of a genetic library for sequencing. The library can contain numerous targeted regions for amplification. In some embodiments at least 10; 100, 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 regions of interest. Examples of such libraries are described herein and can be found in U.S. Patent Application No. 2012/0270212, filed Nov. 18, 2011, which is herein incorporated by reference in its entirety.

Many high throughput DNA sequencing techniques require the modification of the genetic starting material, e.g., the litigation of universal priming sites and/or barcodes, so as to form libraries to facilitate the clonal amplification of small nucleic acid fragments prior to performing subsequent sequencing reactions. In some embodiments, one or more standard sequences are added during genetic library formation or added to a precursor component of a genetic library prior to amplification of the library. The standard sequences can be selected so as to mimic (yet be distinguishable based on nucleotide base sequence) target genomic fragments to be prepared for sequencing by a high throughput genetic sequencing technique. In one embodiment, the standard sequence can be identical to the target genomic fragment excepting one, two, three, four to ten, or eleven to twenty nucleotides. In some embodiments, when the target genetic sequence contains a SNP, the standard sequence can be identical to the SNP excepting the nucleotide at the polymorphic base, which may be chosen to be one of the four nucleotides that is not observed at that location in nature. The standard sequences can be used in a highly multiplexed analysis of multiple target loci (such as polymorphic loci). Standard sequences can be added during the process of library formation (prior to amplification) in known quantities (relative or absolute) so as to provide a standard metric for greater accuracy in determining the amount of target sequence of interest in the sample of analysis. The combination of knowledge of the known quantities of the standard sequences used in conjunction with the knowledge of the ploidy level formation of library for sequencing formed from a genome of previously characterized ploidy level, e.g., known to be diploid for all autosomal chromosomes, can be used to calibrate the amplification properties of each standard sequence with respect to its corresponding target sequence and account for variations between batches of mixtures comprising multiple standard sequences. Given that it is often necessary to simultaneously analyze a large number of loci, it is useful to produce a mixture comprising a large set standard sequences. Embodiments of the invention include mixtures comprising multiple standard sequences. Ideally the amount of each standard sequence in the mixture is known with high precision. However, it is extremely difficult to achieve this ideal because as a practical matter there is a significant amount of variation in the quantity of each standard sequence in the mixture, particularly for mixtures comprising a large number of different synthetic oligonucleotides. This variation has numerous sources, e.g., variations in in vitro oligonucleotide synthesis reaction efficiencies between batch, inaccuracies in volume measurement, variations in pipetting, Furthermore, this variation can occur between different batches of that theoretically contain the exact same set of standard sequences in the exact same amounts. Accordingly, it is of interest to calibrate each batch of standard sequences independently. Batches of standard sequences can be calibrated against reference genomes of known chromosomal composition. Batched of standard sequences can be calibrated by sequencing the batch of standard sequences with minimal or no amplifications steps included in the sequencing protocol. Embodiments of the invention include calibrated mixtures of different standard sequences. Other embodiments of the invention include methods of calibrating mixtures of different standard sequences and calibrated mixtures of different standard sequences made by the subject methods.

Various embodiments of the subject mixtures of standard sequences and methods for using them can comprise at least 10; 100, 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 or more standards sequences, as well as various intermediate amounts. The number of the standard sequences can be the same as the number of target sequences selected for analysis during the generation of a targeted library for DNA sequencing. However, in some embodiments, it may be advantageous to use a lower number of standard sequences than the number of targeted regions in the library being constructed. It may be advantageous to use the lower number so as avoid coming up against the limits of the sequencing capacity of the high throughput DNA sequencer being employed. The number of standard sequences can be 50% or less than the number of targeted regions, 40% or less than the number of targeted regions, be 30% or less than the number of targeted regions, 20% or less than the number of targeted regions, be 10% or less than the number of targeted regions, 5% or less than the number of targeted regions, 1% or less than the number of targeted regions, as well as various intermediate values. For example, if a genetic library is created using 15,000 pairs of primers targeted to specific SNP containing loci, a suitable a mixture containing 1500 standard sequences corresponding to 1500 of the 15,000 targeted loci can be added prior to the amplification step of library constructions.

The amount of standard sequences added during library construction can vary considerably among different embodiments. In some embodiments, the amount of each standard sequence can be approximately the same as the predicted amount of the target sequence present in the genomic material sample used for library preparation. In other embodiments, the amount of each standard sequence can be greater or less than the predicted amount of the target sequence present in the genomic material sample used for library preparation. While the initial relative amounts of the target sequence and the standard sequence are not critical for the function of the invention, it is preferable that the amount be within the range 100 times greater to 100 times less than the amount of the target sequence present in the genomic material sample used for library preparation. Excessive amounts of standard may use too much sequencing capacity of the DNA sequencer in a given run of the instrument. Using too low an amount of standard sequences will produce insufficient data to aid in the analysis of variation in amplification efficiency.

The standard sequences may be selected to be very similar in nucleotide base sequence to the amplified regions of interest; preferably the standard sequence has the exact same primer-binding sites as the analyzed genomic region, i.e., the "target sequence." The standard sequence must be distinguishable from the corresponding target sequence at a given locus. For the sake of convenience, this distinguishable region of the standard sequence will be referred to as a "marker sequence." In some embodiments, the marker sequence region of the target sequences contains the polymorphic region, e.g., a SNP, and can be flanked on both sides by primer binding regions. The standard sequence may be selected to closely match the GC content of the corresponding target sequence. In some embodiments, the primer binding regions of the standard sequence are flanked by universal priming sites. These universal priming sites are selected to match universal priming sites used in a genomic library for analysis. In other embodiments, the standard sequences do not have universal priming sites and the universal priming sites are added during the creation of a library. Standard sequences are typically provided in single stranded form. A standard sequence is defined with respect to a corresponding target sequence and the sequence specific reagents used to amplify the target sequence. In some embodiments, the target sequence contains the polymorphism of interest, e.g., a SNP, a deletion, or insertion, present in the nucleic acid sample for analysis. The standard sequence is a synthetic polynucleotide that is similar in nucleotide base sequence to the target sequence, but is nonetheless distinguishable from the target sequence by virtue of at least one nucleotide base difference, thereby providing a mechanism for distinguishing amplicon sequences derived from the standard sequence form amplicon sequences derived from the target sequence. Standard sequences are selected so as to have essentially the same amplification properties as the corresponding target sequence when amplified with the same set of amplification reagents, e.g., PCR primers. In some embodiments, the standard sequences can have the same primer sequence binding sites than the corresponding target sequences. In other embodiments, the standard sequences can have a different primer sequence binding sites than the corresponding target sequences. In some embodiments, the standard sequences can be selected to produce amplicons that have the same length as the length of amplicons produced from the corresponding target sequences. In other embodiments, the standard sequences can be selected to produce amplicons that have the slightly different lengths than the length of amplicons produced from the corresponding target sequences.

After the amplification reactions have been completed, the library is sequenced on a high throughput DNA sequencer where individual molecule are clonally amplified and sequenced. The number of sequence reads for each allele of the target sequence is counted, also counted are the number of sequence reads for the standard sequence corresponding to the target sequence. The process is also carried out for at least one other pair of target sequences and corresponding standard sequences. Consider for example, locus A, $X_{A1}$ reads for allele 1 of locus A are produced; $X_{A2}$ reads for allele 2 of locus A are produced, and $X_{AC}$ reads for standard sequence A are produced. The ratio of ($X_{A1}$ plus $X_{A2}$) to $X_{AC}$ is determined for each locus of interest. As discussed earlier, the process can be performed on a reference genome, e.g., a genome that is known to be diploid for all chromosomes. The process can be repeated many times in order to provide a large number of read values so as to determine a mean number of reads and the standard deviation in the number of reads. The process is performed with a mixture comprising a large number of different standard sequences corresponding to different loci. By assuming that (1) $X_{A1}$ plus $X_{A2}$ corresponds to the known number of chromosome, e.g., 2 for the normal human female genome and (2) the standard sequences have similar amplification (and detectability) properties as their corresponding natural loci, the relative amounts of the different standard sequences in the multiplex standard mixture can be determined. The calibrated multiplex standard sequence mixture can then be used to adjust for the variability in amplification efficiency between the different loci in a multiplex amplification reaction.

Other embodiments of the invention include methods and compositions for measuring the copy number of specific genes of interest, including duplications and mutant genes characterized by large deletions that would interfere with quantitation by sequencing. Sequencing would have problems detecting alleles having such deletions. Standard sequences included the amplification process can be used to reduce this problem.

In one embodiment of the invention the target sequence for analysis is a gene having a wild type (i.e. functional) form and a mutant form characterized by a deletion. Exemplary of such genes is SMN1, an allele having deletion being responsible for the genetic disease spinal muscular atrophy (SMA). It is of interest to detect an individual carrying the mutant form of the gene by means of high throughput genetic sequencing techniques. The application of such techniques to the detection of deletion mutations can be problematic because, among other reasons, the lack of sequences observed in sequencing (as opposed to detecting a simple point mutation or SNP). Such embodiments employ (1) a pair of amplification primers specific for the gene of interest, where in the amplification primers will amplify the gene of interest (or a portion thereof) and will not significantly amplify the mutant allele, (2) a standard sequence corresponding to the wild type allele of the gene of interest (i.e., a target sequence), but differing by at least one detectable nucleotide base, (3) a pair of amplification primers specific for a second target sequence that serves as a reference sequence, and (4) a standard sequence corresponding to the reference sequence.

In one embodiment of the invention is provided a method for measuring the number of copies of the gene of interest, where in the gene of interest has one meaning allele that comprises a deletion. The method can employ amplification reagent specific for the gene of interest, e.g., PCR primers, that are specific for the gene of interest by amplifying at least a portion of the gene of interest, or the entire gene of interest, or a region adjacent to the gene of interest, while not amplifying the deletion comprising allele of the gene of interest. Additionally the subject method employs a standard sequence corresponding to the gene of interest, wherein the standard sequence differs by at least one nucleotide base from the gene of interest (so that the sequence of the standard sequence can be readily distinguished from the naturally occurring gene of interest). Typically, the standard sequence will contain the same primer binding sites as the gene of interest so as to minimize any amplification discrimination between the gene of interest and the standard sequence corresponding to the gene of interest. The reaction will also comprises amplification reagents specific for a reference sequence. The reference sequence is a sequence of known (or at least assumed to be known) copy number in the genome to be analyzed. The reaction further comprises a standard sequence corresponding to the reference sequence. Typically, the standard sequence corresponding to the reference sequence will contain the same primer binding sites as the reference sequence so as to minimize any amplification discrimination between the reference sequence and the standard sequence corresponding to the reference sequence.

Exemplary PCR Conditions

If desired, any of the PCR conditions disclosed herein or any standard PCR conditions can be used to test a primer library to determine, e.g., the percent of primer dimers, percent of target amplicons, and percent of target loci that are amplified. If desired, standard methods can be used to optimize the reaction conditions to improve the performance of a primer library. Any of these PCR conditions may also be used in any of the methods of the invention to amplify target loci. It was determined that high ionic strength solutions can surprisingly be used for multiplex PCR. In some embodiments, monovalent cations are used to increase the ionic strength to, e.g., help the primers bind the template.

In some embodiments, the reaction volume includes ethylenediaminetetraacetic acid (EDTA), magnesium, tetramethyl ammonium chloride (TMAC), or any combination thereof. In some embodiments, the concentration of TMAC is between 20 and 80 mM, such as between 25 and 70 mM, 30 and 60 mM, 30 and 40 mM, 40 and 50 mM, 50 and 60 mM, or 60 and 70 mM, inclusive. While not meant to be bound to any particular theory, it is believed that TMAC binds to DNA, stabilizes duplexes, increases primer specificity, and/or equalizes the melting temperatures of different primers. In some embodiments, TMAC increases the uniformity in the amount of amplified products for the different targets. In some embodiments, the concentration of magnesium (such as magnesium from magnesium chloride) is between 1 and 10 mM, such as between 1 and 8 mM, 1 and 5 mM, 1 and 3 mM, 3 and 5 mM, 3 and 6 mM, or 5 and 8 mM, inclusive.

In some embodiments, the concentration of available magnesium (the concentration of magnesium that is assumed to be available for binding the polymerase and not bound to molecules other than the polymerase), such as the magnesium that is not bound by phosphate groups on dNTPs, primers, or nucleic acid templates, or carboxylic acid groups on magnetic or other beads, if present) is between 0.5 to 10 mM, such as between 1 and 8 mM, 1 and 5 mM, 1 and 3 mM, 3 and 5 mM, 3 and 6 mM, 4 and 6 mM, or 5 and 8 mM, inclusive. The large number of primers used for multiplex PCR of a large number of targets may chelate a lot of the magnesium (2 phosphates in the primers chelate 1 magnesium). For example, if enough primers are used such that the concentration of phosphate from the primers is ~9 mM, then the primers may reduce the effective magnesium concentration by ~4.5 mM. In some embodiments, EDTA is used to decrease the amount of magnesium available as a cofactor for the polymerase since high concentrations of magnesium can result in PCR errors, such as amplification of non-target loci. In some embodiments, the concentration of EDTA reduces the amount of available magnesium to between 1 and 5 mM (such as between 3 and 5 mM).

In some embodiments, the pH is between 7.5 and 8.5, such as between 7.5 and 8, 8 and 8.3, or 8.3 and 8.5, inclusive. In some embodiments, Tris is used at, for example, a concentration of between 10 and 100 mM, such as between 10 and 25 mM, 25 and 50 mM, 50 and 75 mM, or 25 and 75 mM, inclusive. In some embodiments, any of these concentrations of Tris are used at a pH between 7.5 and 8.5. In some embodiments, a combination of KCl and $(NH_4)_2SO_4$ is used, such as between 50 and 150 mM KCl and between 10 and 90 mM $(NH_4)_2SO_4$, inclusive. In some embodiments, the concentration of KCl is between 0 and 30 mM, between 50 and 100 mM, or between 100 and 150 mM, inclusive. In some embodiments, the concentration of $(NH_4)_2SO_4$ is between 10 and 50 mM, 50 and 90 mM, 10 and 20 mM, 20 and 40 mM, 40 mM and 60, or 60 mM and 80 mM $(NH_4)_2SO_4$, inclusive. In some embodiments, the ammonium $[NH_4^+]$ concentration is between 0 and 160 mM, such as between 0 to 50, 50 to 100, or 100 to 160 mM, inclusive. In some embodiments, the sum of the potassium and ammonium concentration ($[K^+]+[NH_4^+]$) is between 0 and 160 mM, such as between 0 to 25, 25 to 50, 50 to 150, 50 to 75, 75 to 100, 100 to 125, or 125 to 160 mM, inclusive. An exemplary buffer with $[K^+]+[NH_4^+]=120$ mM is 20 mM KCl and 50 mM $(NH_4)_2SO_4$. In some embodiments, the buffer includes 25 to 75 mM Tris, pH 7.2 to 8, 0 to 50 mM KCL, 10 to 80 mM ammonium sulfate, and 3 to 6 mM magnesium, inclusive. In some embodiments, the buffer includes 25 to 75 mM Tris pH 7 to 8.5, 3 to 6 mM MgCl$_2$, 10 to 50 mM KCl, and 20 to 80 mM (NH$_4$)$_2$SO$_4$, inclusive. In some embodiments, 100 to 200 Units/mL of polymerase are used. In some embodiments, 100 mM KCl, 50 mM (NH$_4$)$_2$SO$_4$, 3 mM MgCl$_2$, 7.5 nM of each primer in the library, 50 mM TMAC, and 7 ul DNA template in a 20 ul final volume at pH 8.1 is used.

In some embodiments, a crowding agent is used, such as polyethylene glycol (PEG, such as PEG 8,000) or glycerol. In some embodiments, the amount of PEG (such as PEG 8,000) is between 0.1 to 20%, such as between 0.5 to 15%, 1 to 10%, 2 to 8%, or 4 to 8%, inclusive. In some embodiments, the amount of glycerol is between 0.1 to 20%, such as between 0.5 to 15%, 1 to 10%, 2 to 8%, or 4 to 8%, inclusive. In some embodiments, a crowding agent allows either a low polymerase concentration and/or a shorter annealing time to be used. In some embodiments, a crowding agent improves the uniformity of the DOR and/or reduces dropouts (undetected alleles). For example, at 8% PEG, and 50 U/mL polymerase, the uniformity was as good as 150 U/mL polymerase and no PEG. If the error rate increases when PEG is included, a higher magnesium chloride concentration (such greater than or about 4, 5, 6, 7, 8, 9, or 10 MgCl$_2$) can be used to reduce or prevent the increase in error rate. Inclusion of 8% PEG 8,000 allowed successful multiplexing with an annealing time of only 1 minute at an annealing temperature of 63° C.

In some embodiments, a polymerase with proof-reading activity, a polymerase without (or with negligible) proof-reading activity, or a mixture of a polymerase with proof-reading activity and a polymerase without (or with negligible) proof-reading activity is used. In some embodiments, a hot start polymerase, a non-hot start polymerase, or a mixture of a hot start polymerase and a non-hot start polymerase is used. In some embodiments, a HotStarTaq DNA polymerase is used (see, for example, QIAGEN catalog No. 203203, see, e.g., information available at the World Wide Web at qiagen.com/us/products/catalog/assay-technologies/end-point-pcr-and-rt-pcr-reagents/hotstartaq-dna-polymerase/, which is hereby incorporated by reference in its entirety). In some embodiments, AmpliTaq Gold® DNA Polymerase is used; it is a chemically modified form of AmpliTaq® DNA Polymerase requiring thermal activation (see, for example, Applied Biosystems catalog No. N8080241 see, e.g., information available at the World Wide Web at lifetechnologies.com/order/catalog/product/N8080241, which is hereby incorporated by reference in its entirety). In some embodiments, KAPA Taq DNA Polymerase or KAPA Taq HotStart DNA Polymerase is used; they are based on the single-subunit, wild-type Taq DNA polymerase of the thermophilic bacterium *Thermus aquaticus*. KAPA Taq and KAPA Taq HotStart DNA Polymerase have 5'-3' polymerase and 5'-3' exonuclease activities, but no 3' to 5' exonuclease (proofreading) activity (see, for example, KAPA BIOSYSTEMS catalog No._BK1000 see, e.g., information available at the World Wide Web at kapabiosystems.com/product-applications/products/pcr-2/kapa-taq-pcr-kits/, which is hereby incorporated by reference in its entirety). In some embodiments, Pfu DNA polymerase is used; it is a highly thermostable DNA polymerase from the hyperthermophilic archaeum *Pyrococcus furiosus*. The enzyme catalyzes the template-dependent polymerization of nucleotides into duplex DNA in the 5'→3' direction. Pfu DNA Polymerase also exhibits 3'→5' exonuclease (proofreading) activity that enables the polymerase to correct nucleotide incorporation errors. It has no 5'→3' exonuclease activity (see, for example, Thermo Scientific catalog No._EP0501 see, e.g., information available at the World Wide Web at thermoscientificbio.com/pcr-enzymes-master-mixes-and-reagents/pfu-dna-polymerase/, which is hereby incorporated by reference in its entirety). In some embodiments Klentaq1 is used; it is a Klenow-fragment analog of Taq DNA polymerase, it has no exonuclease or endonuclease activity (see, for example, DNA POLYMERASE TECHNOLOGY, Inc, St. Louis, Missouri, catalog No._100 see, e.g., information available at the World Wide Web at klentaq.com/products/klentaq, which is hereby incorporated by reference in its entirety). In some embodiments, the polymerase is a PUSHION DNA polymerase, such as PHUSION High Fidelity DNA polymerase (M0530S, New England BioLabs, Inc.) or PHUSION Hot Start Flex DNA polymerase (M0535S, New England BioLabs, Inc.; Frey and Suppman *BioChemica*. 2:34-35, 1995; Chester and Marshak *Analytical Biochemistry*. 209:284-290, 1993, which are each hereby incorporated by reference in its entirety). In some embodiments, the polymerase is a Q5® DNA Polymerase, such as Q5® High-Fidelity DNA Polymerase (M0491S, New England BioLabs, Inc.) or Q5® Hot Start High-Fidelity DNA Polymerase (M0493S, New England BioLabs, Inc.). In some embodiments, the polymerase is a T4 DNA polymerase (M0203S, New England BioLabs, Inc.; Tabor and Struh. (1989). "DNA-Dependent DNA Polymerases," In Ausebel et al. (Ed.), *Current Protocols in Molecular Biology*. 3.5.10-3.5.12. New York: John Wiley & Sons, Inc., 1989; Sambrook et al. *Molecular Cloning: A Laboratory Manual*. (2nd ed.), 5.44-5.47. Cold Spring Harbor: Cold Spring Harbor Laboratory Press, 1989, which are each hereby incorporated by reference in its entirety).

In some embodiment, between 5 and 600 Units/mL (Units per 1 mL of reaction volume) of polymerase is used, such as between 5 to 100, 100 to 200, 200 to 300, 300 to 400, 400 to 500, or 500 to 600 Units/mL, inclusive. One unit is commonly defined as the amount of enzyme that will incorporate 15 nmol of dNTP into acid-insoluble material in 30 minutes at 75° C. Exemplary assay conditions for measuring unit activity include 1× THERMOPOL Reaction Buffer, 200 µM dNTPs including [$^3$H]-dTTP and 200 µg/ml activated Calf Thymus DNA (see, e.g., information available at the world wide web at neb.com/products/m0267-taq-dna-polymerase-with-thermopol-buffer, which is hereby incorporated by reference in its entirety). 1× THERMOPOL® Reaction Buffer contains 20 mM Tris-HCl, 10 mM (NH$_4$)$_2$SO$_4$, 10 mM KCl, 2 mM MgSO$_4$, and 0.1% TRITON® X-100, pH 8.8.

In some embodiments, hot-start PCR is used to reduce or prevent polymerization prior to PCR thermocycling. Exemplary hot-start PCR methods include initial inhibition of the DNA polymerase, or physical separation of reaction components reaction until the reaction mixture reaches the higher temperatures. In some embodiments, the enzyme is spatially separated from the reaction mixture by wax that melts when the reaction reaches high temperature. In some embodiments, slow release of magnesium is used. DNA polymerase requires magnesium ions for activity, so the magnesium is chemically separated from the reaction by binding to a chemical compound, and is released into the solution only at high temperature. In some embodiments, non-covalent binding of an inhibitor is used. In this method a peptide, antibody, or aptamer are non-covalently bound to the enzyme at low temperature and inhibit its activity. After incubation at elevated temperature, the inhibitor is released and the reaction starts. In some embodiments, a cold-sensitive Taq polymerase is used, such as a modified DNA polymerase with almost no activity at low temperature. In some embodiments, chemical modification is used. In this method, a molecule is covalently bound to the side chain of an amino acid in the active site of the DNA polymerase. The molecule is released from the enzyme by incubation of the reaction mixture at elevated temperature. Once the molecule is released, the enzyme is activated.

In some embodiments, the amount to template nucleic acids (such as an RNA or DNA sample) is between 20 and 5,000 ng, such as between 20 to 200, 200 to 400, 400 to 600, 600 to 1,000; 1,000 to 1,500; or 2,000 to 3,000 ng, inclusive.

In some embodiments QIAGEN Multiplex PCR Kit is used (QIAGEN catalog No. 206143; see, e.g., information available at the World Wide Web at qiagen.com/products/catalog/assay-technologies/end-point-pcr-and-rt-pcr-reagents/qiagen-multiplex-pcr-kit, which is hereby incorporated by reference in its entirety). For 100×50 µl multiplex PCR reactions, the kit includes 2× QIAGEN Multiplex PCR Master Mix (providing a final concentration of 3 mM $MgCl_2$, 3×0.85 ml), 5× Q-Solution (1×2.0 ml), and RNase-Free Water (2×1.7 ml). The QIAGEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by HotStarTaq DNA Polymerase. HotStarTaq DNA Polymerase is a modified form of Taq DNA polymerase and has no polymerase activity at ambient temperatures. In some embodiments, HotStarTaq DNA Polymerase is activated by a 15-minute incubation at 95° C. which can be incorporated into any existing thermal-cycler program.

In some embodiments, 1× QIAGEN MM final concentration (the recommended concentration), 7.5 nM of each primer in the library, 50 mM TMAC, and 7 ul DNA template in a 20 ul final volume is used. In some embodiments, the PCR thermocycling conditions include 95° C. for 10 minutes (hot start); 20 cycles of 96° C. for 30 seconds; 65° C. for 15 minutes; and 72° C. for 30 seconds; followed by 72° C. for 2 minutes (final extension); and then a 4° C. hold.

In some embodiments, 2× QIAGEN MM final concentration (twice the recommended concentration), 2 nM of each primer in the library, 70 mM TMAC, and 7 ul DNA template in a 20 ul total volume is used. In some embodiments, up to 4 mM EDTA is also included. In some embodiments, the PCR thermocycling conditions include 95° C. for 10 minutes (hot start); 25 cycles of 96° C. for 30 seconds; 65° C. for 20 minutes; and 72° C. for 30 seconds); followed by 72° C. for 2 minutes (final extension); and then a 4° C. hold.

Another exemplary set of PCR thermocycling conditions includes 95° C. for 10 minutes, 15 cycles of 95° C. for 30 seconds, 65° C. for 1 minute, 60° C. for 5 minutes, 65° C. for 5 minutes and 72° C. for 30 seconds; and then 72° C. for 2 minutes. In some embodiments, this set of PCR thermocyling conditions is used with the following reaction conditions: 100 mM KCl, 50 mM $(NH_4)_2SO_4$, 3 mM $MgCl_2$, 7.5 nM of each primer in the library, 50 mM TMAC, and 7 ul DNA template in a 20 ul final volume at pH 8.1.

Another exemplary set of conditions includes a seminested PCR approach. The first PCR reaction uses 20 ul a reaction volume with 2× QIAGEN MM final concentration, 1.875 nM of each primer in the library (outer forward and reverse primers), and DNA template. Thermocycling parameters include 95° C. for 10 minutes; 25 cycles of 96° C. for 30 seconds, 65° C. for 1 minute, 58° C. for 6 minutes, 60° C. for 8 minutes, 65° C. for 4 minutes, and 72° C. for 30 seconds; and then 72° C. for 2 minutes, and then a 4° C. hold. Next, 2 ul of the resulting product, diluted 1:200, is as input in a second PCR reaction. This reaction uses a 10 ul reaction volume with 1× QIAGEN MM final concentration, 20 nM of each inner forward primer, and 1 uM of reverse primer tag. Thermocycling parameters include 95° C. for 10 minutes; 15 cycles of 9°5 C for 30 seconds, 65° C. for 1 minute, 60° C. for 5 minutes, 65° C. for 5 minutes, and 72° C. for 30 seconds; and then 72° C. for 2 minutes, and then a 4° C. hold.

Any of the methods disclosed herein or any standard methods can be used to test a primer library to determine, e.g., the percent of primer dimers, percent of target amplicons, and percent of target loci that are amplified. In some embodiments, the PCR products are sequenced as described in Example 15 or using standard sequencing methods. In some embodiments, the percentage of primer dimers can be determined by measuring the number of sequencing reads from primer dimers, the percentage of amplified products that are target amplicons can be determined by measuring the number of sequencing reads that map to target loci; the percent of target loci that are amplified can be determined by measuring the number of target loci for which there are sequencing reads that map to the target loci; the number of copies of a particular amplified target loci can be determined based on the number of sequencing reads that map to that target loci (such as by comparing the number of sequencing reads compared to the sequences reads from a standard of known concentration or amount).

Figure 46:
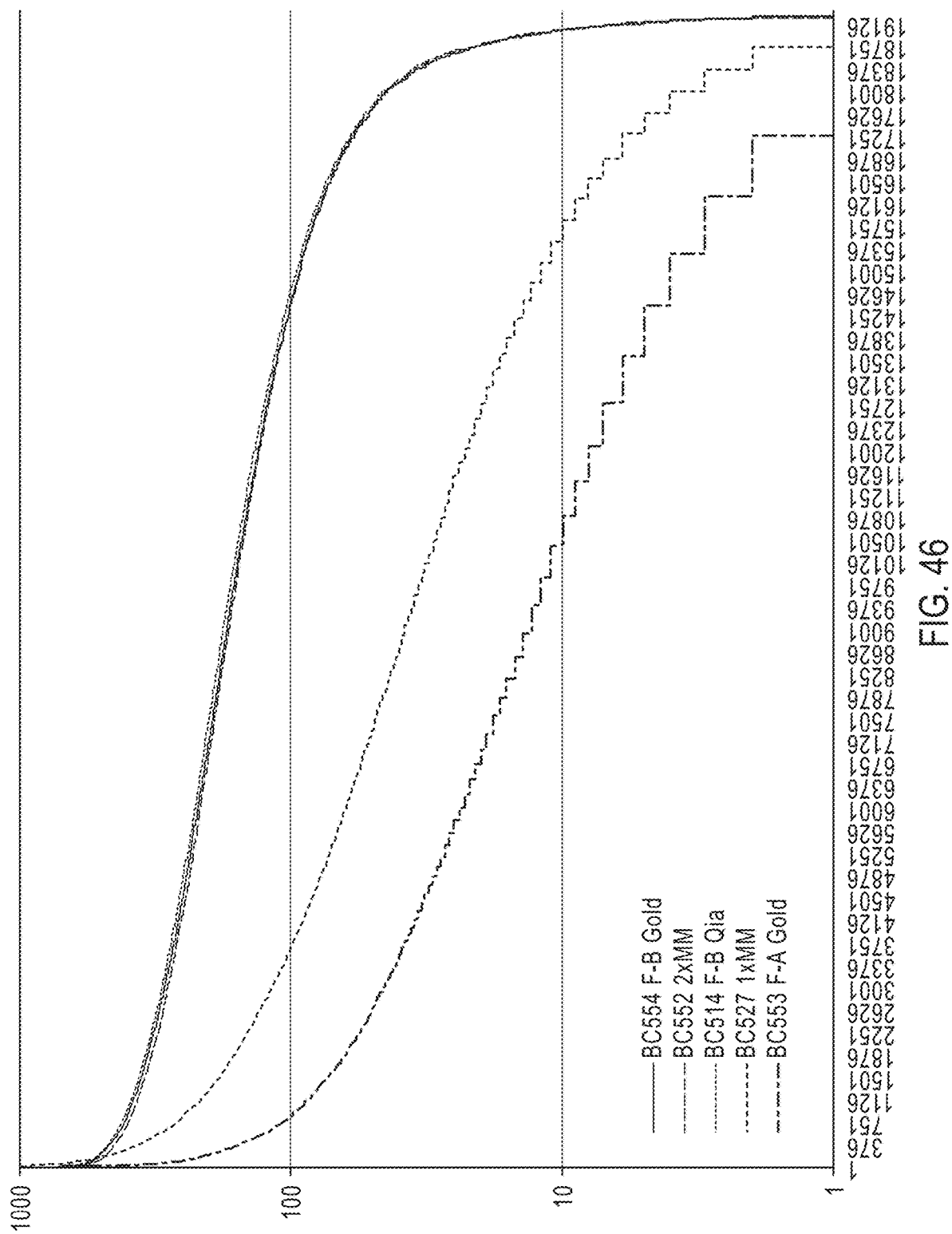
FIG. 46 is a graph illustrating the uniformity in DOR for multiplex PCR with buffers from FIG. 45.
Figure 47:
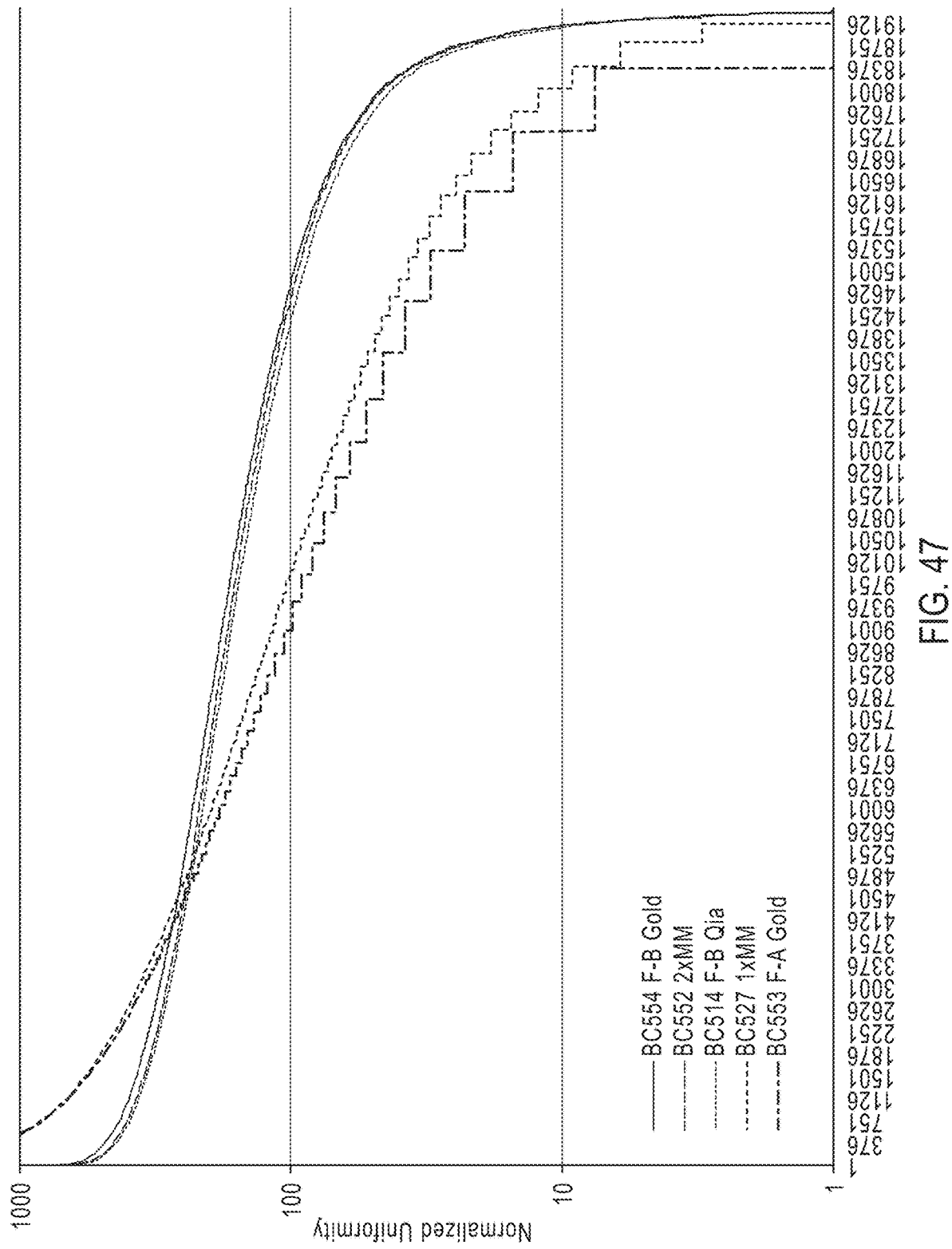
FIG. 47 is a graph illustrating the normalized depth of read (DOR) for multiplex PCR with buffers from FIG. 45 with the DOR normalized to that of buffer 2×MM.

FIG. 45 contains data (such as percent mapped reads and error rate) from multiplex PCR with various buffers. In this figure, "1×MM" denotes 1× QIAGEN Master Mix (the recommended concentration) discussed above, and "2×MM" denotes 2× QIAGEN Master Mix (twice the recommended concentration). FIG. 45 also lists the components of buffer F-A (also called F-A Gold), F-B (also called F-B Gold), F-D, and F-J (also called F-B Qiagen or F-B Qia) as well as the amount and type of polymerase used to generate the data. FIG. 46 is a graph illustrating the uniformity in DOR for multiplex PCR with buffers from FIG. 45. FIG. 47 is a graph illustrating the normalized depth of read (DOR) for multiplex PCR with buffers from FIG. 45 with the DOR normalized to that of buffer 2×MM.

Limit of Detection

As demonstrated by experiments provided in the Examples section, methods provided herein are capable of detecting an average allelic imbalance in a sample with a limit of detection or sensitivity of 0.45% AAI, which is the limit of detection for aneuploidy of an illustrative method of the present invention. Similarly, in certain embodiments, methods provided herein are capable of detecting an average allelic imbalance in a sample of 0.45, 0.5, 0.6, 0.8, 0.8, 0.9, or 1.0%. That is, the test method is capable of detecting chromosomal aneuploidy in a sample down to an AAI of 0.45, 0.5, 0.6, 0.8, 0.8, 0.9, or 1.0%. As demonstrated by experiments provided in the Examples section, methods provided herein are capable of detecting the presence of an SNV in a sample for at least some SNVs, with a limit of detection or sensitivity of 0.2%, which is the limit of detection for at least some SNVs in one illustrative embodiment. Similarly, in certain embodiments, the method is capable of detecting an SNV with a frequency or SNV AAI of 0.2, 0.3, 0.4, 0.5, 0.6, 0.8, 0.8, 0.9, or 1.0%. That is, the test method is capable of detecting an SNV in a sample down to a limit of detection of 0.2, 0.3, 0.4, 0.5, 0.6, 0.8, 0.8, 0.9, or 1.0% of the total allele counts at the chromosomal locus of the SNV.

In some embodiments, a limit of detection of a mutation (such as an SNV or CNV) of a method of the invention is less than or equal to 10, 5, 2, 1, 0.5, 0.1, 0.05, 0.01, or 0.005%. In some embodiments, a limit of detection of a mutation (such as an SNV or CNV) of a method of the invention is between 15 to 0.005%, such as between 10 to 0.005%, 10 to 0.01%, 10 to 0.1%, 5 to 0.005%, 5 to 0.01%, 5 to 0.1%, 1 to 0.005%, 1 to 0.01%, 1 to 0.1%, 0.5 to 0.005%, 0.5 to 0.01%, 0.5 to 0.1%, or 0.1 to 0.01, inclusive.

In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules with that locus in a sample (such as a sample of cfDNA or cfRNA) is detected (or is capable of being detected). For example, the mutation can be detected even if less than or equal to 10, 5, 2, 1, 0.5, 0.1, 0.05, 0.01, or 0.005% of the DNA or RNA molecules that have that locus have that mutation in the locus (instead of, for example, a wild-type or non-mutated version of the locus or a different mutation at that locus). In some embodiments, a limit of detection is such that a mutation (such as an SNV or CNV) that is present in less than or equal to 10, 5, 2, 1, 0.5, 0.1, 0.05, 0.01, or 0.005% of the DNA or RNA molecules in a sample (such as a sample of cfDNA or cfRNA) is detected (or is capable of being detected). In some embodiments in which the CNV is a deletion, the deletion can be detected even if it is only present in less than or equal to 10, 5, 2, 1, 0.5, 0.1, 0.05, 0.01, or 0.005% of the DNA or RNA molecules that have a region of interest that may or may not contain the deletion in a sample. In some embodiments in which the CNV is a deletion, the deletion can be detected even if it is only present in less than or equal to 10, 5, 2, 1, 0.5, 0.1, 0.05, 0.01, or 0.005% of the DNA or RNA molecules in a sample. In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules that have a region of interest that may or may not be duplicated in a sample in a sample. In some embodiments in which the CNV is a duplication, the duplication can be detected even if the extra duplicated DNA or RNA that is present is less than or equal to 10, 5, 2, 1, 0.5, 0.1, 0.05, 0.01, or 0.005% of the DNA or RNA molecules in a sample. Experiment 23 provides exemplary methods for calculating the limit of detection. In some embodiments, the "LOD-zs5.0-mr5" method of Example 23 is used.

Exemplary Nucleic Acid Samples

In some embodiments, the genetic sample may be prepared and/or purified. There are a number of standard procedures known in the art to accomplish such an end. In some embodiments, the sample may be centrifuged to separate various layers. In some embodiments, the DNA may be isolated using filtration. In some embodiments, the preparation of the DNA may involve amplification, separation, purification by chromatography, liquid separation, isolation, preferential enrichment, preferential amplification, targeted amplification, or any of a number of other techniques either known in the art or described herein.

In some embodiments, a method disclosed herein could be used in situations where there is a very small amount of DNA present, such as in in vitro fertilization, or in forensic situations, where one or a few cells are available (typically less than ten cells, less than twenty cells or less than 40 cells.) In these embodiments, a method disclosed herein serves to make ploidy calls from a small amount of DNA that is not contaminated by other DNA, but where the ploidy calling very difficult the small amount of DNA. In some embodiments, a method disclosed herein could be used in situations where the target DNA is contaminated with DNA of another individual, for example in maternal blood in the context of prenatal diagnosis, paternity testing, or products of conception testing. Some other situations where these methods would be particularly advantageous would be in the case of cancer testing where only one or a small number of cells were present among a larger amount of normal cells. The genetic measurements used as part of these methods could be made on any sample comprising DNA or RNA, for example but not limited to: blood, plasma, body fluids, urine, hair, tears, saliva, tissue, skin, fingernails, blastomeres, embryos, fetal cells, amniotic fluid, chorionic villus samples, feces, bile, lymph, cervical mucus, semen, or other cells or materials comprising nucleic acids. In an embodiment, a method disclosed herein could be run with nucleic acid detection methods such as sequencing, microarrays, qPCR, digital PCR, or other methods used to measure nucleic acids. If for some reason it were found to be desirable, the ratios of the allele count probabilities at a locus could be calculated, and the allele ratios could be used to determine ploidy state in combination with some of the methods described herein, provided the methods are compatible. In some embodiments, a method disclosed herein involves calculating, on a computer, allele ratios at the plurality of polymorphic loci from the DNA measurements made on the processed samples. In some embodiments, a method disclosed herein involves calculating, on a computer, allele ratios at the plurality of polymorphic loci from the DNA measurements made on the processed samples along with any combination of other improvements described in this disclosure. Exemplary methods for isolating fetal cells, such as a single fetal cell are disclosed in U.S. Ser. No. 61/978,648, filed Apr. 11, 2014 and U.S. Ser. No. 61/984,546, filed Apr. 25, 2014. Fetal cells or fetal nucleic acids can be isolated from a pregnant mother using invasive (such as CVS or amniocentesis) or noninvasive methods (such as from a maternal blood sample).

In some embodiments, this method may be used to genotype a single cell, a small number of cells, two to five cells, six to ten cells, ten to twenty cells, twenty to fifty cells, fifty to one hundred cells, one hundred to one thousand cells, or a small amount of extracellular DNA, for example from one to ten picograms, from ten to one hundred pictograms, from one hundred pictograms to one nanogram, from one to ten nanograms, from ten to one hundred nanograms, from 30 to 500 nanograms, or from one hundred nanograms to one microgram. In some embodiments, nucleic acids (such as DNA and/or RNA) from less than 100, 75, 50, 40, 30, 20, 10, 8, 6, 4, 2, or 1 cell is amplified with any of the methods of the invention. In some embodiments, the nucleic acid sample includes less than 80, 60, 40, 20, or 10% of the nucleic acids (such as DNA and/or RNA) from a single cell. In some embodiments, in which a small number of cells (such as one cell) or a small amount of nucleic acids is used, nested PCR such as hemi-nested or semi-nested PCR is used and/or the number of PCR cycles is increased compare to that used for samples with a larger amount of cells or nucleic acids. In some embodiments, a large amount of cells or nucleic acids are used (such as in cases in which a larger amount is desired to improve performance of any of the methods of the invention. In some embodiments, a sample with at least 2, 5, 10, 15, 20, 30, 50, 100, or more cells (or DNA or RNA from such cells) is used in any of the methods of the invention. In some embodiments, at least 0.5, 1, 10, 25, 50, 100, 500, 1,000; or 5,000 ng of DNA or RNA is used.

In some embodiments, the cells in the sample are lysed prior to PCR. In some embodiments, the Arcturus PicoPure DNA extraction kit from Applied Biosystems is used. (Applied Biosystems cat. No. KIT0103, see, e.g., information available at the World Wide Web at lifetechnologies.com/order/catalog/product/KIT0103?ICID=search-product, which is hereby incorporated by reference in its entirety). This kit contains Arcturus reconstitution buffer and Protease K. In some embodiments, the following cell lysis thermocycling protocol is used: 56° C. for 1 hour, 95° C. for 10 minutes, 25° C. for 15 minutes, and then a 4° C. hold.

In some embodiments, the nucleic acids are processed using the consecutive steps of end-repairing, dA-tailing, and adaptor ligating the nucleic acids. The consecutive steps exclude purifying the end-repaired products prior to the dA-tailing step and exclude purifying the dA-tailing products prior to the adaptor ligating step. The resulting products are amplified in any of the multiplex PCR methods of the invention. In some embodiments, the amplified products are then sequenced.

Exemplary Nucleic Acid Studies

The multiplex PCR methods of the invention can be used to increase the number of target loci that can be evaluated to measure the amount of one or more specific nucleic acid molecules of interest or of one or more types of nucleic acids. In some embodiments, there is a change in the total amount or concentration of one or more types of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA). In some embodiments, there is a change in the amount or concentration of one or more specific DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) molecules. In some embodiments, one allele is expressed more than another allele of a locus of interest. Exemplary miRNAs are short 20-22 nucleotide RNA molecules that regulate the expression of a gene. In some embodiments, there is a change in the transcriptome, such as a change in the identity or amount of one or more RNA molecules.

In some embodiments, an increase in the total amount or concentration of cfDNA or cfRNA is associated with a disease such as cancer, or an increased risk for a disease such as cancer. In some embodiments, the total concentration of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) increases by at least 2, 3, 4, 5, 6, 7, 8, 9, 10-fold, or more compared to the total concentration of that type of DNA or RNA in healthy (such as non-cancerous) subjects. In some embodiments, a total concentration of cfDNA between 75 to 100 ng/mL, 100 to 150 ng/mL, 150 to 200 ng/mL, 200 to 300 ng/mL, 300 to 400 ng/mgL, 400 to 600 ng/mL, 600 to 800 ng/mL, 800 to 1,000 ng/mL, inclusive, or a total concentration of cfDNA of more than 100 ng, mL, such as more than 200, 300, 400, 500, 600, 700, 800, 900, or 1,000 ng/ml is indicative of cancer, an increased risk for cancer, an increased risk of a tumor being malignant rather than benign, a decreased probably of the cancer going into remission, or a worse prognosis for the cancer. In some embodiments, the amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) having one or more polymorphisms/mutations (such as deletions or duplications) associated with a disease such as cancer or an increased risk for a disease such as cancer is at least 2, 3, 4, 5, 6, 7, 8, 9, 10, 11, 12, 14, 16, 18, 20, or 25% of the total amount of that type of DNA or RNA. In some embodiments, at least 2, 3, 4, 5, 6, 7, 8, 9, 10, 11, 12, 14, 16, 18, 20, or 25% of the total amount of a type of DNA (such as cfDNA cf mDNA, cf nDNA, cellular DNA, or mitochondrial DNA) or RNA (cfRNA, cellular RNA, cytoplasmic RNA, coding cytoplasmic RNA, non-coding cytoplasmic RNA, mRNA, miRNA, mitochondrial RNA, rRNA, or tRNA) has a particular polymorphism or mutation (such as a deletion or duplication) associated with a disease such as cancer or an increased risk for a disease such as cancer.

Exemplary RNA Expression Studies

The multiplex PCR methods of the invention can be used to increase the number of target loci that can be evaluated during gene expression profiling experiments. For example, the expression levels of thousands of genes can be simultaneously monitored to determine whether a person has a sequence (such as a polymorphism or other mutation) associated with a disease (such as cancer) or an increased risk of a disease. These methods can be used to identify sequences (such as polymorphisms or other mutations) associated with an increased or decreased risk for a disease such as cancer by comparing gene expression (such as the expression of particular mRNA alleles) in samples from patients with and without the disease. Additionally, the effect of particular treatments, diseases, or developmental stages on gene expression can be determined. Similarly, these methods can be used to identify genes whose expression is changed in response to pathogens or other organisms by comparing gene expression in infected and uninfected cells or tissues. In these methods the number of sequencing reads can be adjusted based on the frequency of the polymorphisms that are being analyzed such that sufficient reads are performed for the polymorphisms to be detected if they are present. In some embodiments, the polymorphisms or mutation is present at a higher frequency in subjects with a disease or disorder (such as cancer) than subjects without the disease or disorder (such as cancer). In some embodiments, the polymorphisms or mutation is indicative of cancer, such as a causative mutation.

In some embodiments, a sample containing RNA (such as mRNA) is amplified using a reverse transcriptase (RT) and the resulting DNA (such as cDNA) is then amplified using a DNA polymerase (PCR). The RT and PCR steps may be carried out sequentially in the same reaction volume or separately. Any of the primer libraries of the invention can be used in this reverse transcription polymerase chain reaction (RT-PCR) method. In various embodiments, the reverse transcription is performed using oligo-dT, random primers, a mixture of oligo-dT and random primers, or primers specific to the target loci. To avoid amplification of contaminating genomic DNA, primers for RT-PCR can be designed so that part of one primer hybridizes to the 3' end of one exon and the other part of the primer hybridizes to the 5' end of the adjacent exon. Such primers anneal to cDNA synthesized from spliced mRNAs, but not to genomic DNA. To detect amplification of contaminating DNA, RT-PCR primer pairs may be designed to flank a region that contains at least one intron. Products amplified from cDNA (no introns) are smaller than those amplified from genomic DNA (containing introns). Size difference in products is used to detect the presence of contaminating DNA. In some embodiments when only the mRNA sequence is known, primer annealing sites are chosen that are at least 300-400 base pairs apart since it is likely that fragments of this size from eukaryotic DNA contain splice junctions. Alternatively, the sample can be treated with DNase to degrade contaminating DNA.

Exemplary Methods for Paternity Testing

The multiplex PCR methods of the invention can be used to improve the accuracy of paternity testing since so many target loci can be analyzed at once (see, e.g, U.S. Publication No. 2012/0122701, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to determine whether an alleged father in is the biological father of a fetus. In some embodiments the method involves (i) simultaneously amplifying a plurality of polymorphic loci that includes at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci on genetic material from the alleged father to produce a first set of amplified products; (ii) simultaneously amplifying the corresponding plurality of polymorphic loci on a mixed sample of DNA originating from a blood sample from the pregnant mother to produce a second set of amplified products; wherein the mixed sample of DNA comprises fetal DNA and maternal DNA; (iii) determining on a computer the probability that the alleged father is the biological father of the fetus using genotypic measurements based on the first and second sets of amplified products; and (iv) establishing whether the alleged father is the biological father of the fetus using the determined probability that the alleged father is the biological father of the fetus. In various embodiments, the method further includes simultaneously amplifying the corresponding plurality of polymorphic loci on genetic material from the mother to produce a third set of amplified products; wherein the probability that the alleged father is the biological father of the fetus is determined using genotypic measurements based on the first, second, and third sets of amplified products.

Exemplary Methods for Embryo Characterization and Selection

The multiplex PCR methods of the invention can be used to improve the selection of embryos for in vitro fertilization by allowing thousands of target loci to be analyzed at once (see, e.g, U.S. Pub. No. 2011/0092763, filed May 27, 2008, filed Dec. 22, 2011, is which is hereby incorporated by reference in its entirety). For example, the multiplex PCR method can allow thousands of polymorphic loci (such as SNPs) to be analyzed for use in the PARENTAL SUPPORT algorithm described herein to select an embryo out of a set of embryos for in vitro fertilization In some embodiments, the invention provides methods of estimating relative likelihoods that each embryo from a set of embryos will develop as desired. In some embodiments, the method involves contacting a sample from each embryo with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture for each embryo, wherein the samples are each derived from one or more cells from an embryo. In some embodiments, each reaction mixture is subjected to primer extension reaction conditions to produce amplified products. In some embodiments, the method includes determining on a computer one or more characteristics of at least one cell from each embryo based on the amplified products; and estimating on a computer the relative likelihoods that each embryo will develop as desired, based on the one or more characteristics of the at least one cell for each embryo. In some embodiments, the method includes using an informatics based method to determine the at least one characteristic, such as the PARENTAL SUPPORT algorithm described herein. In some embodiments, the characteristic includes a ploidy state. In some embodiments, the characteristic is selected from the group consisting of aneuploid, euploid, mosaic, nullsomy, monosomy, uniparental disomy, trisomy, tetrasomy, a type of aneuploidy, unmatched copy error trisomy, matched copy error trisomy, maternal origin of aneuploidy, paternal origin of aneuploidy, a presence or absence of a disease-linked gene, a chromosomal identity of any aneuploid chromosome, an abnormal genetic condition, a deletion or duplication, a likelihood of a characteristic, and combinations thereof. The characteristic may be associated with a chromosome taken from the group consisting of chromosome one, chromosome two, chromosome three, chromosome four, chromosome five, chromosome six, chromosome seven, chromosome eight, chromosome nine, chromosome ten, chromosome eleven, chromosome twelve, chromosome thirteen, chromosome fourteen, chromosome fifteen, chromosome sixteen, chromosome seventeen, chromosome eighteen, chromosome nineteen, chromosome twenty, chromosome twenty-one, chromosome twenty-two, X chromosome or Y chromosome, and combinations thereof.

Exemplary Prenatal Diagnostic Methods

The multiplex PCR methods of the present invention can be used to improve prenatal diagnostic methods, such as the determination of the ploidy status of fetal chromosomes. Given that the large number of target loci that can be simultaneously amplified, more accurate determinations can be made.

In an embodiment, the present disclosure provides ex vivo methods for determining the ploidy status of a chromosome in a gestating fetus from genotypic data measured from a mixed sample of DNA (i.e., DNA from the mother of the fetus, and DNA from the fetus) and optionally from genotypic data measured from a sample of genetic material from the mother and possibly also from the father, wherein the determining is done by using a joint distribution model to create a set of expected allele distributions for different possible fetal ploidy states given the parental genotypic data, and comparing the expected allelic distributions to the actual allelic distributions measured in the mixed sample, and choosing the ploidy state whose expected allelic distribution pattern most closely matches the observed allelic distribution pattern. In an embodiment, the mixed sample is derived from maternal blood, or maternal serum or plasma. In an embodiment, the mixed sample of DNA may be preferentially enriched at a target loci (e.g., plurality of polymorphic loci). In an embodiment, the preferential enrichment is done in a way that minimizes the allelic bias. In an embodiment, the present disclosure relates to a composition of DNA that has been preferentially enriched at a plurality of loci such that the allelic bias is low. In an embodiment, the allelic distribution(s) are measured by sequencing the DNA from the mixed sample. In an embodiment, the joint distribution model assumes that the alleles will be distributed in a binomial fashion. In an embodiment, the set of expected joint allele distributions are created for genetically linked loci while considering the extant recombination frequencies from various sources, for example, using data from the International HapMap Consortium.

In an embodiment, the present disclosure provides methods for non-invasive prenatal diagnosis (NPD), specifically, determining the aneuploidy status of a fetus by observing allele measurements at a plurality of polymorphic loci in genotypic data measured on DNA mixtures, where certain allele measurements are indicative of an aneuploid fetus, while other allele measurements are indicative of a euploid fetus. In an embodiment, the genotypic data is measured by sequencing DNA mixtures that were derived from maternal plasma. In an embodiment, the DNA sample may be preferentially enriched in molecules of DNA that correspond to the plurality of loci whose allele distributions are being calculated. In an embodiment a sample of DNA comprising only or almost only genetic material from the mother and possibly also a sample of DNA comprising only or almost only genetic material from the father are measured. In an embodiment, the genetic measurements of one or both parents along with the estimated fetal fraction are used to create a plurality of expected allele distributions corresponding to different possible underlying genetic states of the fetus; the expected allele distributions may be termed hypotheses. In an embodiment, the maternal genetic data is not determined by measuring genetic material that is exclusively or almost exclusively maternal in nature, rather, it is estimated from the genetic measurements made on maternal plasma that comprises a mixture of maternal and fetal DNA. In some embodiments the hypotheses may comprise the ploidy of the fetus at one or more chromosomes, which segments of which chromosomes in the fetus were inherited from which parents, and combinations thereof. In some embodiments, the ploidy state of the fetus is determined by comparing the observed allele measurements to the different hypotheses where at least some of the hypotheses correspond to different ploidy states, and selecting the ploidy state that corresponds to the hypothesis that is most likely to be true given the observed allele measurements. In an embodiment, this method involves using allele measurement data from some or all measured SNPs, regardless of whether the loci are homozygous or heterozygous, and therefore does not involve using alleles at loci that are only heterozygous. This method may not be appropriate for situations where the genetic data pertains to only one polymorphic locus. This method is particularly advantageous when the genetic data comprises data for more than ten polymorphic loci for a target chromosome or more than twenty polymorphic loci. This method is especially advantageous when the genetic data comprises data for more than 50 polymorphic loci for a target chromosome, more than 100 polymorphic loci or more than 200 polymorphic loci for a target chromosome. In some embodiments, the genetic data may comprise data for more than 500 polymorphic loci for a target chromosome, more than 1,000 polymorphic loci, more than 2,000 polymorphic loci, or more than 5,000 polymorphic loci for a target chromosome.

In an embodiment, a method disclosed herein yields a quantitative measure of the number of independent observations of each allele at a polymorphic locus. This is unlike most methods such as microarrays or qualitative PCR which provide information about the ratio of two alleles but do not quantify the number of independent observations of either allele. With methods that provide quantitative information regarding the number of independent observations, only the ratio is utilized in ploidy calculations, while the quantitative information by itself is not useful. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio (A/(A+B)) is equal to 0.5, however the second experiment conveys more information than the first about the certainty of the frequency of the A or B allele. Some methods by others involve averaging or summing allele ratios (channel ratios) (i.e. $x_i/y_i$) from individual allele and analyzes this ratio, either comparing it to a reference chromosome or using a rule pertaining to how this ratio is expected to behave in particular situations. No allele weighting is implied in such methods, where it is assumed that one can ensure about the same amount of PCR product for each allele and that all the alleles should behave the same way. Such a method has a number of disadvantages, and more importantly, precludes the use a number of improvements that are described elsewhere in this disclosure.

In an embodiment, a method disclosed herein explicitly models the allele frequency distributions expected in disomy as well as a plurality of allele frequency distributions that may be expected in cases of trisomy resulting from nondisjunction during meiosis I, nondisjunction during meiosis II, and/or nondisjunction during mitosis early in fetal development. To illustrate why this is important, imagine a case where there were no crossovers: nondisjunction during meiosis I would result a trisomy in which two different homologs were inherited from one parent; in contrast, nondisjunction during meiosis II or during mitosis early in fetal development would result in two copies of the same homolog from one parent. Each scenario would result in different expected allele frequencies at each polymorphic locus and also at all loci considered jointly, due to genetic linkage. Crossovers, which result in the exchange of genetic material between homologs, make the inheritance pattern more complex; in an embodiment, the instant method accommodates for this by using recombination rate information in addition to the physical distance between loci. In an embodiment, to enable improved distinction between meiosis I nondisjunction and meiosis II or mitotic nondisjunction the instant method incorporate into the model an increasing probability of crossover as the distance from the centromere increases. Meiosis II and mitotic nondisjunction can distinguished by the fact that mitotic nondisjunction typically results in identical or nearly identical copies of one homolog while the two homologs present following a meiosis II nondisjunction event often differ due to one or more crossovers during gametogenesis.

In some embodiments, a method disclosed herein involves comparing the observed allele measurements to theoretical hypotheses corresponding to possible fetal genetic aneuploidy, and does not involve a step of quantitating a ratio of alleles at a heterozygous locus. Where the number of loci is lower than about 20, the ploidy determination made using a method comprising quantitating a ratio of alleles at a heterozygous locus and a ploidy determination made using a method comprising comparing the observed allele measurements to theoretical allele distribution hypotheses corresponding to possible fetal genetic states may give a similar result. However, where the number of loci is above 50 these two methods are likely to give significantly different results; where the number of loci is above 400, above, 1,000 or above 2,000 these two methods are very likely to give results that are increasingly significantly different. These differences are due to the fact that a method that comprises quantitating a ratio of alleles at a heterozygous locus without measuring the magnitude of each allele independently and aggregating or averaging the ratios precludes the use of techniques including using a joint distribution model, performing a linkage analysis, using a binomial distribution model, and/or other advanced statistical techniques, whereas using a method comprising comparing the observed allele measurements to theoretical allele distribution hypotheses corresponding to possible fetal genetic states may use these techniques which can substantially increase the accuracy of the determination.

In an embodiment, a method disclosed herein involves determining whether the distribution of observed allele measurements is indicative of a euploid or an aneuploid fetus using a joint distribution model. The use of a joint distribution model is a different from and a significant improvement over methods that determine heterozygosity rates by treating polymorphic loci independently in that the resultant determinations are of significantly higher accuracy. Without being bound by any particular theory, it is believed that one reason they are of higher accuracy is that the joint distribution model takes into account the linkage between SNPs, and likelihood of crossovers having occurred during the meiosis that gave rise to the gametes that formed the embryo that grew into the fetus. The purpose of using the concept of linkage when creating the expected distribution of allele measurements for one or more hypotheses is that it allows the creation of expected allele measurements distributions that correspond to reality considerably better than when linkage is not used. For example, imagine that there are two SNPs, 1 and 2 located nearby one another, and the mother is A at SNP 1 and A at SNP 2 on one homolog, and B at SNP 1 and B at SNP 2 on homolog two. If the father is A for both SNPs on both homologs, and a B is measured for the fetus SNP 1, this indicates that homolog two has been inherited by the fetus, and therefore that there is a much higher likelihood of a B being present on the fetus at SNP 2. A model that takes into account linkage would predict this, while a model that does not take linkage into account would not. Alternately, if a mother was AB at SNP 1 and AB at nearby SNP 2, then two hypotheses corresponding to maternal trisomy at that location could be used-one involving a matching copy error (nondisjunction in meiosis II or mitosis in early fetal development), and one involving an unmatching copy error (nondisjunction in meiosis I). In the case of a matching copy error trisomy, if the fetus inherited an AA from the mother at SNP 1, then the fetus is much more likely to inherit either an AA or BB from the mother at SNP 2, but not AB. In the case of an unmatching copy error, the fetus would inherit an AB from the mother at both SNPs. The allele distribution hypotheses made by a ploidy calling method that takes into account linkage would make these predictions, and therefore correspond to the actual allele measurements to a considerably greater extent than a ploidy calling method that did not take into account linkage. Note that a linkage approach is not possible when using a method that relies on calculating allele ratios and aggregating those allele ratios.

One reason that it is believed that ploidy determinations that use a method that comprises comparing the observed allele measurements to theoretical hypotheses corresponding to possible fetal genetic states are of higher accuracy is that when sequencing is used to measure the alleles, this method can glean more information from data from alleles where the total number of reads is low than other methods; for example, a method that relies on calculating and aggregating allele ratios would produce disproportionately weighted stochastic noise. For example, imagine a case that involved measuring the alleles using sequencing, and where there was a set of loci where only five sequence reads were detected for each locus. In an embodiment, for each of the alleles, the data may be compared to the hypothesized allele distribution, and weighted according to the number of sequence reads; therefore the data from these measurements would be appropriately weighted and incorporated into the overall determination. This is in contrast to a method that involved quantitating a ratio of alleles at a heterozygous locus, as this method could only calculate ratios of 0%, 20%, 40%, 60%, 80% or 100% as the possible allele ratios; none of these may be close to expected allele ratios. In this latter case, the calculated allele rations would either have to be discarded due to insufficient reads or else would have disproportionate weighting and introduce stochastic noise into the determination, thereby decreasing the accuracy of the determination. In an embodiment, the individual allele measurements may be treated as independent measurements, where the relationship between measurements made on alleles at the same locus is no different from the relationship between measurements made on alleles at different loci.

In an embodiment, a method disclosed herein involves determining whether the distribution of observed allele measurements is indicative of a euploid or an aneuploid fetus without comparing any metrics to observed allele measurements on a reference chromosome that is expected to be disomic (termed the RC method). This is a significant improvement over methods, such as methods using shotgun sequencing which detect aneuploidy by evaluating the proportion of randomly sequenced fragments from a suspect chromosomes relative to one or more presumed disomic reference chromosome. This RC method yields incorrect results if the presumed disomic reference chromosome is not actually disomic. This can occur in cases where aneuploidy is more substantial than trisomy of a single chromosome or where the fetus is triploid and all autosomes are trisomic. In the case of a female triploid (69, XXX) fetus there are in fact no disomic chromosomes at all. The method described herein does not require a reference chromosome and would be able to correctly identify trisomic chromosomes in a female triploid fetus. For each chromosome, hypothesis, child fraction and noise level, a joint distribution model may be fit, without any of: reference chromosome data, an overall child fraction estimate, or a fixed reference hypothesis.

In an embodiment, a method disclosed herein demonstrates how observing allele distributions at polymorphic loci can be used to determine the ploidy state of a fetus with greater accuracy than methods in the prior art. In an embodiment, the method uses the targeted sequencing to obtain mixed maternal-fetal genotypes and optionally mother and/or father genotypes at a plurality of SNPs to first establish the various expected allele frequency distributions under the different hypotheses, and then observing the quantitative allele information obtained on the maternal-fetal mixture and evaluating which hypothesis fits the data best, where the genetic state corresponding to the hypothesis with the best fit to the data is called as the correct genetic state. In an embodiment, a method disclosed herein also uses the degree of fit to generate a confidence that the called genetic state is the correct genetic state. In an embodiment, a method disclosed herein involves using algorithms that analyze the distribution of alleles found for loci that have different parental contexts, and comparing the observed allele distributions to the expected allele distributions for different ploidy states for the different parental contexts (different parental genotypic patterns). This is different from and an improvement over methods that do not use methods that enable the estimation of the number of independent instances of each allele at each locus in a mixed maternal-fetal sample. In an embodiment, a method disclosed herein involves determining whether the distribution of observed allele measurements is indicative of a euploid or an aneuploid fetus using observed allelic distributions measured at loci where the mother is heterozygous. This is different from and an improvement over methods that do not use observed allelic distributions at loci where the mother is heterozygous because, in cases where the DNA is not preferentially enriched or is preferentially enriched for loci that are not known to be highly informative for that particular target individual, it allows the use of about twice as much genetic measurement data from a set of sequence data in the ploidy determination, resulting in a more accurate determination.

In an embodiment, a method disclosed herein uses a joint distribution model that assumes that the allele frequencies at each locus are multinomial (and thus binomial when SNPs are biallelic) in nature. In some embodiments the joint distribution model uses beta-binomial distributions. When using a measuring technique, such as sequencing, provides a quantitative measure for each allele present at each locus, binomial model can be applied to each locus and the degree underlying allele frequencies and the confidence in that frequency can be ascertained. With methods known in the art that generate ploidy calls from allele ratios, or methods in which quantitative allele information is discarded, the certainty in the observed ratio cannot be ascertained. The instant method is different from and an improvement over methods that calculate allele ratios and aggregate those ratios to make a ploidy call, since any method that involves calculating an allele ratio at a particular locus, and then aggregating those ratios, necessarily assumes that the measured intensities or counts that are indicative of the amount of DNA from any given allele or locus will be distributed in a Gaussian fashion. The method disclosed herein does not involve calculating allele ratios. In some embodiments, a method disclosed herein may involve incorporating the number of observations of each allele at a plurality of loci into a model. In some embodiments, a method disclosed herein may involve calculating the expected distributions themselves, allowing the use of a joint binomial distribution model which may be more accurate than any model that assumes a Gaussian distribution of allele measurements. The likelihood that the binomial distribution model is significantly more accurate than the Gaussian distribution increases as the number of loci increases. For example, when fewer than 20 loci are interrogated, the likelihood that the binomial distribution model is significantly better is low. However, when more than 100, or especially more than 400, or especially more than 1,000, or especially more than 2,000 loci are used, the binomial distribution model will have a very high likelihood of being significantly more accurate than the Gaussian distribution model, thereby resulting in a more accurate ploidy determination. The likelihood that the binomial distribution model is significantly more accurate than the Gaussian distribution also increases as the number of observations at each locus increases. For example, when fewer than 10 distinct sequences are observed at each locus are observed, the likelihood that the binomial distribution model is significantly better is low. However, when more than 50 sequence reads, or especially more than 100 sequence reads, or especially more than 200 sequence reads, or especially more than 300 sequence reads are used for each locus, the binomial distribution model will have a very high likelihood of being significantly more accurate than the Gaussian distribution model, thereby resulting in a more accurate ploidy determination.

In an embodiment, a method disclosed herein uses sequencing to measure the number of instances of each allele at each locus in a DNA sample. Each sequencing read may be mapped to a specific locus and treated as a binary sequence read; alternately, the probability of the identity of the read and/or the mapping may be incorporated as part of the sequence read, resulting in a probabilistic sequence read, that is, the probable whole or fractional number of sequence reads that map to a given loci. Using the binary counts or probability of counts it is possible to use a binomial distribution for each set of measurements, allowing a confidence interval to be calculated around the number of counts. This ability to use the binomial distribution allows for more accurate ploidy estimations and more precise confidence intervals to be calculated. This is different from and an improvement over methods that use intensities to measure the amount of an allele present, for example methods that use microarrays, or methods that make measurements using fluorescence readers to measure the intensity of fluorescently tagged DNA in electrophoretic bands.

In an embodiment, a method disclosed herein uses aspects of the present set of data to determine parameters for the estimated allele frequency distribution for that set of data. This is an improvement over methods that utilize training set of data or prior sets of data to set parameters for the present expected allele frequency distributions, or possibly expected allele ratios. This is because there are different sets of conditions involved in the collection and measurement of every genetic sample, and thus a method that uses data from the instant set of data to determine the parameters for the joint distribution model that is to be used in the ploidy determination for that sample will tend to be more accurate.

In an embodiment, a method disclosed herein involves determining whether the distribution of observed allele measurements is indicative of a euploid or an aneuploid fetus using a maximum likelihood technique. The use of a maximum likelihood technique is different from and a significant improvement over methods that use single hypothesis rejection technique in that the resultant determinations will be made with significantly higher accuracy. One reason is that single hypothesis rejection techniques set cut off thresholds based on only one measurement distribution rather than two, meaning that the thresholds are usually not optimal. Another reason is that the maximum likelihood technique allows the optimization of the cut off threshold for each individual sample instead of determining a cut off threshold to be used for all samples regardless of the particular characteristics of each individual sample. Another reason is that the use of a maximum likelihood technique allows the calculation of a confidence for each ploidy call. The ability to make a confidence calculation for each call allows a practitioner to know which calls are accurate, and which are more likely to be wrong. In some embodiments, a wide variety of methods may be combined with a maximum likelihood estimation technique to enhance the accuracy of the ploidy calls. In an embodiment, the maximum likelihood technique may be used in combination with the method described in U.S. Pat. No. 7,888,017. In an embodiment, the maximum likelihood technique may be used in combination with the method of using targeted PCR amplification to amplify the DNA in the mixed sample followed by sequencing and analysis using a read counting method such as used by TANDEM DIAGNOSTICS, as presented at the International Congress of Human Genetics 2011, in Montreal in October 2011. In an embodiment, a method disclosed herein involves estimating the fetal fraction of DNA in the mixed sample and using that estimation to calculate both the ploidy call and the confidence of the ploidy call. Note that this is both different and distinct from methods that use estimated fetal fraction as a screen for sufficient fetal fraction, followed by a ploidy call made using a single hypothesis rejection technique that does not take into account the fetal fraction nor does it produce a confidence calculation for the call.

In an embodiment, a method disclosed herein takes into account the tendency for the data to be noisy and contain errors by attaching a probability to each measurement. The use of maximum likelihood techniques to choose the correct hypothesis from the set of hypotheses that were made using the measurement data with attached probabilistic estimates makes it more likely that the incorrect measurements will be discounted, and the correct measurements will be used in the calculations that lead to the ploidy call. To be more precise, this method systematically reduces the influence of data that is incorrectly measured on the ploidy determination. This is an improvement over methods where all data is assumed to be equally correct or methods where outlying data is arbitrarily excluded from calculations leading to a ploidy call. Existing methods using channel ratio measurements claim to extend the method to multiple SNPs by averaging individual SNP channel ratios. Not weighting individual SNPs by expected measurement variance based on the SNP quality and observed depth of read reduces the accuracy of the resulting statistic, resulting in a reduction of the accuracy of the ploidy call significantly, especially in borderline cases.

In an embodiment, a method disclosed herein does not presuppose the knowledge of which SNPs or other polymorphic loci are heterozygous on the fetus. This method allows a ploidy call to be made in cases where paternal genotypic information is not available. This is an improvement over methods where the knowledge of which SNPs are heterozygous must be known ahead of time in order to appropriately select loci to target, or to interpret the genetic measurements made on the mixed fetal/maternal DNA sample.

The methods described herein are particularly advantageous when used on samples where a small amount of DNA is available, or where the percent of fetal DNA is low. This is due to the correspondingly higher allele dropout rate that occurs when only a small amount of DNA is available and/or the correspondingly higher fetal allele dropout rate when the percent of fetal DNA is low in a mixed sample of fetal and maternal DNA. A high allele dropout rate, meaning that a large percentage of the alleles were not measured for the target individual, results in poorly accurate fetal fractions calculations, and poorly accurate ploidy determinations. Since methods disclosed herein may use a joint distribution model that takes into account the linkage in inheritance patterns between SNPs, significantly more accurate ploidy determinations may be made. The methods described herein allow for an accurate ploidy determination to be made when the percent of molecules of DNA that are fetal in the mixture is less than 40%, less than 30%, less than 20%, less than 10%, less than 8%, and even less than 6%.

In an embodiment, it is possible to determine the ploidy state of an individual based on measurements when that individual's DNA is mixed with DNA of a related individual. In an embodiment, the mixture of DNA is the free floating DNA found in maternal plasma, which may include DNA from the mother, with known karyotype and known genotype, and which may be mixed with DNA of the fetus, with unknown karyotype and unknown genotype. It is possible to use the known genotypic information from one or both parents to predict a plurality of potential genetic states of the DNA in the mixed sample for different ploidy states, different chromosome contributions from each parent to the fetus, and optionally, different fetal DNA fractions in the mixture. Each potential composition may be referred to as a hypothesis. The ploidy state of the fetus can then be determined by looking at the actual measurements, and determining which potential compositions are most likely given the observed data.

Further discussion of the points above may be found elsewhere in this document.

Non-Invasive Prenatal Diagnosis (NPD)

The process of non-invasive prenatal diagnosis involves a number of steps. Some of the steps may include: (1) obtaining the genetic material from the fetus; (2) enriching the genetic material of the fetus that may be in a mixed sample, ex vivo; (3) amplifying the genetic material, ex vivo; (4) preferentially enriching specific loci in the genetic material, ex vivo; (5) measuring the genetic material, ex vivo; and (6) analyzing the genotypic data, on a computer, and ex vivo. Methods to reduce to practice these six and other relevant steps are described herein. At least some of the method steps are not directly applied on the body. In an embodiment, the present disclosure relates to methods of treatment and diagnosis applied to tissue and other biological materials isolated and separated from the body. At least some of the method steps are executed on a computer.

Some embodiments of the present disclosure allow a clinician to determine the genetic state of a fetus that is gestating in a mother in a non-invasive manner such that the health of the baby is not put at risk by the collection of the genetic material of the fetus, and that the mother is not required to undergo an invasive procedure. Moreover, in certain aspects, the present disclosure allows the fetal genetic state to be determined with high accuracy, significantly greater accuracy than, for example, the non-invasive maternal serum analyte based screens, such as the triple test, that are in wide use in prenatal care.

The high accuracy of the methods disclosed herein is a result of an informatics approach to analysis of the genotype data, as described herein. Modern technological advances have resulted in the ability to measure large amounts of genetic information from a genetic sample using such methods as high throughput sequencing and genotyping arrays. The methods disclosed herein allow a clinician to take greater advantage of the large amounts of data available, and make a more accurate diagnosis of the fetal genetic state. The details of a number of embodiments are given below. Different embodiments may involve different combinations of the aforementioned steps. Various combinations of the different embodiments of the different steps may be used interchangeably.

In an embodiment, a blood sample is taken from a pregnant mother, and the free floating DNA in the plasma of the mother's blood, which contains a mixture of both DNA of maternal origin, and DNA of fetal origin, is isolated and used to determine the ploidy status of the fetus. In an embodiment, a method disclosed herein involves preferential enrichment of those DNA sequences in a mixture of DNA that correspond to polymorphic alleles in a way that the allele ratios and/or allele distributions remain mostly consistent upon enrichment. In an embodiment, a method disclosed herein involves the highly efficient targeted PCR based amplification such that a very high percentage of the resulting molecules correspond to targeted loci. In an embodiment, a method disclosed herein involves sequencing a mixture of DNA that contains both DNA of maternal origin, and DNA of fetal origin. In an embodiment, a method disclosed herein involves using measured allele distributions to determine the ploidy state of a fetus that is gestating in a mother. In an embodiment, a method disclosed herein involves reporting the determined ploidy state to a clinician. In an embodiment, a method disclosed herein involves taking a clinical action, for example, performing follow up invasive testing such as chorionic villus sampling or amniocentesis, preparing for the birth of a trisomic individual or an elective termination of a trisomic fetus.

This application makes reference to U.S. Utility application Ser. No. 11/603,406, filed Nov. 28, 2006 (US Publication No.: 20070184467); U.S. Utility application Ser. No. 12/076,348, filed Mar. 17, 2008 (US Publication No.: 20080243398); PCT Application Serial No. PCT/US09/52730, filed Aug. 4, 2009 (PCT Publication No.: WO/2010/017214); PCT Application Serial No. PCT/US10/050824, filed Sep. 30, 2010 (PCT Publication No.: WO/2011/041485), U.S. Utility application Ser. No. 13/110,685, filed May 18, 2011, and PCT Application Serial No. PCT/12/58578, filed Oct. 3, 2012, which are each herein incorporated by reference in its entirety. Some of the vocabulary used in this filing may have its antecedents in these references. Some of the concepts described herein may be better understood in light of the concepts found in these references.
Screening Maternal Blood Comprising Free Floating Fetal DNA The methods described herein may be used to help determine the genotype of a child, fetus, or other target individual where the genetic material of the target is found in the presence of a quantity of other genetic material. In some embodiments the genotype may refer to the ploidy state of one or a plurality of chromosomes, it may refer to one or a plurality of disease linked alleles, or some combination thereof. In this disclosure, the discussion focuses on determining the genetic state of a fetus where the fetal DNA is found in maternal blood, but this example is not meant to limit to possible contexts that this method may be applied to. In addition, the method may be applicable in cases where the amount of target DNA is in any proportion with the non-target DNA; for example, the target DNA could make up anywhere between 0.000001 and 99.999999% of the DNA present. In addition, the non-target DNA does not necessarily need to be from one individual, or even from a related individual, as long as genetic data from some or all of the relevant non-target individual(s) is known. In an embodiment, a method disclosed herein can be used to determine genotypic data of a fetus from maternal blood that contains fetal DNA. It may also be used in a case where there are multiple fetuses in the uterus of a pregnant woman, or where other contaminating DNA may be present in the sample, for example from other already born siblings.

This technique may make use of the phenomenon of fetal blood cells gaining access to maternal circulation through the placental villi. Ordinarily, only a very small number of fetal cells enter the maternal circulation in this fashion (not enough to produce a positive Kleihauer-Betke test for fetal-maternal hemorrhage). The fetal cells can be sorted out and analyzed by a variety of techniques to look for particular DNA sequences, but without the risks that invasive procedures inherently have. This technique may also make use of the phenomenon of free floating fetal DNA gaining access to maternal circulation by DNA release following apoptosis of placental tissue where the placental tissue in question contains DNA of the same genotype as the fetus. The free floating DNA found in maternal plasma has been shown to contain fetal DNA in proportions as high as 30-40% fetal DNA.

In an embodiment, blood may be drawn from a pregnant woman. Research has shown that maternal blood may contain a small amount of free floating DNA from the fetus, in addition to free floating DNA of maternal origin. In addition, there also may be enucleated fetal blood cells comprising DNA of fetal origin, in addition to many blood cells of maternal origin, which typically do not contain nuclear DNA. There are many methods know in the art to isolate fetal DNA, or create fractions enriched in fetal DNA. For example, chromatography has been show to create certain fractions that are enriched in fetal DNA.

Once the sample of maternal blood, plasma, or other fluid, drawn in a relatively non-invasive manner, and that contains an amount of fetal DNA, either cellular or free floating, either enriched in its proportion to the maternal DNA, or in its original ratio, is in hand, one may genotype the DNA found in said sample. In some embodiments, the blood may be drawn using a needle to withdraw blood from a vein, for example, the basilica vein. The method described herein can be used to determine genotypic data of the fetus. For example, it can be used to determine the ploidy state at one or more chromosomes, it can be used to determine the identity of one or a set of SNPs, including insertions, deletions, and translocations. It can be used to determine one or more haplotypes, including the parent of origin of one or more genotypic features.

Note that this method will work with any nucleic acids that can be used for any genotyping and/or sequencing methods, such as the ILLUMINA INFINIUM ARRAY platform, AFFYMETRIX GENECHIP, ILLUMINA GENOME ANALYZER, or LIFE TECHNOLOGIES' SOLID SYSTEM. This includes extracted free-floating DNA from plasma or amplifications (e.g. whole genome amplification, PCR) of the same; genomic DNA from other cell types (e.g. human lymphocytes from whole blood) or amplifications of the same. For preparation of the DNA, any extraction or purification method that generates genomic DNA suitable for the one of these platforms will work as well. This method could work equally well with samples of RNA. In an embodiment, storage of the samples may be done in a way that will minimize degradation (e.g. below freezing, at about −20 C, or at a lower temperature).
Parental Support Some embodiments may be used in combination with the PARENTAL SUPPORT™ (PS) method, embodiments of which are described in U.S. application Ser. No. 11/603,406 (US Publication No.: 20070184467), U.S. application Ser. No. 12/076,348 (US Publication No.: 20080243398), U.S. application Ser. No. 13/110,685, PCT Application PCT/US09/52730 (PCT Publication No.: WO/2010/017214), and PCT Application No. PCT/US10/050824 (PCT Publication No.: WO/2011/041485) which are incorporated herein by reference in their entirety. PARENTAL SUPPORT™ is an informatics based approach that can be used to analyze genetic data. In some embodiments, the methods disclosed herein may be considered as part of the PARENTAL SUPPORT™ method. In some embodiments, The PARENTAL SUPPORT™ method is a collection of methods that may be used to determine the genetic data of a target individual, with high accuracy, of one or a small number of cells from that individual, or of a mixture of DNA consisting of DNA from the target individual and DNA from one or a plurality of other individuals, specifically to determine disease-related alleles, other alleles of interest, and/or the ploidy state of one or a plurality of chromosomes in the target individual. PARENTAL SUPPORT™ may refer to any of these methods. PARENTAL SUPPORT™ is an example of an informatics based method. Exemplary embodiments of the PARENTAL SUPPORT™ method are illustrated in FIGS. 29-31G and described in Example 19.

The PARENTAL SUPPORT™ method makes use of known parental genetic data, i.e. haplotypic and/or diploid genetic data of the mother and/or the father, together with the knowledge of the mechanism of meiosis and the imperfect measurement of the target DNA, and possibly of one or more related individuals, along with population based crossover frequencies, in order to reconstruct, in silico, the genotype at a plurality of alleles, and/or the ploidy state of an embryo or of any target cell(s), and the target DNA at the location of key loci with a high degree of confidence. The PARENTAL SUPPORT™ method can reconstruct not only single nucleotide polymorphisms (SNPs) that were measured poorly, but also insertions and deletions, and SNPs or whole regions of DNA that were not measured at all. Furthermore, the PARENTAL SUPPORT™ method can both measure multiple disease-linked loci as well as screen for aneuploidy, from a single cell. In some embodiments, the PARENTAL SUPPORT™ method may be used to characterize one or more cells from embryos biopsied during an IVF cycle to determine the genetic condition of the one or more cells.

The PARENTAL SUPPORT™ method allows the cleaning of noisy genetic data. This may be done by inferring the correct genetic alleles in the target genome (embryo) using the genotype of related individuals (parents) as a reference. PARENTAL SUPPORT™ may be particularly relevant where only a small quantity of genetic material is available (e.g. PGD) and where direct measurements of the genotypes are inherently noisy due to the limited amounts of genetic material. PARENTAL SUPPORT™ may be particularly relevant where only a small fraction of the genetic material available is from the target individual (e.g. NPD) and where direct measurements of the genotypes are inherently noisy due to the contaminating DNA signal from another individual. The PARENTAL SUPPORT™ method is able to reconstruct highly accurate ordered diploid allele sequences on the embryo, together with copy number of chromosomes segments, even though the conventional, unordered diploid measurements may be characterized by high rates of allele dropouts, drop-ins, variable amplification biases and other errors. The method may employ both an underlying genetic model and an underlying model of measurement error. The genetic model may determine both allele probabilities at each SNP and crossover probabilities between SNPs. Allele probabilities may be modeled at each SNP based on data obtained from the parents and model crossover probabilities between SNPs based on data obtained from the HapMap database, as developed by the International HapMap Project. Given the proper underlying genetic model and measurement error model, maximum a posteriori (MAP) estimation may be used, with modifications for computationally efficiency, to estimate the correct, ordered allele values at each SNP in the embryo.

The techniques outlined above, in some cases, are able to determine the genotype of an individual given a very small amount of DNA originating from that individual. This could be the DNA from one or a small number of cells, or it could be from the small amount of fetal DNA found in maternal blood.

Hypotheses

In the context of this disclosure, a hypothesis refers to a possible genetic state. It may refer to a possible ploidy state. It may refer to a possible allelic state. A set of hypotheses may refer to a set of possible genetic states, a set of possible allelic states, a set of possible ploidy states, or combinations thereof. In some embodiments, a set of hypotheses may be designed such that one hypothesis from the set will correspond to the actual genetic state of any given individual. In some embodiments, a set of hypotheses may be designed such that every possible genetic state may be described by at least one hypothesis from the set. In some embodiments of the present disclosure, one aspect of a method is to determine which hypothesis corresponds to the actual genetic state of the individual in question.

In another embodiment of the present disclosure, one step involves creating a hypothesis. In some embodiments it may be a copy number hypothesis. In some embodiments it may involve a hypothesis concerning which segments of a chromosome from each of the related individuals correspond genetically to which segments, if any, of the other related individuals. Creating a hypothesis may refer to the act of setting the limits of the variables such that the entire set of possible genetic states that are under consideration are encompassed by those variables.

A "copy number hypothesis," also called a "ploidy hypothesis," or a "ploidy state hypothesis," may refer to a hypothesis concerning a possible ploidy state for a given chromosome copy, chromosome type, or section of a chromosome, in the target individual. It may also refer to the ploidy state at more than one of the chromosome types in the individual. A set of copy number hypotheses may refer to a set of hypotheses where each hypothesis corresponds to a different possible ploidy state in an individual. A set of hypotheses may concern a set of possible ploidy states, a set of possible parental haplotypes contributions, a set of possible fetal DNA percentages in the mixed sample, or combinations thereof. In some embodiments, the copy number hypotheses include all fetuses in a multiple pregnancy being euploid, all fetuses in a multiple pregnancy being aneuploid (such as any of the aneuploidies disclosed herein), and/or one or more fetuses in a multiple pregnancy being euploid and one or more fetuses in a multiple pregnancy being aneuploidy. In some embodiments, the copy number hypotheses include identical twins (also referred to as monozygotic twins) or fraternal twins (also referred to as dizygotic twins). In some embodiments, the copy number hypotheses include a molar pregnancy, such as a complete or partial molar pregnancy.

A normal individual contains one of each chromosome type from each parent. However, due to errors in meiosis and mitosis, it is possible for an individual to have 0, 1, 2, or more of a given chromosome type from each parent. In practice, it is rare to see more that two of a given chromosomes from a parent. In this disclosure, some embodiments only consider the possible hypotheses where 0, 1, or 2 copies of a given chromosome come from a parent; it is a trivial extension to consider more or less possible copies originating from a parent. In some embodiments, for a given chromosome, there are nine possible hypotheses: the three possible hypothesis concerning 0, 1, or 2 chromosomes of maternal origin, multiplied by the three possible hypotheses concerning 0, 1, or 2 chromosomes of paternal origin. Let (m,f) refer to the hypothesis where m is the number of a given chromosome inherited from the mother, and f is the number of a given chromosome inherited from the father. Therefore, the nine hypotheses are (0,0), (0,1), (0,2), (1,0), (1,1), (1,2), (2,0), (2,1), and (2,2). These may also be written as $H_{00}$, $H_{01}$, $H_{02}$, $H_{10}$, $H_{12}$, $H_{20}$, $H_{21}$, and $H_{22}$. The different hypotheses correspond to different ploidy states. For example, (1,1) refers to a normal disomic chromosome; (2,1) refers to a maternal trisomy, and (0,1) refers to a paternal monosomy. In some embodiments, the case where two chromosomes are inherited from one parent and one chromosome is inherited from the other parent may be further differentiated into two cases: one where the two chromosomes are identical (matched copy error), and one where the two chromosomes are homologous but not identical (unmatched copy error). In these embodiments, there are sixteen possible hypotheses. It should be understood that it is possible to use other sets of hypotheses, and a different number of hypotheses.

In some embodiments of the present disclosure, the ploidy hypothesis refers to a hypothesis concerning which chromosome from other related individuals correspond to a chromosome found in the target individual's genome. In some embodiments, a key to the method is the fact that related individuals can be expected to share haplotype blocks, and using measured genetic data from related individuals, along with a knowledge of which haplotype blocks match between the target individual and the related individual, it is possible to infer the correct genetic data for a target individual with higher confidence than using the target individual's genetic measurements alone. As such, in some embodiments, the ploidy hypothesis may concern not only the number of chromosomes, but also which chromosomes in related individuals are identical, or nearly identical, with one or more chromosomes in the target individual.

Once the set of hypotheses have been defined, when the algorithms operate on the input genetic data, they may output a determined statistical probability for each of the hypotheses under consideration. The probabilities of the various hypotheses may be determined by mathematically calculating, for each of the various hypotheses, the value that the probability equals, as stated by one or more of the expert techniques, algorithms, and/or methods described elsewhere in this disclosure, using the relevant genetic data as input.

Once the probabilities of the different hypotheses are estimated, as determined by a plurality of techniques, they may be combined. This may entail, for each hypothesis, multiplying the probabilities as determined by each technique. The product of the probabilities of the hypotheses may be normalized. Note that one ploidy hypothesis refers to one possible ploidy state for a chromosome.

The process of "combining probabilities," also called "combining hypotheses," or combining the results of expert techniques, is a concept that should be familiar to one skilled in the art of linear algebra. One possible way to combine probabilities is as follows: When an expert technique is used to evaluate a set of hypotheses given a set of genetic data, the output of the method is a set of probabilities that are associated, in a one-to-one fashion, with each hypothesis in the set of hypotheses. When a set of probabilities that were determined by a first expert technique, each of which are associated with one of the hypotheses in the set, are combined with a set of probabilities that were determined by a second expert technique, each of which are associated with the same set of hypotheses, then the two sets of probabilities are multiplied. This means that, for each hypothesis in the set, the two probabilities that are associated with that hypothesis, as determined by the two expert methods, are multiplied together, and the corresponding product is the output probability. This process may be expanded to any number of expert techniques. If only one expert technique is used, then the output probabilities are the same as the input probabilities. If more than two expert techniques are used, then the relevant probabilities may be multiplied at the same time. The products may be normalized so that the probabilities of the hypotheses in the set of hypotheses sum to 100%.

In some embodiments, if the combined probabilities for a given hypothesis are greater than the combined probabilities for any of the other hypotheses, then it may be considered that that hypothesis is determined to be the most likely. In some embodiments, a hypothesis may be determined to be the most likely, and the ploidy state, or other genetic state, may be called if the normalized probability is greater than a threshold. In an embodiment, this may mean that the number and identity of the chromosomes that are associated with that hypothesis may be called as the ploidy state. In an embodiment, this may mean that the identity of the alleles that are associated with that hypothesis may be called as the allelic state. In some embodiments, the threshold may be between about 50% and about 80%. In some embodiments the threshold may be between about 80% and about 90%. In some embodiments the threshold may be between about 90% and about 95%. In some embodiments the threshold may be between about 95% and about 99%. In some embodiments the threshold may be between about 99% and about 99.9%. In some embodiments the threshold may be above about 99.9%.

Parental Contexts

The parental context refers to the genetic state of a given allele, on each of the two relevant chromosomes for one or both of the two parents of the target. Note that in an embodiment, the parental context does not refer to the allelic state of the target, rather, it refers to the allelic state of the parents. The parental context for a given SNP may consist of four base pairs, two paternal and two maternal; they may be the same or different from one another. It is typically written as "$m_1m_2|f_1f_2$," where $m_1$ and $m_2$ are the genetic state of the given SNP on the two maternal chromosomes, and $f_1$ and $f_2$ are the genetic state of the given SNP on the two paternal chromosomes. In some embodiments, the parental context may be written as "$f_1f_2|m_1m_2$." Note that subscripts "1" and "2" refer to the genotype, at the given allele, of the first and second chromosome; also note that the choice of which chromosome is labeled "1" and which is labeled "2" is arbitrary.

Note that in this disclosure, A and B are often used to generically represent base pair identities; A or B could equally well represent C (cytosine), G (guanine), A (adenine) or T (thymine). For example, if, at a given SNP based allele, the mother's genotype was T at that SNP on one chromosome, and G at that SNP on the homologous chromosome, and the father's genotype at that allele is G at that SNP on both of the homologous chromosomes, one may say that the target individual's allele has the parental context of AB|BB; it could also be said that the allele has the parental context of AB|AA. Note that, in theory, any of the four possible nucleotides could occur at a given allele, and thus it is possible, for example, for the mother to have a genotype of AT, and the father to have a genotype of GC at a given allele. However, empirical data indicate that in most cases only two of the four possible base pairs are observed at a given allele. It is possible, for example when using single tandem repeats, to have more than two parental, more than four and even more than ten contexts. In this disclosure the discussion assumes that only two possible base pairs will be observed at a given allele, although the embodiments disclosed herein could be modified to take into account the cases where this assumption does not hold.

A "parental context" may refer to a set or subset of target SNPs that have the same parental context. For example, if one were to measure 1000 alleles on a given chromosome on a target individual, then the context AA|BB could refer to the set of all alleles in the group of 1,000 alleles where the genotype of the mother of the target was homozygous, and the genotype of the father of the target is homozygous, but where the maternal genotype and the paternal genotype are dissimilar at that locus. If the parental data is not phased, and thus AB=BA, then there are nine possible parental contexts: AA|AA, AA|AB, AA|BB, AB|AA, AB|AB, AB|BB, BB|AA, BB|AB, and BB|BB. If the parental data is phased, and thus AB/BA, then there are sixteen different possible parental contexts: AA|AA, AA|AB, AA|BA, AA|BB, AB|AA, AB|AB, AB|BA, AB|BB, BA|AA, BA|AB, BA|BA, BA|BB, BB|AA, BB|AB, BB|BA, and BB|BB. Every SNP allele on a chromosome, excluding some SNPs on the sex chromosomes, has one of these parental contexts. The set of SNPs wherein the parental context for one parent is heterozygous may be referred to as the heterozygous context.

Use of Parental Contexts in NPD

Non-invasive prenatal diagnosis is an important technique that can be used to determine the genetic state of a fetus from genetic material that is obtained in a non-invasive manner, for example from a blood draw on the pregnant mother. The blood could be separated and the plasma isolated, followed by isolation of the plasma DNA. Size selection could be used to isolate the DNA of the appropriate length. The DNA may be preferentially enriched at a set of loci. This DNA can then be measured by a number of means, such as by hybridizing to a genotyping array and measuring the fluorescence, or by sequencing on a high throughput sequencer.

When sequencing is used for ploidy calling of a fetus in the context of non-invasive prenatal diagnosis, there are a number of ways to use the sequence data. The most common way one could use the sequence data is to simply count the number of reads that map to a given chromosome. For example, imagine if you are trying to determine the ploidy state of chromosome 21 on the fetus. Further imagine that the DNA in the sample is comprised of 10% DNA of fetal origin, and 90% DNA of maternal origin. In this case, you could look at the average number of reads on a chromosome which can be expected to be disomic, for example chromosome 3, and compare that to the number of read on chromosome 21, where the reads are adjusted for the number of base pairs on that chromosome that are part of a unique sequence. If the fetus were euploid, one would expect the amount of DNA per unit of genome to be about equal at all locations (subject to stochastic variations). On the other hand, if the fetus were trisomic at chromosome 21, then one would expect there to be more slightly more DNA per genetic unit from chromosome 21 than the other locations on the genome. Specifically one would expect there to be about 5% more DNA from chromosome 21 in the mixture. When sequencing is used to measure the DNA, one would expect about 5% more uniquely mappable reads from chromosome 21 per unique segment than from the other chromosomes. One could use the observation of an amount of DNA from a particular chromosome that is higher than a certain threshold, when adjusted for the number of sequences that are uniquely mappable to that chromosome, as the basis for an aneuploidy diagnosis. Another method that may be used to detect aneuploidy is similar to that above, except that parental contexts could be taken into account.

When considering which alleles to target, one may consider the likelihood that some parental contexts are likely to be more informative than others. For example, AA|BB and the symmetric context BB|AA are the most informative contexts, because the fetus is known to carry an allele that is different from the mother. For reasons of symmetry, both AA|BB and BB|AA contexts may be referred to as AA|BB. Another set of informative parental contexts are AA|AB and BB|AB, because in these cases the fetus has a 50% chance of carrying an allele that the mother does not have. For reasons of symmetry, both AA|AB and BB|AB contexts may be referred to as AA|AB. A third set of informative parental contexts are AB|AA and AB|BB, because in these cases the fetus is carrying a known paternal allele, and that allele is also present in the maternal genome. For reasons of symmetry, both AB|AA and AB|BB contexts may be referred to as AB|AA. A fourth parental context is AB|AB where the fetus has an unknown allelic state, and whatever the allelic state, it is one in which the mother has the same alleles. The fifth parental context is AA|AA, where the mother and father are heterozygous.

Different Implementations of the Presently Disclosed Embodiments

Methods are disclosed herein for determining the ploidy state of a target individual. The target individual may be a blastomere, an embryo, or a fetus. In some embodiments of the present disclosure, a method for determining the ploidy state of one or more chromosome in a target individual may include any of the steps described in this document, and combinations thereof:

In some embodiments the source of the genetic material to be used in determining the genetic state of the fetus may be fetal cells, such as nucleated fetal red blood cells, isolated from the maternal blood. The method may involve obtaining a blood sample from the pregnant mother. The method may involve isolating a fetal red blood cell using visual techniques, based on the idea that a certain combination of colors are uniquely associated with nucleated red blood cell, and a similar combination of colors is not associated with any other present cell in the maternal blood. The combination of colors associated with the nucleated red blood cells may include the red color of the hemoglobin around the nucleus, which color may be made more distinct by staining, and the color of the nuclear material which can be stained, for example, blue. By isolating the cells from maternal blood and spreading them over a slide, and then identifying those points at which one sees both red (from the Hemoglobin) and blue (from the nuclear material) one may be able to identify the location of nucleated red blood cells. One may then extract those nucleated red blood cells using a micromanipulator, use genotyping and/or sequencing techniques to measure aspects of the genotype of the genetic material in those cells.

In an embodiment, one may stain the nucleated red blood cell with a die that only fluoresces in the presence of fetal hemoglobin and not maternal hemoglobin, and so remove the ambiguity between whether a nucleated red blood cell is derived from the mother or the fetus. Some embodiments of the present disclosure may involve staining or otherwise marking nuclear material. Some embodiments of the present disclosure may involve specifically marking fetal nuclear material using fetal cell specific antibodies.

There are many other ways to isolate fetal cells from maternal blood, or fetal DNA from maternal blood, or to enrich samples of fetal genetic material in the presence of maternal genetic material. Some of these methods are listed here, but this is not intended to be an exhaustive list. Some appropriate techniques are listed here for convenience: using fluorescently or otherwise tagged antibodies, size exclusion chromatography, magnetically or otherwise labeled affinity tags, epigenetic differences, such as differential methylation between the maternal and fetal cells at specific alleles, density gradient centrifugation succeeded by CD45/14 depletion and CD71-positive selection from CD45/14 negative-cells, single or double Percoll gradients with different osmolalities, or galactose specific lectin method.

In an embodiment of the present disclosure, the target individual is a fetus, and the different genotype measurements are made on a plurality of DNA samples from the fetus. In some embodiments of the present disclosure, the fetal DNA samples are from isolated fetal cells where the fetal cells may be mixed with maternal cells. In some embodiments of the present disclosure, the fetal DNA samples are from free floating fetal DNA, where the fetal DNA may be mixed with free floating maternal DNA. In some embodiments, the fetal DNA samples may be derived from maternal plasma or maternal blood that contains a mixture of maternal DNA and fetal DNA. In some embodiments, the fetal DNA may be mixed with maternal DNA in maternal: fetal ratios ranging from 99.9:0.1% to 99:1%; 99:1% to 90:10%; 90:10% to 80:20%; 80:20% to 70:30%; 70:30% to 50:50%; 50:50% to 10:90%; or 10:90% to 1:99%; 1:99% to 0.1:99.9%.

The genetic data of the target individual and/or of the related individual can be transformed from a molecular state to an electronic state by measuring the appropriate genetic material using tools and or techniques taken from a group including, but not limited to: genotyping microarrays, and high throughput sequencing. Some high throughput sequencing methods include Sanger DNA sequencing, pyrosequencing, the ILLUMINA SOLEXA platform, ILLUMINA's GENOME ANALYZER, or APPLIED BIOSYSTEM's 454 sequencing platform, HELICOS's TRUE SINGLE MOLECULE SEQUENCING platform, HALCYON MOLECULAR's electron microscope sequencing method, or any other sequencing method. All of these methods physically transform the genetic data stored in a sample of DNA into a set of genetic data that is typically stored in a memory device in route to being processed.

A relevant individual's genetic data may be measured by analyzing substances taken from a group including, but not limited to: the individual's bulk diploid tissue, one or more diploid cells from the individual, one or more haploid cells from the individual, one or more blastomeres from the target individual, extra-cellular genetic material found on the individual, extra-cellular genetic material from the individual found in maternal blood, cells from the individual found in maternal blood, one or more embryos created from (a) gamete(s) from the related individual, one or more blastomeres taken from such an embryo, extra-cellular genetic material found on the related individual, genetic material known to have originated from the related individual, and combinations thereof.

In some embodiments, a set of at least one ploidy state hypothesis may be created for each of the chromosomes types of interest of the target individual. Each of the ploidy state hypotheses may refer to one possible ploidy state of the chromosome or chromosome segment of the target individual. The set of hypotheses may include some or all of the possible ploidy states that the chromosome of the target individual may be expected to have. Some of the possible ploidy states may include nullsomy, monosomy, disomy, uniparental disomy, euploidy, trisomy, matching trisomy, unmatching trisomy, maternal trisomy, paternal trisomy, tetrasomy, balanced (2:2) tetrasomy, unbalanced (3:1) tetrasomy, pentasomy, hexasomy, other aneuploidy, and combinations thereof. Any of these aneuploidy states may be mixed or partial aneuploidy such as unbalanced translocations, balanced translocations, Robertsonian translocations, recombinations, deletions, insertions, crossovers, and combinations thereof.

In some embodiments, the knowledge of the determined ploidy state may be used to make a clinical decision. This knowledge, typically stored as a physical arrangement of matter in a memory device, may then be transformed into a report. The report may then be acted upon. For example, the clinical decision may be to terminate the pregnancy; alternately, the clinical decision may be to continue the pregnancy. In some embodiments the clinical decision may involve an intervention designed to decrease the severity of the phenotypic presentation of a genetic disorder, or a decision to take relevant steps to prepare for a special needs child.

In an embodiment of the present disclosure, any of the methods described herein may be modified to allow for multiple targets to come from same target individual, for example, multiple blood draws from the same pregnant mother. This may improve the accuracy of the model, as multiple genetic measurements may provide more data with which the target genotype may be determined. In an embodiment, one set of target genetic data served as the primary data which was reported, and the other served as data to double-check the primary target genetic data. In an embodiment, a plurality of sets of genetic data, each measured from genetic material taken from the target individual, are considered in parallel, and thus both sets of target genetic data serve to help determine which sections of parental genetic data, measured with high accuracy, composes the fetal genome.

In an embodiment, the method may be used for the purpose of paternity testing. For example, given the SNP-based genotypic information from the mother, and from a man who may or may not be the genetic father, and the measured genotypic information from the mixed sample, it is possible to determine if the genotypic information of the male indeed represents that actual genetic father of the gestating fetus. A simple way to do this is to simply look at the contexts where the mother is AA, and the possible father is AB or BB. In these cases, one may expect to see the father contribution half (AA|AB) or all (AA|BB) of the time, respectively. Taking into account the expected ADO, it is straightforward to determine whether or not the fetal SNPs that are observed are correlated with those of the possible father.

One embodiment of the present disclosure could be as follows: a pregnant woman wants to know if her fetus is afflicted with Down Syndrome, and/or if it will suffer from Cystic Fibrosis, and she does not wish to bear a child that is afflicted with either of these conditions. A doctor takes her blood, and stains the hemoglobin with one marker so that it appears clearly red, and stains nuclear material with another marker so that it appears clearly blue. Knowing that maternal red blood cells are typically a nuclear, while a high proportion of fetal cells contain a nucleus, the doctor is able to visually isolate a number of nucleated red blood cells by identifying those cells that show both a red and blue color. The doctor picks up these cells off the slide with a micromanipulator and sends them to a lab which amplifies and genotypes ten individual cells. By using the genetic measurements, the PARENTAL SUPPORT™ method is able to determine that six of the ten cells are maternal blood cells, and four of the ten cells are fetal cells. If a child has already been born to a pregnant mother, PARENTAL SUPPORT™ can also be used to determine that the fetal cells are distinct from the cells of the born child by making reliable allele calls on the fetal cells and showing that they are dissimilar to those of the born child. Note that this method is similar in concept to the paternal testing embodiment of the present disclosure. The genetic data measured from the fetal cells may be of very poor quality, comprising many allele drop outs, due to the difficulty of genotyping single cells. The clinician is able to use the measured fetal DNA along with the reliable DNA measurements of the parents to infer aspects of the genome of the fetus with high accuracy using PARENTAL SUPPORT™, thereby transforming the genetic data contained on genetic material from the fetus into the predicted genetic state of the fetus, stored on a computer. The clinician is able to determine both the ploidy state of the fetus, and the presence or absence of a plurality of disease-linked genes of interest. It turns out that the fetus is euploid, and is not a carrier for cystic fibrosis, and the mother decides to continue the pregnancy.

In an embodiment of the present disclosure, a pregnant mother would like to determine if her fetus is afflicted with any whole chromosomal abnormalities. She goes to her doctor, and gives a sample of her blood, and she and her husband gives samples of their own DNA from cheek swabs. A laboratory researcher genotypes the parental DNA using the MDA protocol to amplify the parental DNA, and ILLUMINA INFINIUM arrays to measure the genetic data of the parents at a large number of SNPs. The researcher then spins down the blood, takes the plasma, and isolates a sample of free-floating DNA using size exclusion chromatography. Alternately, the researcher uses one or more fluorescent antibodies, such as one that is specific to fetal hemoglobin to isolate a nucleated fetal red blood cell. The researcher then takes the isolated or enriched fetal genetic material and amplifies it using a library of 70-mer oligonucleotides appropriately designed such that two ends of each oligonucleotide corresponded to the flanking sequences on either side of a target allele. Upon addition of a polymerase, ligase, and the appropriate reagents, the oligonucleotides underwent gap-filling circularization, capturing the desired allele. An exonuclease was added, heat-inactivated, and the products were used directly as a template for PCR amplification. The PCR products were sequenced on an ILLUMINA GENOME ANALYZER. The sequence reads were used as input for the PARENTAL SUPPORT™ method, which then predicted the ploidy state of the fetus.

In another embodiment, a couple—where the mother, who is pregnant, and is of advanced maternal age—wants to know whether the gestating fetus has Down syndrome, Turner Syndrome, Prader Willi syndrome, or some other whole chromosomal abnormality. The obstetrician takes a blood draw from the mother and father. The blood is sent to a laboratory, where a technician centrifuges the maternal sample to isolate the plasma and the buffy coat. The DNA in the buffy coat and the paternal blood sample are transformed through amplification and the genetic data encoded in the amplified genetic material is further transformed from molecularly stored genetic data into electronically stored genetic data by running the genetic material on a high throughput sequencer to measure the parental genotypes. The plasma sample is preferentially enriched at a set of loci using a 5,000-plex hemi-nested targeted PCR method. The mixture of DNA fragments is prepared into a DNA library suitable for sequencing. The DNA is then sequenced using a high throughput sequencing method, for example, the ILLUMINA GAIIx GENOME ANALYZER. The sequencing transforms the information that is encoded molecularly in the DNA into information that is encoded electronically in computer hardware. An informatics based technique that includes the presently disclosed embodiments, such as PARENTAL SUPPORT™, may be used to determine the ploidy state of the fetus. This may involve calculating, on a computer, allele count probabilities at the plurality of polymorphic loci from the DNA measurements made on the prepared sample; creating, on a computer, a plurality of ploidy hypotheses each pertaining to a different possible ploidy state of the chromosome; building, on a computer, a joint distribution model for the expected allele counts at the plurality of polymorphic loci on the chromosome for each ploidy hypothesis; determining, on a computer, a relative probability of each of the ploidy hypotheses using the joint distribution model and the allele counts measured on the prepared sample; and calling the ploidy state of the fetus by selecting the ploidy state corresponding to the hypothesis with the greatest probability. It is determined that the fetus has Down syndrome. A report is printed out, or sent electronically to the pregnant woman's obstetrician, who transmits the diagnosis to the woman. The woman, her husband, and the doctor sit down and discuss their options. The couple decides to terminate the pregnancy based on the knowledge that the fetus is afflicted with a trisomic condition.

In an embodiment, a company may decide to offer a diagnostic technology designed to detect aneuploidy in a gestating fetus from a maternal blood draw. Their product may involve a mother presenting to her obstetrician, who may draw her blood. The obstetrician may also collect a genetic sample from the father of the fetus. A clinician may isolate the plasma from the maternal blood, and purify the DNA from the plasma. A clinician may also isolate the buffy coat layer from the maternal blood, and prepare the DNA from the buffy coat. A clinician may also prepare the DNA from the paternal genetic sample. The clinician may use molecular biology techniques described in this disclosure to append universal amplification tags to the DNA in the DNA derived from the plasma sample. The clinician may amplify the universally tagged DNA. The clinician may preferentially enrich the DNA by a number of techniques including capture by hybridization and targeted PCR. The targeted PCR may involve nesting, hemi-nesting or semi-nesting, or any other approach to result in efficient enrichment of the plasma derived DNA. The targeted PCR may be massively multiplexed, for example with 10,000 primers in one reaction volume, where the primers target SNPs on chromosomes 13, 18, 21, X and those loci that are common to both X and Y, and optionally other chromosomes as well. The selective enrichment and/or amplification may involve tagging each individual molecule with different tags, molecular barcodes, tags for amplification, and/or tags for sequencing. The clinician may then sequence the plasma sample, and also possibly also the prepared maternal and/or paternal DNA. The molecular biology steps may be executed either wholly or partly by a diagnostic box. The sequence data may be fed into a single computer, or to another type of computing platform such as may be found in 'the cloud'. The computing platform may calculate allele counts at the targeted polymorphic loci from the measurements made by the sequencer. The computing platform may create a plurality of ploidy hypotheses pertaining to nullsomy, monosomy, disomy, matched trisomy, and unmatched trisomy for each of chromosomes 13, 18, 21, X and Y. The computing platform may build a joint distribution model for the expected allele counts at the targeted loci on the chromosome for each ploidy hypothesis for each of the five chromosomes being interrogated. The computing platform may determine a probability that each of the ploidy hypotheses is true using the joint distribution model and the allele counts measured on the preferentially enriched DNA derived from the plasma sample. The computing platform may call the ploidy state of the fetus, for each of chromosome 13, 18, 21, X and Y by selecting the ploidy state corresponding to the germane hypothesis with the greatest probability. A report may be generated comprising the called ploidy states, and it may be sent to the obstetrician electronically, displayed on an output device, or a printed hard copy of the report may be delivered to the obstetrician. The obstetrician may inform the patient and optionally the father of the fetus, and they may decide which clinical options are open to them, and which is most desirable.

In another embodiment, a pregnant woman, hereafter referred to as "the mother" may decide that she wants to know whether or not her fetus(es) are carrying any genetic abnormalities or other conditions. She may want to ensure that there are not any gross abnormalities before she is confident to continue the pregnancy. She may go to her obstetrician, who may take a sample of her blood. He may also take a genetic sample, such as a buccal swab, from her cheek. He may also take a genetic sample from the father of the fetus, such as a buccal swab, a sperm sample, or a blood sample. He may send the samples to a clinician. The clinician may enrich the fraction of free floating fetal DNA in the maternal blood sample. The clinician may enrich the fraction of enucleated fetal blood cells in the maternal blood sample. The clinician may use various aspects of the methods described herein to determine genetic data of the fetus. That genetic data may include the ploidy state of the fetus, and/or the identity of one or a number of disease linked alleles in the fetus. A report may be generated summarizing the results of the prenatal diagnosis. The report may be transmitted or mailed to the doctor, who may tell the mother the genetic state of the fetus. The mother may decide to discontinue the pregnancy based on the fact that the fetus has one or more chromosomal, or genetic abnormalities, or undesirable conditions. She may also decide to continue the pregnancy based on the fact that the fetus does not have any gross chromosomal or genetic abnormalities, or any genetic conditions of interest.

Another example may involve a pregnant woman who has been artificially inseminated by a sperm donor, and is pregnant. She wants to minimize the risk that the fetus she is carrying has a genetic disease. She has blood drawn at a phlebotomist, and techniques described in this disclosure are used to isolate three nucleated fetal red blood cells, and a tissue sample is also collected from the mother and genetic father. The genetic material from the fetus and from the mother and father are amplified as appropriate and genotyped using the ILLUMINA INFINIUM BEADARRAY, and the methods described herein clean and phase the parental and fetal genotype with high accuracy, as well as to make ploidy calls for the fetus. The fetus is found to be euploid, and phenotypic susceptibilities are predicted from the reconstructed fetal genotype, and a report is generated and sent to the mother's physician so that they can decide what clinical decisions may be best.

In an embodiment, the raw genetic material of the mother and the father is transformed by way of amplification to an amount of DNA that is similar in sequence, but larger in quantity. Then, by way of a genotyping method, the genotypic data that is encoded by nucleic acids is transformed into genetic measurements that may be stored physically and/or electronically on a memory device, such as those described above. The relevant algorithms that makeup the PARENTAL SUPPORT™ algorithm, relevant parts of which are discussed in detail herein, are translated into a computer program, using a programming language. Then, through the execution of the computer program on the computer hardware, instead of being physically encoded bits and bytes, arranged in a pattern that represents raw measurement data, they become transformed into a pattern that represents a high confidence determination of the ploidy state of the fetus. The details of this transformation will rely on the data itself and the computer language and hardware system used to execute the method described herein. Then, the data that is physically configured to represent a high quality ploidy determination of the fetus is transformed into a report which may be sent to a health care practitioner. This transformation may be carried out using a printer or a computer display. The report may be a printed copy, on paper or other suitable medium, or else it may be electronic. In the case of an electronic report, it may be transmitted, it may be physically stored on a memory device at a location on the computer accessible by the health care practitioner; it also may be displayed on a screen so that it may be read. In the case of a screen display, the data may be transformed to a readable format by causing the physical transformation of pixels on the display device. The transformation may be accomplished by way of physically firing electrons at a phosphorescent screen, by way of altering an electric charge that physically changes the transparency of a specific set of pixels on a screen that may lie in front of a substrate that emits or absorbs photons. This transformation may be accomplished by way of changing the nanoscale orientation of the molecules in a liquid crystal, for example, from nematic to cholesteric or smectic phase, at a specific set of pixels. This transformation may be accomplished by way of an electric current causing photons to be emitted from a specific set of pixels made from a plurality of light emitting diodes arranged in a meaningful pattern. This transformation may be accomplished by any other way used to display information, such as a computer screen, or some other output device or way of transmitting information. The health care practitioner may then act on the report, such that the data in the report is transformed into an action. The action may be to continue or discontinue the pregnancy, in which case a gestating fetus with a genetic abnormality is transformed into non-living fetus. The transformations listed herein may be aggregated, such that, for example, one may transform the genetic material of a pregnant mother and the father, through a number of steps outlined in this disclosure, into a medical decision consisting of aborting a fetus with genetic abnormalities, or consisting of continuing the pregnancy. Alternately, one may transform a set of genotypic measurements into a report that helps a physician treat his pregnant patient.

In an embodiment of the present disclosure, the method described herein can be used to determine the ploidy state of a fetus even when the host mother, i.e. the woman who is pregnant, is not the biological mother of the fetus she is carrying. In an embodiment of the present disclosure, the method described herein can be used to determine the ploidy state of a fetus using only the maternal blood sample, and without the need for a paternal genetic sample.

Some of the math in the presently disclosed embodiments makes hypotheses concerning a limited number of states of aneuploidy. In some cases, for example, only zero, one or two chromosomes are expected to originate from each parent. In some embodiments of the present disclosure, the mathematical derivations can be expanded to take into account other forms of aneuploidy, such as quadrosomy, where three chromosomes originate from one parent, pentasomy, hexasomy etc., without changing the fundamental concepts of the present disclosure. At the same time, it is possible to focus on a smaller number of ploidy states, for example, only trisomy and disomy. Note that ploidy determinations that indicate a non-whole number of chromosomes may indicate mosaicism in a sample of genetic material.

In some embodiments, the genetic abnormality is a type of aneuploidy, such as Down syndrome (or trisomy 21), Edwards syndrome (trisomy 18), Patau syndrome (trisomy 13), Turner Syndrome (45X), Klinefelter's syndrome (a male with 2x chromosomes), Prader-Willi syndrome, and DiGeorge syndrome (UPD 15). Congenital disorders, such as those listed in the prior sentence, are commonly undesirable, and the knowledge that a fetus is afflicted with one or more phenotypic abnormalities may provide the basis for a decision to terminate the pregnancy, to take necessary precautions to prepare for the birth of a special needs child, or to take some therapeutic approach meant to lessen the severity of a chromosomal abnormality.

In some embodiments, the methods described herein can be used at a very early gestational age, for example as early as four week, as early as five weeks, as early as six weeks, as early as seven weeks, as early as eight weeks, as early as nine weeks, as early as ten weeks, as early as eleven weeks, and as early as twelve weeks.

In some embodiments, a method disclosed herein is used in the context of pre-implantation genetic diagnosis (PGD) for embryo selection during in vitro fertilization, where the target individual is an embryo, and the parental genotypic data can be used to make ploidy determinations about the embryo from sequencing data from a single or two cell biopsy from a day 3 embryo or a trophectoderm biopsy from a day 5 or day 6 embryo. In a PGD setting, only the child DNA is measured, and only a small number of cells are tested, generally one to five but as many as ten, twenty or fifty. The total number of starting copies of the A and B alleles (at a SNP) are then trivially determined by the child genotype and the number of cells. In NPD, the number of starting copies is very high and so the allele ratio after PCR is expected to accurately reflect the starting ratio. However, the small number of starting copies in PGD means that contamination and imperfect PCR efficiency have a non-trivial effect on the allele ratio following PCR. This effect may be more important than depth of read in predicting the variance in the allele ratio measured after sequencing. The distribution of measured allele ratio given a known child genotype may be created by Monte Carlo simulation of the PCR process based on the PCR probe efficiency and probability of contamination. Given an allele ratio distribution for each possible child genotype, the likelihoods of various hypotheses can be calculated as described for NIPD.

Maximum Likelihood Estimates

Most methods known in the art for detecting the presence or absence of biological phenomenon or medical condition involve the use of a single hypothesis rejection test, where a metric that is correlated with the condition is measured, and if the metric is on one side of a given threshold, the condition is present, while of the metric falls on the other side of the threshold, the condition is absent. A single-hypothesis rejection test only looks at the null distribution when deciding between the null and alternate hypotheses. Without taking into account the alternate distribution, one cannot estimate the likelihood of each hypothesis given the observed data and therefore cannot calculate a confidence on the call. Hence with a single-hypothesis rejection test, one gets a yes or no answer without a feeling for the confidence associated with the specific case.

In some embodiments, the method disclosed herein is able to detect the presence or absence of biological phenomenon or medical condition using a maximum likelihood method. This is a substantial improvement over a method using a single hypothesis rejection technique as the threshold for calling absence or presence of the condition can be adjusted as appropriate for each case. This is particularly relevant for diagnostic techniques that aim to determine the presence or absence of aneuploidy in a gestating fetus from genetic data available from the mixture of fetal and maternal DNA present in the free floating DNA found in maternal plasma. This is because as the fraction of fetal DNA in the plasma derived fraction changes, the optimal threshold for calling aneuploidy vs. euploidy changes. As the fetal fraction drops, the distribution of data that is associated with an aneuploidy becomes increasingly similar to the distribution of data that is associated with a euploidy.

The maximum likelihood estimation method uses the distributions associated with each hypothesis to estimate the likelihood of the data conditioned on each hypothesis. These conditional probabilities can then be converted to a hypothesis call and confidence. Similarly, maximum a posteriori estimation method uses the same conditional probabilities as the maximum likelihood estimate, but also incorporates population priors when choosing the best hypothesis and determining confidence.

Therefore, the use of a maximum likelihood estimate (MLE) technique, or the closely related maximum a posteriori (MAP) technique give two advantages, first it increases the chance of a correct call, and it also allows a confidence to be calculated for each call. In an embodiment, selecting the ploidy state corresponding to the hypothesis with the greatest probability is carried out using maximum likelihood estimates or maximum a posteriori estimates. In an embodiment, a method is disclosed for determining the ploidy state of a gestating fetus that involves taking any method currently known in the art that uses a single hypothesis rejection technique and reformulating it such that it uses a MLE or MAP technique. Some examples of methods that can be significantly improved by applying these techniques can be found in U.S. Pat. Nos. 8,008,018, 7,888,017, or U.S. Pat. No. 7,332,277.

In an embodiment, a method is described for determining presence or absence of fetal aneuploidy in a maternal plasma sample comprising fetal and maternal genomic DNA, the method comprising: obtaining a maternal plasma sample; measuring the DNA fragments found in the plasma sample with a high throughput sequencer; mapping the sequences to the chromosome and determining the number of sequence reads that map to each chromosome; calculating the fraction of fetal DNA in the plasma sample; calculating an expected distribution of the amount of a target chromosome that would be expected to be present if that if the second target chromosome were euploid and one or a plurality of expected distributions that would be expected if that chromosome were aneuploid, using the fetal fraction and the number of sequence reads that map to one or a plurality of reference chromosomes expected to be euploid; and using a MLE or MAP determine which of the distributions is most likely to be correct, thereby indicating the presence or absence of a fetal aneuploidy. In an embodiment, the measuring the DNA from the plasma may involve conducting massively parallel shotgun sequencing. In an embodiment, the measuring the DNA from the plasma sample may involve sequencing DNA that has been preferentially enriched, for example through targeted amplification, at a plurality of polymorphic or non-polymorphic loci. The plurality of loci may be designed to target one or a small number of suspected aneuploid chromosomes and one or a small number of reference chromosomes. The purpose of the preferential enrichment is to increase the number of sequence reads that are informative for the ploidy determination.

Ploidy Calling Informatics Methods

Described herein is a method for determining the ploidy state of a fetus given sequence data. In some embodiments, this sequence data may be measured on a high throughput sequencer. In some embodiments, the sequence data may be measured on DNA that originated from free floating DNA isolated from maternal blood, wherein the free floating DNA comprises some DNA of maternal origin, and some DNA of fetal/placental origin. This section will describe one embodiment of the present disclosure in which the ploidy state of the fetus is determined assuming that fraction of fetal DNA in the mixture that has been analyzed is not known and will be estimated from the data. It will also describe an embodiment in which the fraction of fetal DNA ("fetal fraction") or the percentage of fetal DNA in the mixture can be measured by another method, and is assumed to be known in determining the ploidy state of the fetus. In some embodiments the fetal fraction can be calculated using only the genotyping measurements made on the maternal blood sample itself, which is a mixture of fetal and maternal DNA. In some embodiments the fraction may be calculated also using the measured or otherwise known genotype of the mother and/or the measured or otherwise known genotype of the father. In another embodiment ploidy state of the fetus can be determined solely based on the calculated fraction of fetal DNA for the chromosome in question compared to the calculated fraction of fetal DNA for the reference chromosome assumed disomic.

In the preferred embodiment, suppose that, for a particular chromosome, we observe and analyze N SNPs, for which we have:

Set of NR free floating DNA sequence measurements $S=(s_1, \ldots, s_{NR})$. Since this method utilizes the SNP measurements, all sequence data that corresponds to non-polymorphic loci can be disregarded. In a simplified version, where we have (A,B) counts on each SNP, where A and B correspond to the two alleles present at a given locus, S can be written as $S=((a_1,b_1), \ldots, (a_N, b_N))$, where $a_i$ is the A count on SNP i, $b_i$ is the B count on SNP i, and $\Sigma_{i=1:N} (a_i+b_i)=NR$ Parent data consisting of Genotypes from a SNP microarray or other intensity based genotyping platform: mother $M=(m_1, \ldots, m_N)$, father $F=(f_1, \ldots, f_N)$, where $m_i$, $f_i \in$ (AA,AB, BB).

AND/OR sequence data measurements: NRM mother measurements $SM=(sm_1, \ldots, sm_{nrm})$, NRF father measurements $SF=(sf_1, \ldots, sf_{nrf})$. Similar to the above simplification, if we have (A,B) counts on each SNP $SM=((am_1, bm_1), \ldots, (am_N, bm_N))$, $SF=((af_1,bf_1), \ldots, (af_N, bf_N))$ Collectively, the mother, father child data are denoted as D=(M,F,SM,SF,S). Note that the parent data is desired and increases the accuracy of the algorithm, but is NOT necessary, especially the father data. This means that even in the absence of mother and/or father data, it is possible to get very accurate copy number results.

It is possible to derive the best copy number estimate (H*) by maximizing the data log likelihood LIK(D|H) over all hypotheses (H) considered. In particular it is possible to determine the relative probability of each of the ploidy hypotheses using the joint distribution model and the allele counts measured on the prepared sample, and using those relative probabilities to determine the hypothesis most likely to be correct as follows:

$$H^* = \underset{H}{\operatorname{argmax}}\ LIK(D\,|\,H)$$

Similarly the a posteriori hypothesis likelihood given the data may be written as:

$$H^* \underset{H}{\operatorname{argmax}}\ LIK(D\,|\,H) * priorprob(H)$$

Where priorprob(H) is the prior probability assigned to each hypothesis H, based on model design and prior knowledge.

It is also possible to use priors to find the maximum a posteriori estimate:

$$H_{MA} = \underset{H}{\operatorname{argmax}}\ LIK(D\,|\,H)$$

In an embodiment, the copy number hypotheses that may be considered are:

Monosomy:
maternal H10 (one copy from mother)
paternal H01 (one copy from father)
Disomy: H11 (one copy each mother and father)
Simple trisomy, no crossovers considered:
Maternal: H21_matched (two identical copies from mother, one copy from father),
H21_unmatched (BOTH copies from mother, one copy from father)
Paternal: H12_matched (one copy from mother, two identical copies from father),
H12_unmatched (one copy from mother, both copies from father)
Composite trisomy, allowing for crossovers (using a joint distribution model):
maternal H21 (two copies from mother, one from father),
paternal H12 (one copy from mother, two copies from father)

In other embodiments, other ploidy states, such as nullsomy (H00), uniparental disomy (H20 and H02), and tetrasomy (H04, H13, H22, H31 and H40), may be considered.

If there are no crossovers, each trisomy, whether the origin was mitosis, meiosis I, or meiosis II, would be one of the matched or unmatched trisomies. Due to crossovers, true trisomy is usually a combination of the two. First, a method to derive hypothesis likelihoods for simple hypotheses is described. Then a method to derive hypothesis likelihoods for composite hypotheses is described, combining individual SNP likelihood with crossovers.

LIK(D|H) for a Simple Hypothesis

In an embodiment, LIK(D|H) may be determined for simple hypotheses, as follows. For simple hypotheses H, LIK(H), the log likelihood of hypothesis H on a whole chromosome, may be calculated as the sum of log likelihoods of individual SNPs, assuming known or derived child fraction cf. In an embodiment it is possible to derive cf from the data.

$$LIK(D \mid H) = \sum_i LIK(D \mid H, cf, i)$$

This hypothesis does not assume any linkage between SNPs, and therefore does not utilize a joint distribution model.

In some embodiments, the Log Likelihood may be determined on a per SNP basis. On a particular SNP i, assuming fetal ploidy hypothesis H and percent fetal DNA cf, log likelihood of observed data D is defined as:

$$LIK(D \mid H, i) = \log P(D \mid H, cf, i) =$$

$$\log \left( \sum_{m,f,c} P(D \mid m, f, c, H, cf, i) P(c \mid m, f, H) P(m \mid i) P(f \mid i) \right)$$

where m are possible true mother genotypes, f are possible true father genotypes, where m,f∈ {AA, AB, BB}, and c are possible child genotypes given the hypothesis H. In particular, for monosomy c∈ {A, B}, for disomy c∈ {AA, AB, BB}, for trisomy c∈ {AAA, AAB, ABB, BBB}. Genotype prior frequency: p(m|i) is the general prior probability of mother genotype m on SNP i, based on the known population frequency at SNP I, denoted $pA_i$. In particular $$p(AA \mid pA_i) = (pA_i)^2, \quad p(AB \mid pA_i) = 2(pA_i)*(1-pA_i),$$

$$p(BB \mid pA_i) = (1-pA_i)^2$$

Father genotype probability, p(f|i), may be determined in an analogous fashion.

True child probability: p(c|m, f, H) is the probability of getting true child genotype=c, given parents m, f, and assuming hypothesis H, which can be easily calculated. For example, for H11, H21 matched and H21 unmatched, p(c|m, f,H) is given below.

| | | p(c | m, f, H) | | | | | | | | | | | |
|---|---|---|---|---|---|---|---|---|---|---|---|---|---|
| | | H11 | | | H21 matched | | | | H21 unmatched | | | |
| m | f | AA | AB | BB | AAA | AAB | ABB | BBB | AAA | AAB | ABB | BBB |
| AA | AA | 1 | 0 | 0 | 1 | 0 | 0 | 0 | 1 | 0 | 0 | 0 |
| AB | AA | 0.5 | 0.5 | 0 | 0.5 | 0 | 0.5 | 0 | 0 | 1 | 0 | 0 |
| BB | AA | 0 | 1 | 0 | 0 | 0 | 1 | 0 | 0 | 0 | 1 | 0 |
| AA | AB | 0.5 | 0.5 | 0 | 0.5 | 0.5 | 0 | 0 | 0.5 | 0.5 | 0 | 0 |
| AB | AB | 0.25 | 0.5 | 0.25 | 0.25 | 0.25 | 0.25 | 0.25 | 0 | 0.5 | 0.5 | 0 |
| BB | AB | 0 | 0.5 | 0.5 | 0 | 0 | 0.5 | 0.5 | 0 | 0 | 0.5 | 0.5 |
| AA | BB | 0 | 1 | 0 | 0 | 1 | 0 | 0 | 0 | 1 | 0 | 0 |
| AB | BB | 0 | 0.5 | 0.5 | 0 | 0.5 | 0 | 0.5 | 0 | 0 | 1 | 0 |
| BB | BB | 0 | 0 | 1 | 0 | 0 | 0 | 1 | 0 | 0 | 0 | 1 |

Data likelihood: P(D|m, f, c, H, i, cf) is the probability of given data D on SNP i, given true mother genotype m, true father genotype f, true child genotype c, hypothesis H and child fraction cf. It can be broken down into the probability of mother, father and child data as follows:

$$P(D \mid m, f, c, H, cf, i) =$$

$$P(SM \mid m, i) P(M \mid m, i) P(SF \mid f, i) P(F \mid f, i) P(S \mid m, c, H, cf, i)$$

Mother SNP array data likelihood: Probability of mother SNP array genotype data $m_i$ at SNP i compared to true genotype m, assuming SNP array genotypes are correct, is simply $$P(M \mid m, i) = \begin{cases} 1 & m_i = m \\ 0 & m_i \neq m \end{cases}$$

Mother sequence data likelihood: the probability of the mother sequence data at SNP i, in the case of counts $S_i = (am_i, bm_i)$, with no extra noise or bias involved, is the binomial probability defined as $P(SM|m,i) = P_{Xlm}(am_i)$ where Xlm~Binom($p_m(A)$, $am_i + bm_i$) with $p_m(A)$ defined as

| | m | | | | | |
|---|---|---|---|---|---|---|
| | AA | AB | BB | A | B | nocall |
| p(A) | 1 | 0.5 | 0 | 1 | 0 | 0.5 |

Father data likelihood: a similar equation applies for father data likelihood. Note that it is possible to determine the child genotype without the parent data, especially father data. For example if no father genotype data F is available, one may just use P(F|f, i)=1. If no father sequence data SF is available, one may just use P(SF|f,i)=1.

In some embodiments, the method involves building a joint distribution model for the expected allele counts at a plurality of polymorphic loci on the chromosome for each ploidy hypothesis; one method to accomplish such an end is described here. Free fetal DNA data likelihood: P(S|m, c, H, cf, i) is the probability of free fetal DNA sequence data on SNP i, given true mother genotype m, true child genotype c, child copy number hypothesis H, and assuming child fraction cf. It is in fact the probability of sequence data S on SNP I, given the true probability of A content on SNP i μ(m, c, cf, H)

$$P(S \mid m, c, H, cf, i) = P(S \mid \mu(m, c, cf, H), i)$$

For counts, where $S_i = (a_i, b_i)$, with no extra noise or bias in data involved, $$P(S \mid \mu(m, c, cf, H), i) = P_X(a_i)$$

where X~Binom(p(A), $a_i$+$b_i$) with p(A)=μ(m, c, cf, H). In a more complex case where the exact alignment and (A,B) counts per SNP are not known, P(S|μ(m, c, cf, H), i) is a combination of integrated binomials.

True A content probability: μ(m, c, cf, H), the true probability of A content on SNP i in this mother/child mixture, assuming that true mother genotype=m, true child genotype=c, and overall child fraction=cf, is defined as $$\mu(m, c, cf, H) = \frac{\#A(m)*(1-cf) + \#A(c)*cf}{n_m*(1-cf) + n_c*cf}$$

where #A(g)=number of A's in genotype g, $n_m$=2 is somy of mother and $n_c$ is ploidy of the child under hypothesis H (1 for monosomy, 2 for disomy, 3 for trisomy).

Using A Joint Distribution Model: LIK(D|H) for a Composite Hypothesis

In some embodiments, the method involves building a joint distribution model for the expected allele counts at the plurality of polymorphic loci on the chromosome for each ploidy hypothesis; one method to accomplish such an end is described here. In many cases, trisomy is usually not purely matched or unmatched, due to crossovers, so in this section results for composite hypotheses H21 (maternal trisomy) and H12 (paternal trisomy) are derived, which combine matched and unmatched trisomy, accounting for possible crossovers.

In the case of trisomy, if there were no crossovers, trisomy would be simply matched or unmatched trisomy. Matched trisomy is where child inherits two copies of the identical chromosome segment from one parent. Unmatched trisomy is where child inherits one copy of each homologous chromosome segment from the parent. Due to crossovers, some segments of a chromosome may have matched trisomy, and other parts may have unmatched trisomy. Described in this section is how to build a joint distribution model for the heterozygosity rates for a set of alleles; that is, for the expected allele counts at a number of loci for one or more hypotheses.

Suppose that on SNP i, LIK(D|Hm, i) is the fit for matched hypothesis $H_m$, and LIK(D|Hu, i) is the fit for unmatched hypothesis $H_u$, and pc(i)=probability of crossover between SNPs i−1 and i. One may then calculate the full likelihood as:

$$LIK(D \mid H) = \sum_E LIK(D \mid E, 1:N)$$

where LIK(D|E, 1:N) is the likelihood of ending in hypothesis E, for SNPs 1:N. E=hypothesis of the last SNP, E∈(Hm, Hu). Recursively, one may calculate:

$$LIK(D \mid E, 1:i) = LIK(D \mid E, i) + \log$$
$$(\exp(LIK(D \mid E, 1:i-1))*(1-pc(i)) + \exp(LIK(D \mid \sim E, 1:i-1))*pc(i))$$

where ~E is the hypothesis other than E (not E), where hypotheses considered are $H_m$ and $H_u$. In particular, one may calculate the likelihood of 1: i SNPs, based on likelihood of 1 to (i−1) SNPs with either the same hypothesis and no crossover, or the opposite hypothesis and a crossover, multiplied by the likelihood of the SNP i For SNP 1, $i = 1$, $LIK(D \mid E, 1:1) = LIK(D \mid E, 1)$.

For SNP 2, $i = 2$, $LIK(D \mid E, 1:2) = LIK(D \mid E, 2) +$ $\log(\exp(LIK(D \mid E, 1))*(1-pc(2)) + \exp(LIK(D \mid \sim E, 1))*pc(2))$, and so on for i=3:N.

In some embodiments, the child fraction may be determined. The child fraction may refer to the proportion of sequences in a mixture of DNA that originate from the child. In the context of non-invasive prenatal diagnosis, the child fraction may refer to the proportion of sequences in the maternal plasma that originate from the fetus or the portion of the placenta with fetal genotype. It may refer to the child fraction in a sample of DNA that has been prepared from the maternal plasma, and may be enriched in fetal DNA. One purpose of determining the child fraction in a sample of DNA is for use in an algorithm that can make ploidy calls on the fetus, therefore, the child fraction could refer to whatever sample of DNA was analyzed by sequencing for the purpose of non-invasive prenatal diagnosis.

Some of the algorithms presented in this disclosure that are part of a method of non-invasive prenatal aneuploidy diagnosis assume a known child fraction, which may not always be the case. In an embodiment, it is possible to find the most likely child fraction by maximizing the likelihood for disomy on selected chromosomes, with or without the presence of the parental data In particular, suppose that LIK(D|H11, cf, chr)=log likelihood as described above, for the disomy hypothesis, and for child fraction cf on chromosome chr. For selected chromosomes in Cset (usually 1:16), assumed to be euploid, the full likelihood is:

$$LIK(cf) = \sum_{chr \in Cset} Lik(D \mid H11, cf, chr)$$

The most likely child fraction (cf*) is derived as $$cf^* = \underset{cf}{\mathrm{argmax}} LIK(cf).$$

It is possible to use any set of chromosomes. It is also possible to derive child fraction without assuming euploidy on the reference chromosomes. Using this method it is possible to determine the child fraction for any of the following situations: (1) one has array data on the parents and shotgun sequencing data on the maternal plasma; (2) one has array data on the parents and targeted sequencing data on the maternal plasma; (3) one has targeted sequencing data on both the parents and maternal plasma; (4) one has targeted sequencing data on both the mother and the maternal plasma fraction; (5) one has targeted sequencing data on the maternal plasma fraction; (6) other combinations of parental and child fraction measurements.

In some embodiments the informatics method may incorporate data dropouts; this may result in ploidy determinations of higher accuracy. Elsewhere in this disclosure it has been assumed that the probability of getting an A is a direct function of the true mother genotype, the true child genotype, the fraction of the child in the mixture, and the child copy number. It is also possible that mother or child alleles can drop out, for example instead of measuring true child AB in the mixture, it may be the case that only sequences mapping to allele A are measured. One may denote the parent dropout rate for genomic Illumina data $d_{pg}$, parent dropout rate for sequence data $d_{ps}$ and child dropout rate for sequence data $d_{cs}$. In some embodiments, the mother dropout rate may be assumed to be zero, and child dropout rates are relatively low; in this case, the results are not severely affected by dropouts. In some embodiments the possibility of allele dropouts may be sufficiently large that they result in a significant effect of the predicted ploidy call. For such a case, allele dropouts have been incorporated into the algorithm here:

Parent SNP array data dropouts: For mother genomic data M, suppose that the genotype after the dropout is $m_d$, then $$P(M \mid m, i) = \sum_{m_d} P(M \mid m_d, i) P(m_d \mid m)$$

$$\text{where } P(M \mid m_d, i) = \begin{cases} 1 & m_i = m_d \\ 0 & m_i \neq m_d \end{cases}$$

as before, and $P(m_d|m)$ is the likelihood of genotype ma after the possible dropout given the true genotype m, defined as below, for dropout rate d

|    |        |        | md     |        |        |        |
|----|--------|--------|--------|--------|--------|--------|
| m  | AA     | AB     | BB     | A      | B      | nocall |
| AA | (1−d)^2 | 0      | 0      | 2d(1−d) | 0      | d^2    |
| AB | 0      | (1−d)^2 | 0      | d(1−d) | d(1−d) | d^2    |
| BB | 0      | 0      | (1−d)^2 | 0      | 2d(1−d) | d^2    |

A similar equation applies for father SNP array data.

Parent sequence data dropouts: For mother sequence data SM $$P(SM \mid m, i) = \sum_{m_d} P_{X \mid m_d}(am_i) P(m_d \mid m)$$

where $P(m_d|m)$ is defined as in previous section and $P_{X|m_d}$ (am$_i$) probability from a binomial distribution is defined as before in the parent data likelihood section. A similar equation applies to the paternal sequence data.

Free floating DNA sequence data dropout:

$$P(S \mid m, c, H, cf, i) = \sum_{m_d, c_d} P(S \mid \mu(m_d, c_d, cf, H), i) P(m_d \mid m) P(c_d \mid c)$$

where $P(S|\mu(m_d, c_d, cf, H), i)$ is as defined in the section on free floating data likelihood.

In an embodiment, $p(m_d|m)$ is the probability of observed mother genotype ma, given true mother genotype m, assuming dropout rate $d_{ps}$, and $p(c_d|c)$ is the probability of observed child genotype $c_d$, given true child genotype c, assuming dropout rate $d_{cs}$. If $nA_T$=number of A alleles in true genotype c, $nA_D$=number of A alleles in observed genotype $c_d$, where $nA_T \geq nA_D$, and similarly $nB_T$=number of B alleles in true genotype c, $nB_D$=number of B alleles in observed genotype $c_d$, where $nB_T \geq nB_D$ and d=dropout rate, then $$p(c_d \mid c) = \binom{nA_T}{nA_D} * d^{nA_T - nA_D} * (1-d)^{nA_D} * \binom{nB_T}{nB_D} * d^{nB_T - nB_D} * (1-d)^{nB_D}$$

In an embodiment, the informatics method may incorporate random and consistent bias. In an ideal word there is no per SNP consistent sampling bias or random noise (in addition to the binomial distribution variation) in the number of sequence counts. In particular, on SNP i, for mother genotype m, true child genotype c and child fraction cf, and X=the number of A's in the set of (A+B) reads on SNP i, X acts like a X~Binomial(p, A+B), where p=μ(m, c, cf, H)=true probability of A content.

In an embodiment, the informatics method may incorporate random bias. As is often the case, suppose that there is a bias in the measurements, so that the probability of getting an A on this SNP is equal to q, which is a bit different than p as defined above. How much different p is from q depends on the accuracy of the measurement process and number of other factors and can be quantified by standard deviations of q away from p. In an embodiment, it is possible to model q as having a beta distribution, with parameters a, β depending on the mean of that distribution being centered at p, and some specified standard deviation s. In particular, this gives X|q~Bin(q, $D_i$), where q~Beta(α, β). If we let E(q)=p, V(q)=$s^2$, and parameters α, β can be derived as α=pN, β=(1−p)N, where $$N = \frac{p(1-p)}{s^2} - 1.$$

This is the definition of a beta-binomial distribution, where one is sampling from a binomial distribution with variable parameter q, where q follows a beta distribution with mean p. So, in a setup with no bias, on SNP i, the parent sequence data (SM) probability assuming true mother genotype (m), given mother sequence A count on SNP i (am$_i$) and mother sequence B count on SNP i (bm$_i$) may be calculated as:

$$P(SM|m,i) = P_{X|m}(ami) \text{ where } X|m \sim \text{Binom}(p_m(A), am_i + bm_i)$$

Now, including random bias with standard deviation s, this becomes:

$$X|m \sim \text{BetaBinom}(p_m(A), am_i + bm_i, s)$$

In the case with no bias, the maternal plasma DNA sequence data(S) probability assuming true mother genotype (m), true child genotype (c), child fraction (cf), assuming child hypothesis H, given free floating DNA sequence A count on SNP i (a$_i$) and free floating sequence B count on SNP i (b$_i$) may be calculated as $$P(S \mid m, c, cf, H, i) = P_X(a_i)$$

where X~Binom(p(A), a$_i$+b$_i$) with p(A)=μ(m, c, cf, H).

In an embodiment, including random bias with standard deviation s, this becomes X~BetaBinom(p(A),a$_i$+b$_i$,s), where the amount of extra variation is specified by the deviation parameter s, or equivalently N. The smaller the value of s (or the larger the value of N) the closer this distribution is to the regular binomial distribution. It is possible to estimate the amount of bias, i.e. estimate N above, from unambiguous contexts AA|AA, BB|BB, AA|BB, BB|AA and use estimated $\hat{N}$ in the above probability. Depending on the behavior of the data, N may be made to be a constant irrespective of the depth of read $a_i+b_i$, or a function of $a_i+b_i$, making bias smaller for larger depths of read.

In an embodiment, the informatics method may incorporate consistent per-SNP bias. Due to artifacts of the sequencing process, some SNPs may have consistently lower or higher counts irrespective of the true amount of A content. Suppose that SNP i consistently adds a bias of $w_i$ percent to the number of A counts. In some embodiments, this bias can be estimated from the set of training data derived under same conditions, and added back in to the parent sequence data estimate as:

$$P(SM \mid m, i) = P_{X\mid m}(am_i) \text{ where } X \mid m \sim BetaBinom(p_m(A) + w_i, am_i + bm_i, s)$$

and with the free floating DNA sequence data probability estimate as:

$$P(S \mid m, c, cf, H, i) = P_X(a_i) \text{ where } X \sim BetaBinom(p(A) + w_i, a_i + b_i, s),$$

In some embodiments, the method may be written to specifically take into account additional noise, differential sample quality, differential SNP quality, and random sampling bias. An example of this is given here. This method has been shown to be particularly useful in the context of data generated using the massively multiplexed mini-PCR protocol, and was used in Examples 7 through 13. The method involves several steps that each introduce different kind of noise and/or bias to the final model:

Suppose the first sample that comprises a mixture of maternal and fetal DNA contains an original amount of DNA of size=No molecules, usually in the range 1,000-40,000, where p=true % refs In the amplification using the universal ligation adaptors, assume that $N_1$ molecules are sampled; usually $N_1 \sim N_0/2$ molecules and random sampling bias is introduced due to sampling. The amplified sample may contain a number of molecules $N_2$ where $N_2 \gg N_1$. Let $X_1$ represent the amount of reference loci (on per SNP basis) out of $N_1$ sampled molecules, with a variation in $p_1 = X_1/N_1$ that introduces random sampling bias throughout the rest of protocol. This sampling bias is included in the model by using a Beta-Binomial (BB) distribution instead of using a simple Binomial distribution model. Parameter N of the Beta-Binomial distribution may be estimated later on per sample basis from training data after adjusting for leakage and amplification bias, on SNPs with 0<p<1. Leakage is the tendency for a SNP to be read incorrectly.

The amplification step will amplify any allelic bias, thus amplification bias introduced due to possible uneven amplification. Suppose that one allele at a locus is amplified f times another allele at that locus is amplified g times, where $f=ge^b$, where b=0 indicates no bias. The bias parameter, b, is centered at 0, and indicates how much more or less the A allele get amplified as opposed to the B allele on a particular SNP. The parameter b may differ from SNP to SNP. Bias parameter b may be estimated on per SNP basis, for example from training data.

The sequencing step involves sequencing a sample of amplified molecules. In this step there may be leakage, where leakage is the situation where a SNP is read incorrectly. Leakage may result from any number of problems, and may result in a SNP being read not as the correct allele A, but as another allele B found at that locus or as an allele C or D not typically found at that locus. Suppose the sequencing measures the sequence data of a number of DNA molecules from an amplified sample of size $N_3$, where $N_3 < N_2$. In some embodiments, $N_3$ may be in the range of 20,000 to 100,000; 100,000 to 500,000; 500,000 to 4,000,000; 4,000,000 to 20,000,000; or 20,000,000 to 100,000,000. Each molecule sampled has a probability $p_g$ of being read correctly, in which case it will show up correctly as allele A. The sample will be incorrectly read as an allele unrelated to the original molecule with probability $1-p_g$, and will look like allele A with probability $p_r$, allele B with probability $p_m$ or allele C or allele D with probability $p_o$, where $p_r+p_m+p_o=1$. Parameters $p_g$, $p_r$, $p_m$, $p_o$ are estimated on per SNP basis from the training data.

Different protocols may involve similar steps with variations in the molecular biology steps resulting in different amounts of random sampling, different levels of amplification and different leakage bias. The following model may be equally well applied to each of these cases. The model for the amount of DNA sampled, on per SNP basis, is given by:

$$X_3 \sim BetaBinomial(L(F(p, b), p_r, p_g), N * H(p, b))$$

where p=the true amount of reference DNA, b=per SNP bias, and as described above, $p_g$ is the probability of a correct read, $p_r$ is the probability of read being read incorrectly but serendipitously looking like the correct allele, in case of a bad read, as described above, and:

$$F(p, b) = pe^b / (pe^b + (1 - p)), H(p, b) = (e^b p + (1 - p))^2 / e^b,$$

$$L(p, p_r, p_g) = p * p_g + p_r * (1 - p_g).$$

In some embodiments, the method uses a Beta-Binomial distribution instead of a simple binomial distribution; this takes care of the random sampling bias. Parameter N of the Beta-Binomial distribution is estimated on per sample basis on an as needed basis. Using bias correction F(p,b), H(p,b), instead of just p, takes care of the amplification bias. Parameter b of the bias is estimated on per SNP basis from training data ahead of time.

In some embodiments the method uses leakage correction L $(p,p_r,p_g)$, instead of just p; this takes care of the leakage bias, i.e. varying SNP and sample quality. In some embodiments, parameters $p_g$, $p_r$, $p_o$ are estimated on per SNP basis from the training data ahead of time. In some embodiments, the parameters $p_g$, $p_r$, $p_o$ may be updated with the current sample on the go, to account for varying sample quality.

The model described herein is quite general and can account for both differential sample quality and differential SNP quality. Different samples and SNPs are treated differently, as exemplified by the fact that some embodiments use Beta-Binomial distributions whose mean and variance are a function of the original amount of DNA, as well as sample and SNP quality.

Platform Modeling

Consider a single SNP where the expected allele ratio present in the plasma is r (based on the maternal and fetal genotypes). The expected allele ratio is defined as the expected fraction of A alleles in the combined maternal and fetal DNA. For maternal genotype $g_m$ and child genotype $g_c$, the expected allele ratio is given by equation 1, assuming that the genotypes are represented as allele ratios as well.

$$r = fg_c + (1-f)g_m \tag{1}$$

The observation at the SNP consists of the number of mapped reads with each allele present, $n_a$ and $n_b$, which sum to the depth of read d. Assume that thresholds have already been applied to the mapping probabilities and phred scores such that the mappings and allele observations can be considered correct. A phred score is a numerical measure that relates to the probability that a particular measurement at a particular base is wrong. In an embodiment, where the base has been measured by sequencing, the phred score may be calculated from the ratio of the dye intensity corresponding to the called base to the dye intensity of the other bases. The simplest model for the observation likelihood is a binomial distribution which assumes that each of the d reads is drawn independently from a large pool that has allele ratio r. Equation 2 describes this model.

$$P(n_a, n_b \mid r) = p_{bino}(n_a; n_a + n_b, r) = \binom{n_a + n_b}{n_a} r^{n_a}(1-r)^{n_b} \tag{2}$$

The binomial model can be extended in a number of ways. When the maternal and fetal genotypes are either all A or all B, the expected allele ratio in plasma will be 0 or 1, and the binomial probability will not be well-defined. In practice, unexpected alleles are sometimes observed in practice. In an embodiment, it is possible to use a corrected allele ratio $\hat{r}=1/(n_a+n_b)$ to allow a small number of the unexpected allele. In an embodiment, it is possible to use training data to model the rate of the unexpected allele appearing on each SNP, and use this model to correct the expected allele ratio. When the expected allele ratio is not 0 or 1, the observed allele ratio may not converge with a sufficiently high depth of read to the expected allele ratio due to amplification bias or other phenomena. The allele ratio can then be modeled as a beta distribution centered at the expected allele ratio, leading to a beta-binomial distribution for $P(n_a, n_b \mid r)$ which has higher variance than the binomial.

The platform model for the response at a single SNP will be defined as F (a, b, $g_c$, $g_m$, f) (3), or the probability of observing $n_a$=a and $n_b$=b given the maternal and fetal genotypes, which also depends on the fetal fraction through equation 1. The functional form of F may be a binomial distribution, beta-binomial distribution, or similar functions as discussed above.

$$F(a, b, g_c, g_m, f) = \tag{3}$$
$$P(n_a = a, n_b = b \mid g_c, g_m, f) = P(n_a = a, n_b = b \mid r(g_c, g_m, f))$$

In an embodiment, the child fraction may be determined as follows. A maximum likelihood estimate of the fetal fraction f for a prenatal test may be derived without the use of paternal information. This may be relevant where the paternal genetic data is not available, for example where the father of record is not actually the genetic father of the fetus. The fetal fraction is estimated from the set of SNPs where the maternal genotype is 0 or 1, resulting in a set of only two possible fetal genotypes. Define $S_0$ as the set of SNPs with maternal genotype 0 and $S_1$ as the set of SNPs with maternal genotype 1. The possible fetal genotypes on $S_0$ are 0 and 0.5, resulting in a set of possible allele ratios $R_0(f)=\{0,f/2\}$. Similarly, $R_1(f)=\{1-f/2, 1\}$. This method can be trivially extended to include SNPs where maternal genotype is 0.5, but these SNPs will be less informative due to the larger set of possible allele ratios.

Define $N_{a0}$ and $N_{b0}$ as the vectors formed by $n_{as}$ and $n_{bs}$ for SNPs s in $S_0$, and $N_{a1}$ and $N_{b1}$ similarly for $S_1$. The maximum likelihood estimate $\hat{f}$ of f is defined by equation 4.

$$\hat{f} = \arg\max_f P(N_{a0}, N_{b0} \mid f) P(N_{a1}, N_{b1} \mid f) \tag{4}$$

Assuming that the allele counts at each SNP are independent conditioned on the SNP's plasma allele ratio, the probabilities can be expressed as products over the SNPs in each set (5).

$$P(N_{a0}, N_{b0} \mid f) = \prod_{s \in S_0} P(n_{as}, n_{bs} \mid f) \tag{5}$$
$$P(N_{a1}, N_{b1} \mid f) = \prod_{s \in S_1} P(n_{as}, n_{bs} \mid f)$$

The dependence on f is through the sets of possible allele ratios $R_0(f)$ and $R_1(f)$. The SNP probability $P(n_{as}, n_{bs}\mid f)$ can be approximated by assuming the maximum likelihood genotype conditioned on f. At reasonably high fetal fraction and depth of read, the selection of the maximum likelihood genotype will be high confidence. For example, at fetal fraction of 10 percent and depth of read of 1000, consider a SNP where the mother has genotype zero. The expected allele ratios are 0 and 5 percent, which will be easily distinguishable at sufficiently high depth of read. Substitution of the estimated child genotype into equation 5 results in the complete equation (6) for the fetal fraction estimate.

$$\hat{f} = \tag{6}$$
$$\arg\max_f \left[ \prod_{s \in S_0} \left( \max_{r_s \in R_0(f)} P(n_{as}, n_{bs} \mid r_s) \right) \prod_{s \in S_1} \left( \max_{r_s \in R_1(f)} P(n_{as}, n_{bs} \mid r_s) \right) \right]$$

The fetal fraction must be in the range [0, 1] and so the optimization can be easily implemented by a constrained one-dimensional search.

In the presence of low depth of read or high noise level, it may be preferable not to assume the maximum likelihood genotype, which may result in artificially high confidences. Another method would be to sum over the possible genotypes at each SNP, resulting in the following expression (7) for $P(n_a, n_b\mid f)$ for a SNP in $S_0$. The prior probability $P(r)$ could be assumed uniform over $R_0(f)$, or could be based on population frequencies. The extension to group $S_1$ is trivial.

$$P(n_a, n_b \mid f) = \sum_{r \in R_0(f)} P(n_a, n_a \mid r) P(r) \tag{7}$$

In some embodiments the probabilities may be derived as follows. A confidence can be calculated from the data likelihoods of the two hypotheses $H_t$ and $H_f$. The likelihood of each hypothesis is derived based on the response model, the estimated fetal fraction, the mother genotypes, allele population frequencies, and the plasma allele counts.

Define the following notation:

| | |
|---|---|
| $G_m$, $G_c$ | true maternal and child genotypes |
| $G_{af}$, $G_{tf}$ | true genotypes of alleged father and of true father |
| $G(g_c, g_m, g_{tf}) = P(G_c = g_c \mid G_m = g_m, G_{tf} = g_{tf})$ | inheritance probabilities |
| $P(g) = P(G_{tf} = g)$ | population frequency of genotype g at particular SNP |

Assuming that the observation at each SNP is independent conditioned on the plasma allele ratio, the likelihood of a paternity hypothesis is the product of the likelihoods on the SNPs. The following equations derive the likelihood for a single SNP. Equation 8 is a general expression for the likelihood of any hypothesis h, which will then be broken down into the specific cases of $H_t$ and $H_f$.

$$P(n_a, n_b \mid h, G_m, G_{tf}, f) = \sum_{g_c \in (0, 0.5, 1)} P(n_a, n_b \mid G_c = g_c, G_m, \quad (8)$$
$$G_{tf}, h, f) P(G_c = g_c \mid G_m, G_{tf}, h, f)$$

$$= \sum_{g_c \in (0, 0.5, 1)} P(n_a, n_b \mid G_c = g_c, G_m, f)$$
$$P(G_c = g_c \mid G_m, G_{tf}, h)$$

$$= \sum_{g_c \in (0, 0.5, 1)} F(n_a, n_b, g_c, g_m, f)$$
$$P(G_c = g_c \mid G_m, G_{tf}, h)$$

In the case of $H_t$, the alleged father is the true father and the fetal genotypes are inherited from the maternal genotypes and alleged father genotypes according to equation 9.

$$P(n_a, n_b \mid H_t, G_m, G_{tf}, f) = \sum_{g_c \in (0, 0.5, 1)} F(n_a, n_b, g_c, g_m, f) \quad (9)$$
$$P(G_c = g_c \mid G_m, G_{tf}, H_t)$$

$$= \sum_{g_c \in (0, 0.5, 1)} F(n_a, n_b, g_c, g_m, f)$$
$$G(g_c, G_m, G_{tf})$$

In the case of $H_f$, the alleged father is not the true father. The best estimate of the true father genotypes are given by the population frequencies at each SNP. Thus, the probabilities of child genotypes are determined by the known mother genotypes and the population frequencies, as in equation 10.

$$P(n_a, n_b \mid H_t, G_m, G_{tf}, f) = \sum_{g_c \in (0, 0.5, 1)} F(n_a, n_b, g_c, g_m, f)$$
$$P(G_c = g_c \mid G_m, G_{tf}, H_f)$$

$$\sum_{g_c \in (0, 0.5, 1)} F(n_a, n_b, g_c, g_m, f)$$
$$P(G_c = g_c \mid G_m)$$

$$= \sum_{g_c \in (0, 0.5, 1)} \sum_{g_{tf} \in (0, 0.5, 1)} F(n_a, n_b, g_c, g_m, f)$$
$$P(G_c = g_c \mid G_m, G_{tf} = g_{tf}) P(G_{tf} = g_{tf})$$

-continued
$$= \sum_{g_c \in (0, 0.5, 1)} \sum_{g_{tf} \in (0, 0.5, 1)}$$
$$F(n_a, n_b, g_c, g_m, f) G(g_c, G_m, g_{tf}) P(g_{tf})$$

The confidence $C_p$ on correct paternity is calculated from the product over SNPs of the two likelihoods using Bayes rule (11).

$$C_p = \frac{\prod_s P(n_{as}, n_{bs} \mid H_t, G_{ms}, G_{tf}, f)}{\prod_s P(n_{as}, n_{bs} \mid H_t, G_{ms}, G_{tf}, f) + \prod_s P(n_{as}, n_{bs} \mid H_f, G_{ms}, G_{tf}, f)} \quad (11)$$

Exemplary Methods for Identifying and Analyzing Multiple Pregnancies

In some embodiments, any of the methods of the present invention are used to detect the presence of a multiple pregnancy, such as a twin pregnancy, where at least one of the fetuses is genetically different from at least one other fetus. In some embodiments, fraternal twins are identified based on the presence of two fetus with different allele, different allele ratios, or different allele distributions at some (or all) of the tested loci. In some embodiments, fraternal twins are identified by determining the expected allele ratio at each locus (such as SNP loci) for two fetuses that may have the same or different fetal fractions in the sample (such as a plasma sample). In some embodiments, the likelihood of a particular pair of fetal fractions (where f1 is the fetal fraction for fetus 1, and f2 is the fetal fraction for fetus 2) is calculated by considering some or all of the possible genotypes of the two fetuses, conditioned on the mother's genotype and genotype population frequencies. The mixture of two fetal and one maternal genotype, combined with the fetal fractions, determine the expected allele ratio at a SNP. For example, if the mother is AA, fetus 1 is AA, and fetus 2 is AB, the overall fraction of B allele at the SNP is one-half of f2. The likelihood calculation asks how well all of the SNPs together match the expected allele ratios based on all of the possible combinations of fetal genotypes. The fetal fraction pair (f1, f2) that best matches the data is selected. It is not necessary to calculated specific genotypes of the fetuses; instead, one can, for example, considered all of the possible genotypes in a statistical combination. In some embodiments, if the method does not distinguish between singleton and identical twins, an ultrasound can be performed to determine whether there is a singleton or identical twin pregnancy. If the ultrasound detects a twin pregnancy it can be assumed that the pregnancy is an identical twin pregnancy because a fraternal twin pregnancy would have been detected based on the SNP analysis discussed above.

In some embodiments, a pregnant mother is known to have a multiple pregnancy (such as a twin pregnancy) based on prior testing, such as an ultrasound. Any of the methods of the present invention can be used to determine whether the multiple pregnancy includes identical or fraternal twins. For example, the measured allele ratios can be compared to what would be expected for identical twins (the same allele ratios as a singleton pregnancy) or for fraternal twins (such as the calculation of allele ratios as described above). Some identical twins are monochorionic twins, which have a risk of twin-to-twin transfusion syndrome. Thus, twins determined to be identical twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments, any of the methods of the present invention are used to determine whether any of the fetuses in a multiple pregnancy, such as a twin pregnancy, are aneuploid. Aneuploidy testing for twins begins with the fetal fraction estimate. In some embodiments, the fetal fraction pair (f1, f2) that best matches the data is selected as described above. In some embodiments, a maximum likelihood estimate is performed for the parameter pair (f1, f2) over the range of possible fetal fractions. In some embodiments, the range of f2 is from 0 to f1 because f2 is defined as the smaller fetal fraction. Given a pair (f1, f2), data likelihood is calculated from the allele ratios observed at a set of loci such as SNP loci. In some embodiments, the data likelihood reflects the genotypes of the mother, the father if available, population frequencies, and the resulting probabilities of fetal genotypes. In some embodiments, SNPs are assumed independent. The estimated fetal fraction pair is the one that produces the highest data likelihood. If f2 is 0 then the data is best explained by only one set of fetal genotypes, indicating identical twins, where f1 is the combined fetal fraction. Otherwise f1 and f2 are the estimates of the individual twin fetal fractions. Having established the best estimate of (f1, f2), one can predict the overall fraction of B allele in the plasma for any combination of maternal and fetal genotypes, if desired. It is not necessary to assign individual sequence reads to the individual fetuses. Ploidy testing is performed using another maximum likelihood estimate which compares the data likelihood of two hypotheses. In some embodiments for identical twins, one consider the hypotheses (i) both twins are euploid, and (ii) both twins are trisomic. In some embodiments for fraternal twins, one considers the hypotheses (i) both twins are euploid and (ii) at least one twin is trisomic. The trisomy hypotheses for fraternal twins are based on the lower fetal fraction, since a trisomy in the twin with a higher fetal fraction would also be detected. Ploidy likelihoods are calculated using a method which predicts the expected number of reads at each targeted genome locus conditioned on either the disomy or trisomy hypothesis. There is no requirement for a disomy reference chromosome. The variance model for the expected number of reads takes into account the performance of individual target loci as well as the correlation between loci (see, for example, U.S. Ser. No. 62/008,235, filed Jun. 5, 2014, and U.S. Ser. No. 62/032,785, filed Aug. 4, 2014, which are each hereby incorporated by reference in its entirety). If the smaller twin has fetal fraction f1, our ability to detect a trisomy in that twin is equivalent to our ability to detect a trisomy in a singleton pregnancy at the same fetal fraction. This is because the part of the method that detects the trisomy in some embodiments does not depend on genotypes and does not distinguish between multiple or singleton pregnancy. It simply looks for an increased number of reads in accordance with the determined fetal fraction.

In some embodiments, the method includes detecting the presence of twins based on SNP loci (such as described above). If twins are detected, SPNs are used to determine the fetal fraction of each fetus (f1, f2) such as described above. In some embodiments, samples that have high confidence disomy calls are used to determine the amplification bias on a per-SNP basis. In some embodiments, these samples with high confidence disomy calls are analyzed in the same run as one or more samples of interest. In some embodiments, the amplification bias on a per-SNP basis is used to model the distribution of reads for one or more chromosomes or chromosome segments of interest such as chromosome 21 that are expected or the disomy hypothesis and the trisomy hypothesis given the lower of the two twin fetal fraction. The likelihood or probability of disomy or trisomy is calculated given the two models and the measured quantity of the chromosome or chromosome segment of interest.

In some embodiments, the threshold for a positive aneuploidy call (such as a trisomy call) is set based on the twin with the lower fetal fraction. This way, if the other twin is positive, or if both are positive, the total chromosome representation is definitely above the threshold.

Maximum Likelihood Model Using Percent Fetal Fraction

Determining the ploidy status of a fetus by measuring the free floating DNA contained in maternal serum, or by measuring the genotypic material in any mixed sample, is a non-trivial exercise. There are a number of methods, for example, performing a read count analysis where the presumption is that if the fetus is trisomic at a particular chromosome, then the overall amount of DNA from that chromosome found in the maternal blood will be elevated with respect to a reference chromosome. One way to detect trisomy in such fetuses is to normalize the amount of DNA expected for each chromosome, for example, according to the number of SNPs in the analysis set that correspond to a given chromosome, or according to the number of uniquely mappable portions of the chromosome. Once the measurements have been normalized, any chromosomes for which the amount of DNA measured exceeds a certain threshold are determined to be trisomic. This approach is described in Fan, et al. PNAS, 2008; 105 (42); pp. 16266-16271, and also in Chiu et al. BMJ 2011; 342: c7401. In the Chiu et al. paper, the normalization was accomplished by calculating a Z score as follows:

$$Z \text{ score for percentage chromosome 21 in test case} = \\ ((\text{percentage chromosome 21 in test case}) - \\ (\text{mean percentage chromosome 21 in reference controls}))/ \\ (\text{standard deviation of percentage chromosome 21 in reference controls}).$$

These methods determine the ploidy status of the fetus using a single hypothesis rejection method. However, they suffer from some significant shortcomings. Since these methods for determining ploidy in the fetus are invariant according to the percentage of fetal DNA in the sample, they use one cut off value; the result of this is that the accuracies of the determinations are not optimal, and those cases where the percentage of fetal DNA in the mixture are relatively low will suffer the worst accuracies.

In an embodiment, a method of the present disclosure is used to determine the ploidy state of the fetus involves taking into account the fraction of fetal DNA in the sample. In another embodiment of the present disclosure, the method involves the use of maximum likelihood estimations. In an embodiment, a method of the present disclosure involves calculating the percent of DNA in a sample that is fetal or placental in origin. In an embodiment, the threshold for calling aneuploidy is adaptively adjusted based on the calculated percent fetal DNA. In some embodiments, the method for estimating the percentage of DNA that is of fetal origin in a mixture of DNA, comprises obtaining a mixed sample that comprises genetic material from the mother, and genetic material from the fetus, obtaining a genetic sample from the father of the fetus, measuring the DNA in the mixed sample, measuring the DNA in the father sample, and calculating the percentage of DNA that is of fetal origin in the mixed sample using the DNA measurements of the mixed sample, and of the father sample.

In an embodiment of the present disclosure, the fraction of fetal DNA, or the percentage of fetal DNA in the mixture can be measured. In some embodiments the fraction can be calculated using only the genotyping measurements made on the maternal plasma sample itself, which is a mixture of fetal and maternal DNA. In some embodiments the fraction may be calculated also using the measured or otherwise known genotype of the mother and/or the measured or otherwise known genotype of the father. In some embodiments the percent fetal DNA may be calculated using the measurements made on the mixture of maternal and fetal DNA along with the knowledge of the parental contexts. In an embodiment, the fraction of fetal DNA may be calculated using population frequencies to adjust the model on the probability on particular allele measurements.

In an embodiment of the present disclosure, a confidence may be calculated on the accuracy of the determination of the ploidy state of the fetus. In an embodiment, the confidence of the hypothesis of greatest likelihood ($H_{major}$) may be calculated as $(1-H_{major})/\Sigma(\text{all } H)$. It is possible to determine the confidence of a hypothesis if the distributions of all of the hypotheses are known. It is possible to determine the distribution of all of the hypotheses if the parental genotype information is known. It is possible to calculate a confidence of the ploidy determination if the knowledge of the expected distribution of data for the euploid fetus and the expected distribution of data for the aneuploid fetus are known. It is possible to calculate these expected distributions if the parental genotype data are known. In an embodiment one may use the knowledge of the distribution of a test statistic around a normal hypothesis and around an abnormal hypothesis to determine both the reliability of the call as well as refine the threshold to make a more reliable call. This is particularly useful when the amount and/or percent of fetal DNA in the mixture is low. It will help to avoid the situation where a fetus that is actually aneuploid is found to be euploid because a test statistic, such as the Z statistic does not exceed a threshold that is made based on a threshold that is optimized for the case where there is a higher percent fetal DNA.

In an embodiment, a method disclosed herein can be used to determine a fetal aneuploidy by determining the number of copies of maternal and fetal target chromosomes in a mixture of maternal and fetal genetic material. This method may entail obtaining maternal tissue comprising both maternal and fetal genetic material; in some embodiments this maternal tissue may be maternal plasma or a tissue isolated from maternal blood. This method may also entail obtaining a mixture of maternal and fetal genetic material from said maternal tissue by processing the aforementioned maternal tissue. This method may entail distributing the genetic material obtained into a plurality of reaction samples, to randomly provide individual reaction samples that comprise a target sequence from a target chromosome and individual reaction samples that do not comprise a target sequence from a target chromosome, for example, performing high throughput sequencing on the sample. This method may entail analyzing the target sequences of genetic material present or absent in said individual reaction samples to provide a first number of binary results representing presence or absence of a presumably euploid fetal chromosome in the reaction samples and a second number of binary results representing presence or absence of a possibly aneuploid fetal chromosome in the reaction samples. Either of the number of binary results may be calculated, for example, by way of an informatics technique that counts sequence reads that map to a particular chromosome, to a particular region of a chromosome, to a particular locus or set of loci. This method may involve normalizing the number of binary events based on the chromosome length, the length of the region of the chromosome, or the number of loci in the set. This method may entail calculating an expected distribution of the number of binary results for a presumably euploid fetal chromosome in the reaction samples using the first number. This method may entail calculating an expected distribution of the number of binary results for a presumably aneuploid fetal chromosome in the reaction samples using the first number and an estimated fraction of fetal DNA found in the mixture, for example, by multiplying the expected read count distribution of the number of binary results for a presumably euploid fetal chromosome by $(1+n/2)$ where n is the estimated fetal fraction. In some embodiments, the sequence reads may be treated at probabilistic mappings rather than binary results; this method would yield higher accuracies, but require more computing power. The fetal fraction may be estimated by a plurality of methods, some of which are described elsewhere in this disclosure. This method may involve using a maximum likelihood approach to determine whether the second number corresponds to the possibly aneuploid fetal chromosome being euploid or being aneuploid. This method may involve calling the ploidy status of the fetus to be the ploidy state that corresponds to the hypothesis with the maximum likelihood of being correct given the measured data.

Note that the use of a maximum likelihood model may be used to increase the accuracy of any method that determines the ploidy state of a fetus. Similarly, a confidence maybe calculated for any method that determines the ploidy state of the fetus. The use of a maximum likelihood model would result in an improvement of the accuracy of any method where the ploidy determination is made using a single hypothesis rejection technique. A maximum likelihood model may be used for any method where a likelihood distribution can be calculated for both the normal and abnormal cases. The use of a maximum likelihood model implies the ability to calculate a confidence for a ploidy call.

Further Discussion of the Method

In an embodiment, a method disclosed herein utilizes a quantitative measure of the number of independent observations of each allele at a polymorphic locus, where this does not involve calculating the ratio of the alleles. This is different from methods, such as some microarray based methods, which provide information about the ratio of two alleles at a locus but do not quantify the number of independent observations of either allele. Some methods known in the art can provide quantitative information regarding the number of independent observations, but the calculations leading to the ploidy determination utilize only the allele ratios, and do not utilize the quantitative information. To illustrate the importance of retaining information about the number of independent observations consider the sample locus with two alleles, A and B. In a first experiment twenty A alleles and twenty B alleles are observed, in a second experiment 200 A alleles and 200 B alleles are observed. In both experiments the ratio $(A/(A+B))$ is equal to 0.5, however the second experiment conveys more information than the first about the certainty of the frequency of the A or B allele. The instant method, rather than utilizing the allele ratios, uses the quantitative data to more accurately model the most likely allele frequencies at each polymorphic locus.

In an embodiment, the instant methods build a genetic model for aggregating the measurements from multiple polymorphic loci to better distinguish trisomy from disomy and also to determine the type of trisomy. Additionally, the instant method incorporates genetic linkage information to enhance the accuracy of the method. This is in contrast to some methods known in the art where allele ratios are averaged across all polymorphic loci on a chromosome. The method disclosed herein explicitly models the allele frequency distributions expected in disomy as well as and trisomy resulting from nondisjunction during meiosis I, nondisjunction during meiosis II, and nondisjunction during mitosis early in fetal development. To illustrate why this is important, if there were no crossovers nondisjunction during meiosis I would result a trisomy in which two different homologs were inherited from one parent; nondisjunction during meiosis II or during mitosis early in fetal development would result in two copies of the same homolog from one parent. Each scenario results in different expected allele frequencies at each polymorphic locus and also at all physically linked loci (i.e. loci on the same chromosome) considered jointly. Crossovers, which result in the exchange of genetic material between homologs, make the inheritance pattern more complex, but the instant method accommodates for this by using genetic linkage information, i.e. recombination rate information and the physical distance between loci. To better distinguish between meiosis I nondisjunction and meiosis II or mitotic nondisjunction the instant method incorporates into the model an increasing probability of crossover as the distance from the centromere increases. Meiosis II and mitotic nondisjunction can distinguished by the fact that mitotic nondisjunction typically results in identical or nearly identical copies of one homolog while the two homologs present following a meiosis II nondisjunction event often differ due to one or more crossovers during gametogenesis.

In an embodiment, a method of the present disclosure may not determine the haplotypes of the parents if disomy is assumed. In an embodiment, in case of trisomy, the instant method can make a determination about the haplotypes of one or both parents by using the fact that plasma takes two copies from one parent, and parent phase information can be determined by noting which two copies have been inherited from the parent in question. In particular, a child can inherit either two of the same copies of the parent (matched trisomy) or both copies of the parent (unmatched trisomy). At each SNP one can calculate the likelihood of the matched trisomy and of the unmatched trisomy. A ploidy calling method that does not use the linkage model accounting for crossovers would calculate the overall likelihood of the trisomy as a simple weighted average of the matched and unmatched trisomies over all chromosomes. However, due to the biological mechanisms that result in disjunction error and crossing over, trisomy can change from matched to unmatched (and vice versa) on a chromosome only if a crossover occurs. The instant method probabilistically takes into account the likelihood of crossover, resulting in ploidy calls that are of greater accuracy than those methods that do not.

In an embodiment, a reference chromosome is used to determine the child fraction and noise level amount or probability distribution. In an embodiment, the child fraction, noise level, and/or probability distribution is determined using only the genetic information available from the chromosome whose ploidy state is being determined. The instant method works without the reference chromosome, as well as without fixing the particular child fraction or noise level. This is a significant improvement and point of differentiation from methods known in the art where genetic data from a reference chromosome is necessary to calibrate the child fraction and chromosome behavior.

In an embodiment where a reference chromosome is not needed to determine the fetal fraction, determining the hypothesis is done as follows:

$$H^* = \underset{H}{\operatorname{argmax}}\ LIK(D \mid H) * priorprob(H)$$

With the algorithm with reference chromosome, one typically assumes that the reference chromosome is a disomy, and then one may either (a) fix the most likely child fraction and random noise level N based on this assumption and reference chromosome data:

$$[cfr^*, N^*] = \underset{cfr,N}{\operatorname{argmax}}\ LIK(D(ref.chrom) \mid H11, cfr, N)$$

And then reduce $$LIK(D \mid H) = LIK(D \mid H, cfr^*, N^*)$$

or (b) estimate the child fraction and noise level distribution based on this assumption and reference chromosome data. In particular, one would not fix just one value for cfr and N, but assign probability p(cfr, N) for the wider range of possible cfr, N values:

$$p(cfr, N) \sim LIK(D(ref.chrom) \mid H11, cfr, N) * priorprob(cfr, N)$$

where priorprob(cfr, N) is the prior probability of particular child fraction and noise level, determined by prior knowledge and experiments. If desired, just uniform over the range of cfr, N. One may then write:

$$LIK(D \mid H) = \sum_{cfr,N} LIK(D \mid H, cfr, N) * p(cfr, N)$$

Both methods above give good results.

Note that in some instances using a reference chromosome is not desirable, possible or feasible. In such a case, it is possible to derive the best ploidy call for each chromosome separately. In particular:

$$LIK(D \mid H) = \sum_{cfr,N} LIK(D \mid H, cfr, N) * p(cfr, N \mid H)$$

p(cfr, N|H) may be determined as above, for each chromosome separately, assuming hypothesis H, not just for the reference chromosome assuming disomy. It is possible, using this method, to keep both noise and child fraction parameters fixed, fix either of the parameters, or keep both parameters in probabilistic form for each chromosome and each hypothesis.

Measurements of DNA are noisy and/or error prone, especially measurements where the amount of DNA is small, or where the DNA is mixed with contaminating DNA. This noise results in less accurate genotypic data, and less accurate ploidy calls. In some embodiments, platform modeling or some other method of noise modeling may be used to counter the deleterious effects of noise on the ploidy determination. The instant method uses a joint model of both channels, which accounts for the random noise due to the amount of input DNA, DNA quality, and/or protocol quality.

This is in contrast to some methods known in the art where the ploidy determinations are made using the ratio of allele intensities at a locus. This method precludes accurate SNP noise modeling. In particular, errors in the measurements typically do not specifically depend on the measured channel intensity ratio, which reduces the model to using one-dimensional information. Accurate modeling of noise, channel quality and channel interaction requires a two-dimensional joint model, which can not be modeled using allele ratios.

In particular, projecting two channel information to the ratio r where f(x,y) is r=x/y, does not lend itself to accurate channel noise and bias modeling. Noise on a particular SNP is not a function of the ratio, i.e. noise $(x,y) \neq f(x,y)$ but is in fact a joint function of both channels. For example, in the binomial model, noise of the measured ratio has a variance of $r(1-r)/(x+y)$ which is not a function purely of r. In such a model, where any channel bias or noise is included, suppose that on SNP i, the observed channel X value is $x=a_i X+b_i$, where X is the true channel value, $b_i$ is the extra channel bias and random noise. Similarly, suppose that $y=c_i Y+d_i$. The observed ratio $r=x/y$ can not accurately predict the true ratio X/Y or model the leftover noise, since (aiX+bi)/(ciY+di) is not a function of X/Y.

The method disclosed herein describes an effective way to model noise and bias using joint binomial distributions of all of the measurement channels individually. Relevant equations may be found elsewhere in the document in sections which speaks of per SNP consistent bias, P(good) and P(ref|bad), P(mut|bad) which effectively adjust SNP behavior. In an embodiment, a method of the present disclosure uses a BetaBinomial distribution, which avoids the limiting practice of relying on the allele ratios only, but instead models the behavior based on both channel counts.

In an embodiment, a method disclosed herein can call the ploidy of a gestating fetus from genetic data found in maternal plasma by using all available measurements. In an embodiment, a method disclosed herein can call the ploidy of a gestating fetus from genetic data found in maternal plasma by using the measurements from only a subset of parental contexts. Some methods known in the art only use measured genetic data where the parental context is from the AA|BB context, that is, where the parents are both homozygous at a given locus, but for a different allele. One problem with this method is that a small proportion of polymorphic loci are from the AA|BB context, typically less than 10%. In an embodiment of a method disclosed herein, the method does not use genetic measurements of the maternal plasma made at loci where the parental context is AA|BB. In an embodiment, the instant method uses plasma measurements for only those polymorphic loci with the AA|AB, AB|AA, and AB|AB parental context.

Some methods known in the art involve averaging allele ratios from SNPs in the AA|BB context, where both parent genotypes are present, and claim to determine the ploidy calls from the average allele ratio on these SNPs. This method suffers from significant inaccuracy due differential SNP behavior. Note that this method assumes that have both parent genotypes are known. In contrast, in some embodiments, the instant method uses a joint channel distribution model that does not assume the presence of either of the parents, and does not assume the uniform SNP behavior. In some embodiments, the instant method accounts for the different SNP behavior/weighing. In some embodiments, the instant method does not require the knowledge of one or both parental genotypes. An example of how the instant method may accomplish this follows:

In some embodiments, the log likelihood of a hypothesis may be determined on a per SNP basis. On a particular SNP i, assuming fetal ploidy hypothesis H and percent fetal DNA cf, the log likelihood of observed data D is defined as:

$$LIK(D|H, i) = \log P(D|H, cf, i) = \log\left(\sum_{m,f,c} P(D|m, f, c, H, cf, i) P(c|m, f, H) P(m|i) P(f|i)\right)$$

where m are possible true mother genotypes, f are possible true father genotypes, where $m,f \in \{AA,AB,BB\}$, and where c are possible child genotypes given the hypothesis H. In particular, for monosomy c $\{A, B\}$, for disomy $c \in \{AA, AB, BB\}$, for trisomy $c \in \{AAA, AAB, ABB, BBB\}$. Note that including parental genotypic data typically results in more accurate ploidy determinations, however, parental genotypic data is not necessary for the instant method to work well.

Some methods known in the art involve averaging allele ratios from SNPs where the mother is homozygous but a different allele is measured in the plasma (either AA|AB or AA|BB contexts), and claim to determine the ploidy calls from the average allele ratio on these SNPs. This method is intended for cases where the paternal genotype is not available. Note that it is questionable how accurately one can claim that plasma is heterozygous on a particular SNP without the presence of homozygous and opposite father BB: for cases with low child fraction, what looks like presence of B allele could be just presence of noise; additionally, what looks like no B present could be simple allele drop out of the fetal measurements. Even in a case where one can actually determine heterozygosity of the plasma, this method will not be able to distinguish paternal trisomies. In particular, for SNPs where mother is AA, and where some B is measured in the plasma, if the father is GG, the resulting child genotype is AGG, resulting in an average ratio of 33% A (for child fraction=100%). But in the case where the father is AG, the resulting child genotype could be AGG for matched trisomy, contributing to the 33% A ratio, or AAG for unmatched trisomy, drawing the average ratio more toward 66% A. Given that many trisomies are on chromosomes with crossovers, the overall chromosome can have anywhere between no unmatched trisomy and all unmatched trisomy, this ratio can vary anywhere between 33-66%. For a plain disomy, the ratio should be around 50%. Without the use of a linkage model or an accurate error model of the average, this method would miss many cases of paternal trisomy. In contrast, the method disclosed herein assigns parental genotype probabilities for each parental genotypic candidate, based on available genotypic information and population frequency, and does not explicitly require parental genotypes. Additionally, the method disclosed herein is able to detect trisomy even in the absence or presence of parent genotypic data, and can compensate by identifying the points of possible crossovers from matched to unmatched trisomy using a linkage model.

Some methods known in the art claim a method for averaging allele ratios from SNPs where neither the maternal or paternal genotype is known, and for determining the ploidy calls from average ratio on these SNPs. However, a method to accomplish these ends is not disclosed. The method disclosed herein is able to make accurate ploidy calls in such a situation, and the reduction to practice is disclosed elsewhere in this document, using a joint probability maximum likelihood method and optionally utilizes SNP noise and bias models, as well as a linkage model.

Some methods known in the art involve averaging allele ratios and claim to determine the ploidy calls from the average allele ratio at one or a few SNPs. However, such methods do not utilize the concept of linkage. The methods disclosed herein do not suffer from these drawbacks.

Using Sequence Length as a Prior to Determine the Origin of DNA

It has been reported that the distribution of length of sequences differ for maternal and fetal DNA, with fetal generally being shorter. In an embodiment of the present disclosure, it is possible to use previous knowledge in the form of empirical data, and construct prior distribution for expected length of both mother ($P(X| \text{maternal})$) and fetal DNA ($P(X| \text{fetal})$). Given new unidentified DNA sequence of length x, it is possible to assign a probability that a given sequence of DNA is either maternal or fetal DNA, based on prior likelihood of x given either maternal or fetal. In particular if $P(x|\text{maternal}) > P(x|\text{fetal})$, then the DNA sequence can be classified as maternal, with $P(x|\text{maternal}) = P(x|\text{maternal})/[(P(x|\text{maternal}) + P(x|\text{fetal})]$, and if $p(x|\text{maternal}) < p(x|\text{fetal})$, then the DNA sequence can be classified as fetal, $P(x|\text{fetal}) = P(x|\text{fetal})/[(P(x|\text{maternal}) + P(x|\text{fetal})]$. In an embodiment of the present disclosure, a distributions of maternal and fetal sequence lengths can be determined that is specific for that sample by considering the sequences that can be assigned as maternal or fetal with high probability, and then that sample specific distribution can be used as the expected size distribution for that sample.

Variable Read Depth to Minimize Sequencing Cost

In many clinical trials concerning a diagnostic, for example, in Chiu et al. BMJ 2011; 342: c7401, a protocol with a number of parameters is set, and then the same protocol is executed with the same parameters for each of the patients in the trial. In the case of determining the ploidy status of a fetus gestating in a mother using sequencing as a method to measure genetic material one pertinent parameter is the number of reads. The number of reads may refer to the number of actual reads, the number of intended reads, fractional lanes, full lanes, or full flow cells on a sequencer. In these studies, the number of reads is typically set at a level that will ensure that all or nearly all of the samples achieve the desired level of accuracy. Sequencing is currently an expensive technology, a cost of roughly $200 per 5 mappable million reads, and while the price is dropping, any method which allows a sequencing based diagnostic to operate at a similar level of accuracy but with fewer reads will necessarily save a considerable amount of money.

The accuracy of a ploidy determination is typically dependent on a number of factors, including the number of reads and the fraction of fetal DNA in the mixture. The accuracy is typically higher when the fraction of fetal DNA in the mixture is higher. At the same time, the accuracy is typically higher if the number of reads is greater. It is possible to have a situation with two cases where the ploidy state is determined with comparable accuracies wherein the first case has a lower fraction of fetal DNA in the mixture than the second, and more reads were sequenced in the first case than the second. It is possible to use the estimated fraction of fetal DNA in the mixture as a guide in determining the number of reads necessary to achieve a given level of accuracy.

In an embodiment of the present disclosure, a set of samples can be run where different samples in the set are sequenced to different reads depths, wherein the number of reads run on each of the samples is chosen to achieve a given level of accuracy given the calculated fraction of fetal DNA in each mixture. In an embodiment of the present disclosure, this may entail making a measurement of the mixed sample to determine the fraction of fetal DNA in the mixture; this estimation of the fetal fraction may be done with sequencing, it may be done with TAQMAN, it may be done with qPCR, it may be done with SNP arrays, it may be done with any method that can distinguish different alleles at a given loci. The need for a fetal fraction estimate may be eliminated by including hypotheses that cover all or a selected set of fetal fractions in the set of hypotheses that are considered when comparing to the actual measured data. After the fraction fetal DNA in the mixture has been determined, the number of sequences to be read for each sample may be determined.

In an embodiment of the present disclosure, 100 pregnant women visit their respective OB's, and their blood is drawn into blood tubes with an anti-lysant and/or something to inactivate DNAase. They each take home a kit for the father of their gestating fetus who gives a saliva sample. Both sets of genetic materials for all 100 couples are sent back to the laboratory, where the mother blood is spun down and the buffy coat is isolated, as well as the plasma. The plasma comprises a mixture of maternal DNA as well as placentally derived DNA. The maternal buffy coat and the paternal blood is genotyped using a SNP array, and the DNA in the maternal plasma samples are targeted with SURESELECT hybridization probes. The DNA that was pulled down with the probes is used to generate 100 tagged libraries, one for each of the maternal samples, where each sample is tagged with a different tag. A fraction from each library is withdrawn, each of those fractions are mixed together and added to two lanes of a ILLUMINA HISEQ DNA sequencer in a multiplexed fashion, wherein each lane resulted in approximately 50 million mappable reads, resulting in approximately 100 million mappable reads on the 100 multiplexed mixtures, or approximately 1 million reads per sample. The sequence reads were used to determine the fraction of fetal DNA in each mixture. 50 of the samples had more than 15% fetal DNA in the mixture, and the 1 million reads were sufficient to determine the ploidy status of the fetuses with a 99.9% confidence.

Of the remaining mixtures, 25 had between 10 and 15% fetal DNA; a fraction of each of the relevant libraries prepped from these mixtures were multiplexed and run down one lane of the HISEQ generating an additional 2 million reads for each sample. The two sets of sequence data for each of the mixture with between 10 and 15% fetal DNA were added together, and the resulting 3 million reads per sample which were sufficient to determine the ploidy state of those fetuses with 99.9% confidence.

Of the remaining mixtures, 13 had between 6 and 10% fetal DNA; a fraction of each of the relevant libraries prepped from these mixtures were multiplexed and run down one lane of the HISEQ generating an additional 4 million reads for each sample. The two sets of sequence data for each of the mixture with between 6 and 10% fetal DNA were added together, and the resulting 5 million total reads per mixture which were sufficient to determine the ploidy state of those fetuses with 99.9% confidence.

Of the remaining mixtures, 8 had between 4 and 6% fetal DNA; a fraction of each of the relevant libraries prepped from these mixtures were multiplexed and run down one lane of the HISEQ generating an additional 6 million reads for each sample. The two sets of sequence data for each of the mixture with between 4 and 6% fetal DNA were added together, and the resulting 7 million total reads per mixture which were sufficient to determine the ploidy state of those fetuses with 99.9% confidence.

Of the remaining four mixtures, all of them had between 2 and 4% fetal DNA; a fraction of each of the relevant libraries prepped from these mixtures were multiplexed and run down one lane of the HISEQ generating an additional 12 million reads for each sample. The two sets of sequence data for each of the mixture with between 2 and 4% fetal DNA were added together, and the resulting 13 million total reads per mixture which were sufficient to determine the ploidy state of those fetuses with 99.9% confidence.

This method required six lanes of sequencing on a HISEQ machine to achieve 99.9% accuracy over 100 samples. If the same number of runs had been required for every sample, to ensure that every ploidy determination was made with a 99.9% accuracy, it would have taken 25 lanes of sequencing, and if a no-call rate or error rate of 4% was tolerated, it could have been achieved with 14 lanes of sequencing.

Using Raw Genotyping Data

There are a number of methods that can accomplish NPD using fetal genetic information measured on fetal DNA found in maternal blood. Some of these methods involve making measurements of the fetal DNA using SNP arrays, some methods involve untargeted sequencing, and some methods involve targeted sequencing. The targeted sequencing may target SNPs, it may target STRs, it may target other polymorphic loci, it may target non-polymorphic loci, or some combination thereof. Some of these methods may involve using a commercial or proprietary allele caller that calls the identity of the alleles from the intensity data that comes from the sensors in the machine doing the measuring. For example, the ILLUMINA INFINIUM system or the AFFYMETRIX GENECHIP microarray system involves beads or microchips with attached DNA sequences that can hybridize to complementary segments of DNA; upon hybridization, there is a change in the fluorescent properties of the sensor molecule that can be detected. There are also sequencing methods, for example the ILLUMINA SOLEXA GENOME SEQUENCER or the ABI SOLID GENOME SEQUENCER, wherein the genetic sequence of fragments of DNA are sequenced; upon extension of the strand of DNA complementary to the strand being sequenced, the identity of the extended nucleotide is typically detected via a fluorescent or radio tag appended to the complementary nucleotide. In all of these methods the genotypic or sequencing data is typically determined on the basis of fluorescent or other signals, or the lack thereof. These systems are typically combined with low level software packages that make specific allele calls (secondary genetic data) from the analog output of the fluorescent or other detection device (primary genetic data). For example, in the case of a given allele on a SNP array, the software will make a call, for example, that a certain SNP is present or not present if the fluorescent intensity is measure above or below a certain threshold. Similarly, the output of a sequencer is a chromatogram that indicates the level of fluorescence detected for each of the dyes, and the software will make a call that a certain base pair is A or T or C or G. High throughput sequencers typically make a series of such measurements, called a read, that represents the most likely structure of the DNA sequence that was sequenced. The direct analog output of the chromatogram is defined here to be the primary genetic data, and the base pair/SNP calls made by the software are considered here to be the secondary genetic data. In an embodiment, primary data refers to the raw intensity data that is the unprocessed output of a genotyping platform, where the genotyping platform may refer to a SNP array, or to a sequencing platform. The secondary genetic data refers to the processed genetic data, where an allele call has been made, or the sequence data has been assigned base pairs, and/or the sequence reads have been mapped to the genome.

Many higher level applications take advantage of these allele calls, SNP calls and sequence reads, that is, the secondary genetic data, that the genotyping software produces. For example, DNA NEXUS, ELAND or MAQ will take the sequencing reads and map them to the genome. For example, in the context of non-invasive prenatal diagnosis, complex informatics, such as PARENTAL SUPPORT™, may leverage a large number of SNP calls to determine the genotype of an individual. Also, in the context of preimplantation genetic diagnosis, it is possible to take a set of sequence reads that are mapped to the genome, and by taking a normalized count of the reads that are mapped to each chromosome, or section of a chromosome, it may be possible to determine the ploidy state of an individual. In the context of non-invasive prenatal diagnosis it may be possible to take a set of sequence reads that have been measured on DNA present in maternal plasma, and map them to the genome. One may then take a normalized count of the reads that are mapped to each chromosome, or section of a chromosome, and use that data to determine the ploidy state of an individual. For example, it may be possible to conclude that those chromosomes that have a disproportionately large number of reads are trisomic in the fetus that is gestating in the mother from which the blood was drawn.

However, in reality, the initial output of the measuring instruments is an analog signal. When a certain base pair is called by the software that is associated with the sequencing software, for example the software may call the base pair a T, in reality the call is the call that the software believes to be most likely. In some cases, however, the call may be of low confidence, for example, the analog signal may indicate that the particular base pair is only 90% likely to be a T, and 10% likely to be an A. In another example, the genotype calling software that is associated with a SNP array reader may call a certain allele to be G. However, in reality, the underlying analog signal may indicate that it is only 70% likely that the allele is G, and 30% likely that the allele is T. In these cases, when the higher level applications use the genotype calls and sequence calls made by the lower level software, they are losing some information. That is, the primary genetic data, as measured directly by the genotyping platform, may be messier than the secondary genetic data that is determined by the attached software packages, but it contains more information. In mapping the secondary genetic data sequences to the genome, many reads are thrown out because some bases are not read with enough clarity and or mapping is not clear. When the primary genetic data sequence reads are used, all or many of those reads that may have been thrown out when first converted to secondary genetic data sequence read can be used by treating the reads in a probabilistic manner.

In an embodiment of the present disclosure, the higher level software does not rely on the allele calls, SNP calls, or sequence reads that are determined by the lower level software. Instead, the higher level software bases its calculations on the analog signals directly measured from the genotyping platform. In an embodiment of the present disclosure, an informatics based method such as PARENTAL SUPPORT™ is modified so that its ability to reconstruct the genetic data of the embryo/fetus/child is engineered to directly use the primary genetic data as measured by the genotyping platform. In an embodiment of the present disclosure, an informatics based method such as PARENTAL SUPPORT™ is able to make allele calls, and/or chromosome copy number calls using primary genetic data, and not using the secondary genetic data. In an embodiment of the present disclosure, all genetic calls, SNPs calls, sequence reads, sequence mapping is treated in a probabilistic manner by using the raw intensity data as measured directly by the genotyping platform, rather than converting the primary genetic data to secondary genetic calls. In an embodiment, the DNA measurements from the prepared sample used in calculating allele count probabilities and determining the relative probability of each hypothesis comprise primary genetic data.

In some embodiments, the method can increase the accuracy of genetic data of a target individual which incorporates genetic data of at least one related individual, the method comprising obtaining primary genetic data specific to a target individual's genome and genetic data specific to the genome(s) of the related individual(s), creating a set of one or more hypotheses concerning possibly which segments of which chromosomes from the related individual(s) correspond to those segments in the target individual's genome, determining the probability of each of the hypotheses given the target individual's primary genetic data and the related individual(s)'s genetic data, and using the probabilities associated with each hypothesis to determine the most likely state of the actual genetic material of the target individual. In some embodiments, the method can determining the number of copies of a segment of a chromosome in the genome of a target individual, the method comprising creating a set of copy number hypotheses about how many copies of the chromosome segment are present in the genome of a target individual, incorporating primary genetic data from the target individual and genetic information from one or more related individuals into a data set, estimating the characteristics of the platform response associated with the data set, where the platform response may vary from one experiment to another, computing the conditional probabilities of each copy number hypothesis, given the data set and the platform response characteristics, and determining the copy number of the chromosome segment based on the most probable copy number hypothesis. In an embodiment, a method of the present disclosure can determine a ploidy state of at least one chromosome in a target individual, the method comprising obtaining primary genetic data from the target individual and from one or more related individuals, creating a set of at least one ploidy state hypothesis for each of the chromosomes of the target individual, using one or more expert techniques to determine a statistical probability for each ploidy state hypothesis in the set, for each expert technique used, given the obtained genetic data, combining, for each ploidy state hypothesis, the statistical probabilities as determined by the one or more expert techniques, and determining the ploidy state for each of the chromosomes in the target individual based on the combined statistical probabilities of each of the ploidy state hypotheses. In an embodiment, a method of the present disclosure can determine an allelic state in a set of alleles, in a target individual, and from one or both parents of the target individual, and optionally from one or more related individuals, the method comprising obtaining primary genetic data from the target individual, and from the one or both parents, and from any related individuals, creating a set of at least one allelic hypothesis for the target individual, and for the one or both parents, and optionally for the one or more related individuals, where the hypotheses describe possible allelic states in the set of alleles, determining a statistical probability for each allelic hypothesis in the set of hypotheses given the obtained genetic data, and determining the allelic state for each of the alleles in the set of alleles for the target individual, and for the one or both parents, and optionally for the one or more related individuals, based on the statistical probabilities of each of the allelic hypotheses.

In some embodiments, the genetic data of the mixed sample may comprise sequence data wherein the sequence data may not uniquely map to the human genome. In some embodiments, the genetic data of the mixed sample may comprise sequence data wherein the sequence data maps to a plurality of locations in the genome, wherein each possible mapping is associated with a probability that the given mapping is correct. In some embodiments, the sequence reads are not assumed to be associated with a particular position in the genome. In some embodiments, the sequence reads are associated with a plurality of positions in the genome, and an associated probability belonging to that position.

Counting Method to Determine Chromosome Copy Number

In one aspect, the invention features methods of testing for an abnormal distribution of a fetal chromosome by comparing the number of sequence tags that align to different chromosomes (see, e.g., U.S. Pat. No. 8,296,076, filed Apr. 20, 2012, which is hereby incorporated by reference in its entirety). As is known in the art, the term "sequence tag" refers to a relatively short (e.g., 15-100) nucleic acid sequence that can be used to identify a certain larger sequence, e.g., be mapped to a chromosome or genomic region or gene. In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different target loci to produce a reaction mixture; wherein the target loci are from a plurality of different chromosomes; and wherein the plurality of different chromosomes comprise at least one first chromosome suspected of having an abnormal distribution in the sample and at least one second chromosome presumed to be normally distributed in the sample; (ii) subjecting the reaction mixture to primer extension reaction conditions to produce amplified products; (iii) sequencing the amplified products to obtain a plurality of sequence tags aligning to the target loci; wherein the sequence tags are of sufficient length to be assigned to a specific target locus; (iv) assigning on a computer the plurality of sequence tags to their corresponding target loci; (v) determining on a computer a number of sequence tags aligning to the target loci of the first chromosome and a number of sequence tags aligning to the target loci of the second chromosome; and (vi) comparing the numbers from step(v) to determine the presence or absence of an abnormal distribution of the first chromosome.

In one aspect, the invention provides methods for detecting the presence or absence of a fetal aneuploidy by comparing the relative frequency of target amplicons between chromosomes (see, e.g., PCT Publ. No. WO 2012/103031, filed Jan. 23, 2012, which is hereby incorporated by reference in its entirety). In some embodiments, the method involves (i) contacting a sample that includes a mixture of maternal and fetal DNA with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different non-polymorphic target loci to produce a reaction mixture; wherein the target loci are from a plurality of different chromosomes; (ii) subjecting the reaction mixture to primer extension reaction conditions to produce amplified products that includes target amplicons; (iii) quantifying on a computer a relative frequency of the target amplicons from the first and second chromosomes of interest; (iv) comparing on a computer the relative frequency of the target amplicons from the first and second chromosomes of interest; and (v) identifying the presence or absence of an aneuploidy based on the compared relative frequencies of the first and second chromosome of interest. In some embodiments, the first chromosome is a chromosome suspected of being euploid. In some embodiments, the second chromosome is a chromosome suspected of being aneuploidy Combining Methods of Prenatal Diagnosis There are many methods that may be used for prenatal diagnosis or prenatal screening of aneuploidy or other genetic defects. Described elsewhere in this document, and in U.S. Utility application Ser. No. 11/603,406, filed Nov. 28, 2006; U.S. Utility application Ser. No. 12/076,348, filed Mar. 17, 2008, and PCT Application Serial No. PCT/S09/52730 is one such method that uses the genetic data of related individuals to increase the accuracy with which genetic data of a target individual, such as a fetus, is known, or estimated. Other methods used for prenatal diagnosis involve measuring the levels of certain hormones in maternal blood, where those hormones are correlated with various genetic abnormalities. An example of this is called the triple test, a test wherein the levels of several (commonly two, three, four or five) different hormones are measured in maternal blood. In a case where multiple methods are used to determine the likelihood of a given outcome, where none of the methods are definitive in and of themselves, it is possible to combine the information given by those methods to make a prediction that is more accurate than any of the individual methods. In the triple test, combining the information given by the three different hormones can result in a prediction of genetic abnormalities that is more accurate than the individual hormone levels may predict.

Disclosed herein is a method for making more accurate predictions about the genetic state of a fetus, specifically the possibility of genetic abnormalities in a fetus that comprises combining predictions of genetic abnormalities in a fetus where those predictions were made using a variety of methods. A "more accurate" method may refer to a method for diagnosing an abnormality that has a lower false negative rate at a given false positive rate. In a favored embodiment of the present disclosure, one or more of the predictions are made based on the genetic data known about the fetus, where the genetic knowledge was determined using the PARENTAL SUPPORT™ method, that is, using genetic data of individual related to the fetus to determine the genetic data of the fetus with greater accuracy. In some embodiments the genetic data may include ploidy states of the fetus. In some embodiments, the genetic data may refer to a set of allele calls on the genome of the fetus. In some embodiments some of the predictions may have been made using the triple test. In some embodiments, some of the predictions may have been made using measurements of other hormone levels in maternal blood. In some embodiments, predictions made by methods considered diagnoses may be combined with predictions made by methods considered screening. In some embodiments, the method involves measuring maternal blood levels of alpha-fetoprotein (AFP). In some embodiments, the method involves measuring maternal blood levels of unconjugated estriol ($UE_3$). In some embodiments, the method involves measuring maternal blood levels of beta human chorionic gonadotropin (beta-hCG). In some embodiments, the method involves measuring maternal blood levels of invasive trophoblast antigen (ITA). In some embodiments, the method involves measuring maternal blood levels of inhibin. In some embodiments, the method involves measuring maternal blood levels of pregnancy-associated plasma protein A (PAPP-A). In some embodiments, the method involves measuring maternal blood levels of other hormones or maternal serum markers. In some embodiments, some of the predictions may have been made using other methods. In some embodiments, some of the predictions may have been made using a fully integrated test such as one that combines ultrasound and blood test at around 12 weeks of pregnancy and a second blood test at around 16 weeks. In some embodiments, the method involves measuring the fetal nuchal translucency (NT). In some embodiments, the method involves using the measured levels of the aforementioned hormones for making predictions. In some embodiments the method involves a combination of the aforementioned methods.

There are many ways to combine the predictions, for example, one could convert the hormone measurements into a multiple of the median (MoM) and then into likelihood ratios (LR). Similarly, other measurements could be transformed into LRs using the mixture model of NT distributions. The LRs for NT and the biochemical markers could be multiplied by the age and gestation-related risk to derive the risk for various conditions, such as trisomy 21. Detection rates (DRs) and false-positive rates (FPRs) could be calculated by taking the proportions with risks above a given risk threshold.

In an embodiment, a method to call the ploidy state involves combining the relative probabilities of each of the ploidy hypotheses determined using the joint distribution model and the allele count probabilities with relative probabilities of each of the ploidy hypotheses that are calculated using statistical techniques taken from other methods that determine a risk score for a fetus being trisomic, including but not limited to: a read count analysis, comparing heterozygosity rates, a statistic that is only available when parental genetic information is used, the probability of normalized genotype signals for certain parent contexts, a statistic that is calculated using an estimated fetal fraction of the first sample or the prepared sample, and combinations thereof.

Another method could involve a situation with four measured hormone levels, where the probability distribution around those hormones is known: $p(x_1, x_2, x_3, x_4|e)$ for the euploid case and $p(x_1, X2, x_3, x_4|a)$ for the aneuploid case. Then one could measure the probability distribution for the DNA measurements, $g(y|e)$ and $g(y|a)$ for the euploid and aneuploid cases respectively. Assuming they are independent given the assumption of euploid/aneuploid, one could combine as $p(x_1, x_2, x_3, x_4|a)g(y|a)$ and $p(x_1, x_2, x_3, x_4|e)g(y|e)$ and then multiply each by the prior $p(a)$ and $p(e)$ given the maternal age. One could then choose the one that is highest.

In an embodiment, it is possible to evoke central limit theorem to assume distribution on $g(y|a$ or $e)$ is Gaussian, and measure mean and standard deviation by looking at multiple samples. In another embodiment, one could assume they are not independent given the outcome and collect enough samples to estimate the joint distribution $p(x_1, x_2, x_3, x_4 | a$ or $e)$.

In an embodiment, the ploidy state for the target individual is determined to be the ploidy state that is associated with the hypothesis whose probability is the greatest. In some cases, one hypothesis will have a normalized, combined probability greater than 90%. Each hypothesis is associated with one, or a set of, ploidy states, and the ploidy state associated with the hypothesis whose normalized, combined probability is greater than 90%, or some other threshold value, such as 50%, 80%, 95%, 98%, 99%, or 99.9%, may be chosen as the threshold required for a hypothesis to be called as the determined ploidy state.

DNA from Children from Previous Pregnancies in Maternal Blood

One difficulty to non-invasive prenatal diagnosis is differentiating fetal cells from the current pregnancy from fetal cells from previous pregnancies. Some believe that genetic matter from prior pregnancies will go away after some time, but conclusive evidence has not been shown. In an embodiment of the present disclosure, it is possible to determine fetal DNA present in the maternal blood of paternal origin (that is, DNA that the fetus inherited from the father) using the PARENTAL SUPPORT™ (PS) method, and the knowledge of the paternal genome. This method may utilize phased parental genetic information. It is possible to phase the parental genotype from unphased genotypic information using grandparental genetic data (such as measured genetic data from a sperm from the grandfather), or genetic data from other born children, or a sample of a miscarriage. One could also phase unphased genetic information by way of a HapMap-based phasing, or a haplotyping of paternal cells. Successful haplotyping has been demonstrated by arresting cells at phase of mitosis when chromosomes are tight bundles and using microfluidics to put separate chromosomes in separate wells. In another embodiment it is possible to use the phased parental haplotypic data to detect the presence of more than one homolog from the father, implying that the genetic material from more than one child is present in the blood. By focusing on chromosomes that are expected to be euploid in a fetus, one could rule out the possibility that the fetus was afflicted with a trisomy. Also, it is possible to determine if the fetal DNA is not from the current father, in which case one could use other methods such as the triple test to predict genetic abnormalities.

There may be other sources of fetal genetic material available via methods other than a blood draw. In the case of the fetal genetic material available in maternal blood, there are two main categories: (1) whole fetal cells, for example, nucleated fetal red blood cells or erythroblats, and (2) free floating fetal DNA. In the case of whole fetal cells, there is some evidence that fetal cells can persist in maternal blood for an extended period of time such that it is possible to isolate a cell from a pregnant woman that contains the DNA from a child or fetus from a prior pregnancy. There is also evidence that the free floating fetal DNA is cleared from the system in a matter of weeks. One challenge is how to determine the identity of the individual whose genetic material is contained in the cell, namely to ensure that the measured genetic material is not from a fetus from a prior pregnancy. In an embodiment of the present disclosure, the knowledge of the maternal genetic material can be used to ensure that the genetic material in question is not maternal genetic material. There are a number of methods to accomplish this end, including informatics based methods such as PARENTAL SUPPORT™, as described in this document or any of the patents referenced in this document.

In an embodiment of the present disclosure, the blood drawn from the pregnant mother may be separated into a fraction comprising free floating fetal DNA, and a fraction comprising nucleated red blood cells. The free floating DNA may optionally be enriched, and the genotypic information of the DNA may be measured. From the measured genotypic information from the free floating DNA, the knowledge of the maternal genotype may be used to determine aspects of the fetal genotype. These aspects may refer to ploidy state, and/or a set of allele identities. Then, individual nucleated red blood cells may be genotyped using methods described elsewhere in this document, and other referent patents, especially those mentioned in the first section of this document. The knowledge of the maternal genome would allow one to determine whether or not any given single blood cell is genetically maternal. And the aspects of the fetal genotype that were determined as described above would allow one to determine if the single blood cell is genetically derived from the fetus that is currently gestating. In essence, this aspect of the present disclosure allows one to use the genetic knowledge of the mother, and possibly the genetic information from other related individuals, such as the father, along with the measured genetic information from the free floating DNA found in maternal blood to determine whether an isolated nucleated cell found in maternal blood is either (a) genetically maternal, (b) genetically from the fetus currently gestating, or (c) genetically from a fetus from a prior pregnancy.

Prenatal Sex Chromosome Aneuploidy Determination

In methods known in the art, people attempting to determine the sex of a gestating fetus from the blood of the mother have used the fact that fetal free floating DNA (fffDNA) is present in the plasma of the mother. If one is able to detect Y-specific loci in the maternal plasma, this implies that the gestating fetus is a male. However, the lack of detection of Y-specific loci in the plasma does not always guarantee that the gestating fetus is a female when using methods known in the art, as in some cases the amount of fffDNA is too low to ensure that the Y-specific loci would be detected in the case of a male fetus.

Presented here is a novel method that does not require the measurement of Y-specific nucleic acids, that is, DNA that is from loci that are exclusively paternally derived. The Parental Support method, disclosed previously, uses crossover frequency data, parental genotypic data, and informatics techniques, to determine the ploidy state of a gestating fetus. The sex of a fetus is simply the ploidy state of the fetus at the sex chromosomes. A child that is XX is female, and XY is male. The method described herein is also able to determine the ploidy state of the fetus. Note that sexing is effectively synonymous with ploidy determination of the sex chromosomes; in the case of sexing, an assumption is often made that the child is euploid, therefore there are fewer possible hypotheses.

The method disclosed herein involves looking at loci that are common to both the X and Y chromosome to create a baseline in terms of expected amount of fetal DNA present for a fetus. Then, those regions that are specific only to the X chromosome can be interrogated to determine if the fetus is female or male. In the case of a male, we expect to see less fetal DNA from loci that are specific to the X chromosome than from loci that are specific to both the X and the Y. In contrast, in female fetuses, we expect the amount of DNA for each of these groups to be the same. The DNA in question can be measured by any technique that can quantitate the amount of DNA present on a sample, for example, qPCR, SNP arrays, genotyping arrays, or sequencing. For DNA that is exclusively from an individual we would expect to see the following:

|  | DNA specific to X | DNA specific to X and Y | DNA specific to Y |
|---|---|---|---|
| Male (XY) | A | 2A | A |
| Female (XX) | 2A | 2A | 0 |

In the case of DNA from a fetus that is mixed with DNA from the mother, and where the fraction of fetal DNA in the mixture is F, and where the fraction of maternal DNA in the mixture is M, such that F+M=100%, we would expect to see the following:

|  | DNA specific to X | DNA specific to X and Y | DNA specific to Y |
|---|---|---|---|
| Male fetus (XY) | M + ½ F | M + F | ½ F |
| Female fetus (XX) | M + F | M + F | 0 |

In the case where F and M are known, the expected ratios can be computed, and the observed data can be compared to the expected data. In the case where M and F are not known, a threshold can be selected based on historical data. In both cases, the measured amount of DNA at loci specific to both X and Y can be used as a baseline, and the test for the sex of the fetus can be based on the amount of DNA observed on loci specific to only the X chromosome. If that amount is lower than the baseline by an amount roughly equal to ½ F, or by an amount that causes it to fall below a predefined threshold, the fetus is determined to be male, and if that amount is about equal to the baseline, or if is not lower by an amount that causes it to fall below a predefined threshold, the fetus is determined to be female.

In another embodiment, one can look only at those loci that are common to both the X and the Y chromosomes, often termed the Z chromosome. A subset of the loci on the Z chromosome are typically always A on the X chromosome, and B on the Y chromosome. If SNPs from the Z chromosome are found to have the B genotype, then the fetus is called a male; if the SNPs from the Z chromosome are found to only have A genotype, then the fetus is called a female. In another embodiment, one can look at the loci that are found only on the X chromosome. Contexts such as AA|B are particularly informative as the presence of a B indicates that the fetus has an X chromosome from the father. Contexts such as AB|B are also informative, as we expect to see B present only half as often in the case of a female fetus as compared to a male fetus. In another embodiment, one can look at the SNPs on the Z chromosome where both A and B alleles are present on both the X and the Y chromosome, and where the it is known which SNPs are from the paternal Y chromosome, and which are from the paternal X chromosome.

In an embodiment, it is possible to amplify single nucleotide positions known to varying between the homologous non-recombining (HNR) region shared by chromosome Y and chromosome X. The sequence within this HNR region is largely identical between the X and Y chromosomes. Within this identical region are single nucleotide positions that, while invariant among X chromosomes and among Y chromosomes in the population, are different between the X and Y chromosomes. Each PCR assay could amplify a sequence from loci that are present on both the X and Y chromosomes. Within each amplified sequence would be a single base that can be detected using sequencing or some other method (see, for example, U.S. Publication No. 2011/0178719, filed Feb. 3, 2011, which is hereby incorporated by reference in its entirety).

In an embodiment, the sex of the fetus could be determined from the fetal free floating DNA found in maternal plasma, the method comprising some or all of the following steps: 1) Design PCR (either regular or mini-PCR, plus multiplexing if desired) primers amplify X/Y variant single nucleotide positions within HNR region, 2) obtain maternal plasma, 3) PCR Amplify targets from maternal plasma using HNR X/Y PCR assays, 4) sequence the amplicons, 5) Examine sequence data for presence of Y-allele within one or more of the amplified sequences. The presence of one or more would indicate a male fetus. Absence of all Y-alleles from all amplicons indicates a female fetus.

In an embodiment, one could use targeted sequencing to measure the DNA in the maternal plasma and/or the parental genotypes. In an embodiment, one could ignore all sequences that clearly originate from paternally sourced DNA. For example, in the context AA|AB, one could count the number of A sequences and ignore all the B sequences. In order to determine a heterozygosity rate for the above algorithm, one could compare the number of observed A sequences to the expected number of total sequences for the given probe. There are many ways one could calculate an expected number of sequences for each probe on a per sample basis. In an embodiment, it is possible to use historical data to determine what fraction of all sequence reads belongs to each specific probe and then use this empirical fraction, combined with the total number of sequence reads, to estimate the number of sequences at each probe. Another approach could be to target some known homozygous alleles and then use historical data to relate the number of reads at each probe with the number of reads at the known homozygous alleles. For each sample, one could then measure the number of reads at the homozygous alleles and then use this measurement, along with the empirically derived relationships, to estimate the number of sequence reads at each probe.

In some embodiments, it is possible to determine the sex of the fetus by combining the predictions made by a plurality of methods. In some embodiments the plurality of methods are taken from methods described in this disclosure. In some embodiments, at least one of the plurality of methods are taken from methods described in this disclosure.

In some embodiments the method described herein can be used to determine the ploidy state of the gestating fetus. In an embodiment, the ploidy calling method uses loci that are specific to the X chromosome, or common to both the X and Y chromosome, but does not make use of any Y-specific loci. In an embodiment, the ploidy calling method uses one or more of the following: loci that are specific to the X chromosome, loci that are common to both the X and Y chromosome, and loci that are specific to the Y chromosome. In an embodiment, where the ratios of sex chromosomes are similar, for example 45,X (Turner Syndrome), 46,XX (normal female) and 47,XXX (trisomy X), the differentiation can be accomplished by comparing the allele distributions to expected allele distributions according to the various hypotheses. In another embodiment, this can be accomplished by comparing the relative number of sequence reads for the sex chromosomes to one or a plurality of reference chromosomes that are assumed to be euploid. Also note that these methods can be expanded to include aneuploid cases.

Single Gene Disease Screening

In an embodiment, a method for determining the ploidy state of the fetus may be extended to enable simultaneous testing for single gene disorders. Single-gene disease diagnosis leverages the same targeted approach used for aneuploidy testing, and requires additional specific targets. In an embodiment, the single gene NPD diagnosis is through linkage analysis. In many cases, direct testing of the cfDNA sample is not reliable, as the presence of maternal DNA makes it virtually impossible to determine if the fetus has inherited the mother's mutation. Detection of a unique paternally-derived allele is less challenging, but is only fully informative if the disease is dominant and carried by the father, limiting the utility of the approach. In an embodiment, the method involves PCR or related amplification approaches.

In some embodiments, the method involves phasing the abnormal allele with surrounding very tightly linked SNPs in the parents using information from first-degree relatives. Then Parental Support may be run on the targeted sequencing data obtained from these SNPs to determine which homologs, normal or abnormal, were inherited by the fetus from both parents. As long as the SNPs are sufficiently linked, the inheritance of the genotype of the fetus can be determined very reliably. In some embodiments, the method comprises (a) adding a set of SNP loci to densely flank a specified set of common diseases to our multiplex pool for aneuploidy testing; (b) reliably phasing the alleles from these added SNPs with the normal and abnormal alleles based on genetic data from various relatives; and (c) reconstructing the fetal haplotype, or set of phased SNP alleles on the inherited maternal and paternal homologs in the region surrounding the disease locus to determine fetal genotype. In some embodiments additional probes that are closely linked to a disease linked locus are added to the set of polymorphic locus being used for aneuploidy testing.

Reconstructing fetal diplotype is challenging because the sample is a mixture of maternal and fetal DNA. In some embodiments, the method incorporates relative information to phase the SNPs and disease alleles, then take into account physical distance of the SNPs and recombination data from location specific recombination likelihoods and the data observed from the genetic measurements of the maternal plasma to obtain the most likely genotype of the fetus.

In an embodiment, a number of additional probes per disease linked locus are included in the set of targeted polymorphic loci; the number of additional probes per disease linked locus may be between 4 and 10, between 11 and 20, between 21 and 40, between 41 and 60, between 61 and 80, or combinations thereof.

Phasing the diploid data from the parents can be challenging, and there are a number of ways this can be accomplished. Some are discussed in this disclosure, others are described in greater detail in other disclosures (see, e.g., PCT Publ. No. WO2009105531, filed Feb. 9, 2009, and PCT Publ. No. WO2010017214, filed Aug. 4, 2009, which are each hereby incorporated by reference in its entirety). In one embodiment, a parent can be phased by inference by measuring tissue from the parent that is haploid, for example by measuring one or more sperm or eggs. In one embodiment the parent can be phased by inference using the measured genotypic data of a first degree relative such as the parent's parent(s) or siblings. In one embodiment, the parent can be phased by dilution where the DNA is diluted, in one or a plurality of wells, to the point where there is expected to be no more than approximately one copy of each haplotype in each well, and then measuring the DNA in the one or more wells. In one embodiment, the parent genotype can be phased by using computer programs that use population based haplotype frequencies to infer the most likely phase. In one embodiment, the parent can be phased if the phased haplotypic data is known for the other parent, along with the unphased genetic data of one or more genetic offspring of the parents. In some embodiments, the genetic offspring of the parents may be one or more embryos, fetuses, and/or born children. Some of these methods and other methods for phasing one or both parents are disclosed in greater detail in, e.g., U.S. Publ. No. 2011/0033862, filed Aug. 19, 2010; U.S. Publ. No. 2011/0178719, filed Feb. 3, 2011; U.S. Publ. No. 2007/0184467, filed Nov. 22, 2006; U.S. Publ. No. 2008/0243398, filed Mar. 17, 2008, which are each hereby incorporated by reference in its entirety.

Fetal Genome Reconstruction

In one aspect, the invention features methods for determining a haplotype of a fetus. In various embodiments, this method allows one to determine which polymorphic loci (such as SNPs) were inherited by the fetus and to reconstruct which homologs (including recombination events) are present in the fetus (and thereby interpolate the sequence between the polymorphic loci). If desired, essentially the entire genome of the fetus can be reconstructed. If there is some remaining ambiguity in the genome of the fetus (such as in intervals with a crossover), this ambiguity can be minimized if desired by analyzing additional polymorphic loci. In various embodiments, the polymorphic loci are chosen to cover one or more of the chromosomes at a density to reduce any ambiguity to a desired level. This method has important applications for the detection of polymorphisms or other mutations of interest in a fetus since it enables their detection based on linkage (such as the presence of linked polymorphic loci in the fetal genome) rather than by directing detecting the polymorphism or other mutation of interest in the fetal genome. For example, if a parent is a carrier for a mutation associated with cystic fibrosis (CF), a nucleic acid sample that includes maternal DNA from the mother of the fetus and fetal DNA from the fetus can be analyzed to determine whether the fetal DNA include the haplotype containing the CF mutation. In particular, polymorphic loci can be analyzed to determine whether the fetal DNA includes the haplotype containing the CF mutation without having to detect the CF mutation itself in the fetal DNA. This is useful in screening for one or more mutations, such as disease-linked mutations, without having to directly detect the mutations.

In some embodiments, the method involves determining a parental haplotype (e.g., a haplotype of the mother or father of the fetus). In some embodiments, this determination is made without using data from a relative of the mother or father. In some embodiments, a parental haplotype is determined using a dilution approach followed by SNP genotyping or sequencing as described herein and elsewhere (see, e.g., U.S. Publ. No. 2011/0033862, filed Aug. 19, 2010, which is hereby incorporated by reference in its entirety). Because the DNA is diluted, it is unlikely that more than one haplotype is in the same fraction (or tube). Thus, there may be effectively a single molecule of DNA in the tube, which allows the haplotype on a single DNA molecule to be determined. In some embodiments, the method includes dividing a DNA sample into a plurality of fractions such that at least one of the fractions includes one chromosome or one chromosome segment from a pair of chromosomes, and genotyping (e.g., determining the presence of two or more polymorphic loci) the DNA sample in at least one of the fractions, thereby determining a parental haplotype. In some embodiments, the genotyping involves sequencing (such as shotgun sequencing). In some embodiments, the genotyping involves use of a SNP array to detect polymorphic loci, such as at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, the genotyping involves the use of multiplex PCR. In some embodiments, the method involves contacting the sample in a fraction with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data.

In some embodiments, a haplotype of the mother is determined by any of the methods described herein using data from a relative of the mother. In some embodiments, a haplotype of the father is determined by any of the methods described herein using data from a relative of the father. In some embodiments, a haplotype is determined for both the father and the mother. In some embodiments, a SNP array is used to determine the presence of at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci in a DNA sample from the mother (or father) and a relative of the mother (or father). In some embodiments, the method involves contacting a DNA sample from the mother (or father) and/or a relative of the mother (or father) with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture; and subjecting the reaction mixture to primer extension reaction conditions to produce amplified products that are measured with a high throughput sequencer to produce sequencing data. The parental haplotype may be determined based on the SNP array or sequencing data. In some embodiments, parental data may be phased by methods described or referred to elsewhere in this document.

This parental haplotype data can be used to determine if the fetus inherited the parental haplotype. In some embodiments, a nucleic acid sample that includes maternal DNA from the mother of the fetus and fetal DNA from the fetus is analyzed using a SNP array to detect at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci. In some embodiments, a nucleic acid sample that includes maternal DNA from the mother of the fetus and fetal DNA from the fetus is analyzed by contacting the sample with a library of primers that simultaneously hybridize to at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci (such as SNPs) to produce a reaction mixture. In some embodiments, the reaction mixture is subjected to primer extension reaction conditions to produce amplified products. In some embodiments, the amplified products are measured with a high throughput sequencer to produce sequencing data. In various embodiments, the SNP array or sequencing data is used to determine a parental haplotype by using data about the probability of chromosomes crossing over at different locations in a chromosome (such as by using recombination data such as may be found in the HapMap database to create a recombination risk score for any interval) to model dependence between polymorphic alleles on the chromosome. In some embodiments, allele counts at the polymorphic loci are calculated on a computer based on the sequencing data. In some embodiments, a plurality of ploidy hypotheses each pertaining to a different possible ploidy state of the chromosome are created on a computer; a model (such as a joint distribution model) for the expected allele counts at the polymorphic loci on the chromosome is built on a computer for each ploidy hypothesis; a relative probability of each of the ploidy hypotheses is determined on a computer using the joint distribution model and the allele counts; and the ploidy state of the fetus is called by selecting the ploidy state corresponding to the hypothesis with the greatest probability. In some embodiments, building a joint distribution model for allele counts and the step of determining the relative probability of each hypothesis are done using a method that does not require the use of a reference chromosome.

In some embodiments, a fetal haplotype is determined for one or more chromosomes taken from the group consisting of chromosomes 13, 18, 21, X, and Y. In some embodiments, a fetal haplotype is determined for all of the fetal chromosomes. In various embodiments, the method determines essentially the entire genome of the fetus. In some embodiments, the haplotype is determined for at least 30, 40, 50, 60, 70, 80, 90, or 95% of the genome of the fetus. In some embodiments, the haplotype determination of the fetus includes information about which allele is present for at least 25; 50; 75; 100; 300; 500; 750; 1,000; 2,000; 5,000; 7,500; 10,000; 15,000; 19,000; 20,000; 25,000; 27,000; 28,000; 30,000; 40,000; 50,000; 75,000; or 100,000 different polymorphic loci.

Compositions of DNA

When performing an informatics analysis on sequencing data measured on a mixture of fetal and maternal blood to determine genomic information pertaining to the fetus, for example the ploidy state of the fetus, it may be advantageous to measure the allele distributions at a set of alleles. Unfortunately, in many cases, such as when attempting to determine the ploidy state of a fetus from the DNA mixture found in the plasma of a maternal blood sample, the amount of DNA available is not sufficient to directly measure the allele distributions with good fidelity in the mixture. In these cases, amplification of the DNA mixture will provide sufficient numbers of DNA molecules that the desired allele distributions may be measured with good fidelity. However, current methods of amplification typically used in the amplification of DNA for sequencing are often very biased, meaning that they do not amplify both alleles at a polymorphic locus by the same amount. A biased amplification can result in allele distributions that are quite different from the allele distributions in the original mixture. For most purposes, highly accurate measurements of the relative amounts of alleles present at polymorphic loci are not needed. In contrast, in an embodiment of the present disclosure, amplification or enrichment methods that specifically enrich polymorphic alleles and preserve allelic ratios is advantageous.

A number of methods are described herein that may be used to preferentially enrich a sample of DNA at a plurality of loci in a way that minimizes allelic bias. Some examples are using circularizing probes to target a plurality of loci where the 3' ends and 5' ends of the pre-circularized probe are designed to hybridize to bases that are one or a few positions away from the polymorphic sites of the targeted allele. Another is to use PCR probes where the 3' end PCR probe is designed to hybridize to bases that are one or a few positions away from the polymorphic sites of the targeted allele. Another is to use a split and pool approach to create mixtures of DNA where the preferentially enriched loci are enriched with low allelic bias without the drawbacks of direct multiplexing. Another is to use a hybrid capture approach where the capture probes are designed such that the region of the capture probe that is designed to hybridize to the DNA flanking the polymorphic site of the target is separated from the polymorphic site by one or a small number of bases.

In the case where measured allele distributions at a set of polymorphic loci are used to determine the ploidy state of an individual, it is desirable to preserve the relative amounts of alleles in a sample of DNA as it is prepared for genetic measurements. This preparation may involve WGA amplification, targeted amplification, selective enrichment techniques, hybrid capture techniques, circularizing probes or other methods meant to amplify the amount of DNA and/or selectively enhance the presence of molecules of DNA that correspond to certain alleles.

In some embodiments of the present disclosure, there is a set of DNA probes designed to target loci where the loci have maximal minor allele frequencies. In some embodiments of the present disclosure, there is a set of probes that are designed to target where the loci have the maximum likelihood of the fetus having a highly informative SNP at those loci. In some embodiments of the present disclosure, there is a set of probes that are designed to target loci where the probes are optimized for a given population subgroup. In some embodiments of the present disclosure, there is a set of probes that are designed to target loci where the probes are optimized for a given mix of population subgroups. In some embodiments of the present disclosure, there is a set of probes that are designed to target loci where the probes are optimized for a given pair of parents which are from different population subgroups that have different minor allele frequency profiles. In some embodiments of the present disclosure, there is a circularized strand of DNA that comprises at least one base pair that annealed to a piece of DNA that is of fetal origin. In some embodiments of the present disclosure, there is a circularized strand of DNA that comprises at least one base pair that annealed to a piece of DNA that is of placental origin. In some embodiments of the present disclosure, there is a circularized strand of DNA that circularized while at least some of the nucleotides were annealed to DNA that was of fetal origin. In some embodiments of the present disclosure, there is a circularized strand of DNA that circularized while at least some of the nucleotides were annealed to DNA that was of placental origin. In some embodiments of the present disclosure, there is a set of probes wherein some of the probes target single tandem repeats, and some of the probes target single nucleotide polymorphisms. In some embodiments, the loci are selected for the purpose of non-invasive prenatal diagnosis. In some embodiments, the probes are used for the purpose of non-invasive prenatal diagnosis. In some embodiments, the loci are targeted using a method that could include circularizing probes, MIPs, capture by hybridization probes, probes on a SNP array, or combinations thereof. In some embodiments, the probes are used as circularizing probes, MIPs, capture by hybridization probes, probes on a SNP array, or combinations thereof. In some embodiments, the loci are sequenced for the purpose of non-invasive prenatal diagnosis.

In the case where the relative informativeness of a sequence is greater when combined with relevant parent contexts, it follows that maximizing the number of sequence reads that contain a SNP for which the parental context is known may maximize the informativeness of the set of sequencing reads on the mixed sample. In an embodiment, the number of sequence reads that contain a SNP for which the parent contexts are known may be enhanced by using qPCR to preferentially amplify specific sequences. In an embodiment, the number of sequence reads that contain a SNP for which the parent contexts are known may be enhanced by using circularizing probes (for example, MIPs) to preferentially amplify specific sequences. In an embodiment, the number of sequence reads that contain a SNP for which the parent contexts are known may be enhanced by using a capture by hybridization method (for example SURESELECT) to preferentially amplify specific sequences. Different methods may be used to enhance the number of sequence reads that contain a SNP for which the parent contexts are known. In an embodiment, the targeting may be accomplished by extension ligation, ligation without extension, capture by hybridization, or PCR.

In a sample of fragmented genomic DNA, a fraction of the DNA sequences map uniquely to individual chromosomes; other DNA sequences may be found on different chromosomes. Note that DNA found in plasma, whether maternal or fetal in origin is typically fragmented, often at lengths under 500 bp. In a typical genomic sample, roughly 3.3% of the mappable sequences will map to chromosome 13; 2.2% of the mappable sequences will map to chromosome 18; 1.35% of the mappable sequences will map to chromosome 21; 4.5% of the mappable sequences will map to chromosome X in a female; 2.25% of the mappable sequences will map to chromosome X (in a male); and 0.73% of the mappable sequences will map to chromosome Y (in a male). These are the chromosomes that are most likely to be aneuploid in a fetus. Also, among short sequences, approximately 1 in 20 sequences will contain a SNP, using the SNPs contained on dbSNP. The proportion may well be higher given that there may be many SNPs that have not been discovered.

In an embodiment of the present disclosure, targeting methods may be used to enhance the fraction of DNA in a sample of DNA that map to a given chromosome such that the fraction significantly exceeds the percentages listed above that are typical for genomic samples. In an embodiment of the present disclosure, targeting methods may be used to enhance the fraction of DNA in a sample of DNA such that the percentage of sequences that contain a SNP are significantly greater than what may be found in typical for genomic samples. In an embodiment of the present disclosure, targeting methods may be used to target DNA from a chromosome or from a set of SNPs in a mixture of maternal and fetal DNA for the purposes of prenatal diagnosis.

Note that a method has been reported (U.S. Pat. No. 7,888,017) for determining fetal aneuploidy by counting the number of reads that map to a suspect chromosome and comparing it to the number of reads that map to a reference chromosome, and using the assumption that an overabundance of reads on the suspect chromosome corresponds to a triploidy in the fetus at that chromosome. Those methods for prenatal diagnosis would not make use of targeting of any sort, nor do they describe the use of targeting for prenatal diagnosis.

By making use of targeting approaches in sequencing the mixed sample, it may be possible to achieve a certain level of accuracy with fewer sequence reads. The accuracy may refer to sensitivity, it may refer to specificity, or it may refer to some combination thereof. The desired level of accuracy may be between 90% and 95%; it may be between 95% and 98%; it may be between 98% and 99%; it may be between 99% and 99.5%; it may be between 99.5% and 99.9%; it may be between 99.9% and 99.99%; it may be between 99.99% and 99.999%, it may be between 99.999% and 100%. Levels of accuracy above 95% may be referred to as high accuracy.

There are a number of published methods in the prior art that demonstrate how one may determine the ploidy state of a fetus from a mixed sample of maternal and fetal DNA, for example: G. J. W. Liao et al. Clinical Chemistry 2011; 57 (1) pp. 92-101. These methods focus on thousands of locations along each chromosome. The number of locations along a chromosome that may be targeted while still resulting in a high accuracy ploidy determination on a fetus, for a given number of sequence reads, from a mixed sample of DNA is unexpectedly low. In an embodiment of the present disclosure, an accurate ploidy determination may be made by using targeted sequencing, using any method of targeting, for example qPCR, ligand mediated PCR, other PCR methods, capture by hybridization, or circularizing probes, wherein the number of loci along a chromosome that need to be targeted may be between 5,000 and 2,000 loci; it may be between 2,000 and 1,000 loci; it may be between 1,000 and 500 loci; it may be between 500 and 300 loci; it may be between 300 and 200 loci; it may be between 200 and 150 loci; it may be between 150 and 100 loci; it may be between 100 and 50 loci; it may be between 50 and 20 loci; it may be between 20 and 10 loci. Optimally, it may be between 100 and 500 loci. The high level of accuracy may be achieved by targeting a small number of loci and executing an unexpectedly small number of sequence reads. The number of reads may be between 100 million and 50 million reads; the number of reads may be between 50 million and 20 million reads; the number of reads may be between 20 million and 10 million reads; the number of reads may be between 10 million and 5 million reads; the number of reads may be between 5 million and 2 million reads; the number of reads may be between 2 million and 1 million; the number of reads may be between 1 million and 500,000; the number of reads may be between 500,000 and 200,000; the number of reads may be between 200,000 and 100,000; the number of reads may be between 100,000 and 50,000; the number of reads may be between 50,000 and 20,000; the number of reads may be between 20,000 and 10,000; the number of reads may be below 10,000. Fewer number of read are necessary for larger amounts of input DNA.

In some embodiments, there is a composition comprising a mixture of DNA of fetal origin, and DNA of maternal origin, wherein the percent of sequences that uniquely map to chromosome 13 is greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 18 is greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome 21 is greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome X is greater than 6%, greater than 7%, greater than 8%, greater than 9%, greater than 10%, greater than 12%, greater than 15%, greater than 20%, greater than 25%, or greater than 30%. In some embodiments of the present disclosure, there is a composition comprising a mixture of DNA of fetal origin, and DNA of maternal origin, wherein the percent of sequences that uniquely map to chromosome Y is greater than 1%, greater than 2%, greater than 3%, greater than 4%, greater than 5%, greater than 6%, greater than 7%, greater than 8%, greater than 9%, greater than 10%, greater than 12%, greater than 15%, greater than 20%, greater than 25%, or greater than 30%.

In some embodiments, a composition is described comprising a mixture of DNA of fetal origin, and DNA of maternal origin, wherein the percent of sequences that uniquely map to a chromosome, and that contains at least one single nucleotide polymorphism is greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, and where the chromosome is taken from the group 13, 18, 21, X, or Y. In some embodiments of the present disclosure, there is a composition comprising a mixture of DNA of fetal origin, and DNA of maternal origin, wherein the percent of sequences that uniquely map to a chromosome and that contain at least one single nucleotide polymorphism from a set of single nucleotide polymorphisms is greater than 0.15%, greater than 0.2%, greater than 0.3%, greater than 0.4%, greater than 0.5%, greater than 0.6%, greater than 0.7%, greater than 0.8%, greater than 0.9%, greater than 1%, greater than 1.2%, greater than 1.4%, greater than 1.6%, greater than 1.8%, greater than 2%, greater than 2.5%, greater than 3%, greater than 4%, greater than 5%, greater than 6%, greater than 7%, greater than 8%, greater than 9%, greater than 10%, greater than 12%, greater than 15%, or greater than 20%, where the chromosome is taken from the set of chromosome 13, 18, 21, X and Y, and where the number of single nucleotide polymorphisms in the set of single nucleotide polymorphisms is between 1 and 10, between 10 and 20, between 20 and 50, between 50 and 100, between 100 and 200, between 200 and 500, between 500 and 1,000, between 1,000 and 2,000, between 2,000 and 5,000, between 5,000 and 10,000, between 10,000 and 20,000, between 20,000 and 50,000, and between 50,000 and 100,000.

In theory, each cycle in the amplification doubles the amount of DNA present; however, in reality, the degree of amplification is slightly lower than two. In theory, amplification, including targeted amplification, will result in bias free amplification of a DNA mixture; in reality, however, different alleles tend to be amplified to a different extent than other alleles. When DNA is amplified, the degree of allelic bias typically increases with the number of amplification steps. In some embodiments, the methods described herein involve amplifying DNA with a low level of allelic bias. Since the allelic bias compounds with each additional cycle, one can determine the per cycle allelic bias by calculating the nth root of the overall bias where n is the base 2 logarithm of degree of enrichment. In some embodiments, there is a composition comprising a second mixture of DNA, where the second mixture of DNA has been preferentially enriched at a plurality of polymorphic loci from a first mixture of DNA where the degree of enrichment is at least 10, at least 100, at least 1,000, at least 10,000, at least 100,000 or at least 1,000,000, and where the ratio of the alleles in the second mixture of DNA at each locus differs from the ratio of the alleles at that locus in the first mixture of DNA by a factor that is, on average, less than 1,000%, 500%, 200%, 100%, 50%, 20%, 10%, 5%, 2%, 1%, 0.5%, 0.2%, 0.1%, 0.05%, 0.02%, or 0.01%. In some embodiments, there is a composition comprising a second mixture of DNA, where the second mixture of DNA has been preferentially enriched at a plurality of polymorphic loci from a first mixture of DNA where the per cycle allelic bias for the plurality of polymorphic loci is, on average, less than 10%, 5%, 2%, 1%, 0.5%, 0.2%, 0.1%, 0.05%, or 0.02%. In some embodiments, the plurality of polymorphic loci comprises at least 10 loci, at least 20 loci, at least 50 loci, at least 100 loci, at least 200 loci, at least 500 loci, at least 1,000 loci, at least 2,000 loci, at least 5,000 loci, at least 10,000 loci, at least 20,000 loci, or at least 50,000 loci.

Some Embodiments

In some embodiments, a method is disclosed herein for generating a report disclosing the determined ploidy status of a chromosome in a gestating fetus, the method comprising: obtaining a first sample that contains DNA from the mother of the fetus and DNA from the fetus; obtaining genotypic data from one or both parents of the fetus; preparing the first sample by isolating the DNA so as to obtain a prepared sample; measuring the DNA in the prepared sample at a plurality of polymorphic loci; calculating, on a computer, allele counts or allele count probabilities at the plurality of polymorphic loci from the DNA measurements made on the prepared sample; creating, on a computer, a plurality of ploidy hypotheses concerning expected allele count probabilities at the plurality of polymorphic loci on the chromosome for different possible ploidy states of the chromosome; building, on a computer, a joint distribution model for allele count probability of each polymorphic locus on the chromosome for each ploidy hypothesis using genotypic data from the one or both parents of the fetus; determining, on a computer, a relative probability of each of the ploidy hypotheses using the joint distribution model and the allele count probabilities calculated for the prepared sample; calling the ploidy state of the fetus by selecting the ploidy state corresponding to the hypothesis with the greatest probability; and generating a report disclosing the determined ploidy status.

In some embodiments, the method is used to determine the ploidy state of a plurality of gestating fetuses in a plurality of respective mothers, the method further comprising: determining the percent of DNA that is of fetal origin in each of the prepared samples; and wherein the step of measuring the DNA in the prepared sample is done by sequencing a number of DNA molecules in each of the prepared samples, where more molecules of DNA are sequenced from those prepared samples that have a smaller fraction of fetal DNA than those prepared samples that have a larger fraction of fetal DNA.

In some embodiments, the method is used to determine the ploidy state of a plurality of gestating fetuses in a plurality of respective mothers, and where the measuring the DNA in the prepared sample is done, for each of the fetuses, by sequencing a first fraction of the prepared sample of DNA to give a first set of measurements, the method further comprising: making a first relative probability determination for each of the ploidy hypotheses for each of the fetuses, given the first set of DNA measurements; resequencing a second fraction of the prepared sample from those fetuses where the first relative probability determination for each of the ploidy hypotheses indicates that a ploidy hypothesis corresponding to an aneuploid fetus has a significant but not conclusive probability, to give a second set of measurements; making a second relative probability determination for ploidy hypotheses for the fetuses using the second set of measurements and optionally also the first set of measurements; and calling the ploidy states of the fetuses whose second sample was resequenced by selecting the ploidy state corresponding to the hypothesis with the greatest probability as determined by the second relative probability determination.

In some embodiments, a composition of matter is disclosed, the composition of matter comprising: a sample of preferentially enriched DNA, wherein the sample of preferentially enriched DNA has been preferentially enriched at a plurality of polymorphic loci from a first sample of DNA, wherein the first sample of DNA consisted of a mixture of maternal DNA and fetal DNA derived from maternal plasma, where the degree of enrichment is at least a factor of 2, and wherein the allelic bias between the first sample and the preferentially enriched sample is, on average, selected from the group consisting of less than 2%, less than 1%, less than 0.5%, less than 0.2%, less than 0.1%, less than 0.05%, less than 0.02%, and less than 0.01%. In some embodiments, a method is disclosed to create a sample of such preferentially enriched DNA.

In some embodiment, a method is disclosed for determining the presence or absence of a fetal aneuploidy in a maternal tissue sample comprising fetal and maternal genomic DNA, wherein the method comprises: (a) obtaining a mixture of fetal and maternal genomic DNA from said maternal tissue sample; (b) selectively enriching the mixture of fetal and maternal DNA at a plurality of polymorphic alleles; (c) distributing selectively enriched fragments from the mixture of fetal and maternal genomic DNA of step a to provide reaction samples comprising a single genomic DNA molecule or amplification products of a single genomic DNA molecule; (d) conducting massively parallel DNA sequencing of the selectively enriched fragments of genomic DNA in the reaction samples of step c) to determine the sequence of said selectively enriched fragments; (e) identifying the chromosomes to which the sequences obtained in step d) belong; (f) analyzing the data of step d) to determine i) the number of fragments of genomic DNA from step d) that belong to at least one first target chromosome that is presumed to be diploid in both the mother and the fetus, and ii) the number of fragments of genomic DNA from step d) that belong to a second target chromosome, wherein said second chromosome is suspected to be aneuploid in the fetus; (g) calculating an expected distribution of the number of fragments of genomic DNA from step d) for the second target chromosome if the second target chromosome is euploid, using the number determined in step f) part i); (h) calculating an expected distribution of the number of fragments of genomic DNA from step d) for the second target chromosome if the second target chromosome is aneuploid, using the first number is step f) part i) and an estimated fraction of fetal DNA found in the mixture of step b); and (i)

using a maximum likelihood or maximum a posteriori approach to determine whether the number of fragments of genomic DNA determined in step f) part ii) is more likely to be part of the distribution calculated in step g) or the distribution calculated in step h); thereby indicating the presence or absence of a fetal aneuploidy.

Exemplary Cancer Diagnostic Methods

Note that it has been demonstrated that DNA that originated from cancer that is living in a host can be found in the blood of the host. In the same way that genetic diagnoses can be made from the measurement of mixed DNA found in maternal blood, genetic diagnoses can equally well be made from the measurement of mixed DNA found in host blood. The genetic diagnoses may include aneuploidy states, or gene mutations. Any claim in the instant disclosure that reads on determining the ploidy state or genetic state of a fetus from the measurements made on maternal blood can equally well read on determining the ploidy state or genetic state of a cancer from the measurements on host blood.

In some embodiments, a method of the present disclosure allows one to determine the ploidy status of a cancer, the method including obtaining a mixed sample that contains genetic material from the host, and genetic material from the cancer; measuring the DNA in the mixed sample; calculating the fraction of DNA that is of cancer origin in the mixed sample; and determining the ploidy status of the cancer using the measurements made on the mixed sample and the calculated fraction. In some embodiments, the method may further include administering a cancer therapeutic based on the determination of the ploidy state of the cancer. In some embodiments, the method may further include administering a cancer therapeutic based on the determination of the ploidy state of the cancer, wherein the cancer therapeutic is taken from the group comprising a pharmaceutical, a biologic therapeutic, and antibody based therapy and combination thereof.

Exemplary Clinical Actions

In some embodiments, any of the methods include taking a clinical action based on a result of a method of the invention (such as the determination of the presence or absence of a polymorphism or mutation, ploidy state, or paternity). In some embodiments in which an embryo or fetus has one or more one or more polymorphisms or mutations of interest (such as a CNV) based on a result of a method of the invention, the clinical action includes performing additional testing (such as testing to confirm the presence of the polymorphism or mutation), not implanting the embryo for IVF, implanting a different embryo for IVF, terminating a pregnancy, preparing for a special needs child, or undergoing an intervention designed to decrease the severity of the phenotypic presentation of a genetic disorder. In some embodiments, the clinical action is selected from the group consisting of performing an ultrasound, amniocentesis on the fetus, amniocentesis on a subsequent fetus that inherits genetic material from the mother and/or father, chorion villus biopsy on the fetus, chorion villus biopsy on a subsequent fetus that inherits genetic material from the mother and/or father, in vitro fertilization, preimplantation genetic diagnosis on one or more embryos that inherited genetic material from the mother and/or father, karyotyping on the mother, karyotyping on the father, fetal echocardiogram (such as an echocardiogram of a fetus with trisomy 21, 18, or 13, monosomy X, or a microdeletion), and combinations thereof. In some embodiments, the clinical action is selected from the group consisting of administering growth hormone to a born child with monosomy X (such as administration starting at ~9 months), administering calcium to a born child with a 22q deletion (such as DiGeorge syndrome), administering an androgen such as testosterone to a born child with 47,XXY (such as one injection per month for 3 months of 25 mg testosterone enanthate to an infant or toddler), performing a test for cancer on a woman with a complete or partial molar pregnancy (such as a triploid fetus), administering a therapy for cancer such as a chemotherapeutic agent to a woman with a complete or partial molar pregnancy (such as a triploid fetus), screening a fetus determined to be male (such as a fetus determined to be male using a method of the invention) for one or more X-linked genetic disorders such as Duchenne muscular dystrophy (DMD), adrenoleukodystrophy, or hemophilia, performing amniocentesis on a male fetus at risk for an X-linked disorder, administering dexamethasone to a women with a female fetus at risk male (such as a fetus determined to be female using a method of the invention) for congenital adrenal hyperplasia, performing amniocentesis on a female fetus at risk for congenital adrenal hyperplasia, administering killed vaccines (instead of live vaccines) or not administering certain vaccines to a born child who is (or is suspected of being) immune deficient from a 22q11.2 deletion, performing occupational and/or physical therapy, performing early intervention in education, delivering the baby at a tertiary care center with a NICU and/or having pediatric specialists available at delivery, behavioral intervention for born child (such as a child with XXX, XXY, or XYY), and combinations thereof.

In some embodiments, ultrasound or another screening test is performed on a women determined to have multiple pregnancies (such as twins) to determine whether or not two or more of the fetus are monochorionic. Monozygotic twins result from ovulation and fertilization of a single oocyte, with subsequent division of the zygote; placentation may be dichorionic or monochorionic. Dizygotic twins occur from ovulation and fertilization of two oocytes, which usually results in dichorionic placentation. Monochorionic twins have a risk of twin-to-twin transfusion syndrome, which may cause unequal distribution of blood between fetuses that results in differences in their growth and development, sometimes resulting in stillbirth. Thus, twins determined to be monozygotic twins using a method of the invention are desirably tested (such as by ultrasound) to determine if they are monochorionic twins, and if so, these twins can be monitored (such as bi-weekly ultrasounds from 16 weeks) for signs of win-to-twin transfusion syndrome.

In some embodiments in which an embryo or fetus does not have one or more one or more polymorphisms or mutations of interest (such as a CNV) based on a result of a method of the invention, the clinical action includes implanting the embryo for IVF or continuing a pregnancy. In some embodiments, the clinical action is additional testing to confirm the absence of the polymorphism or mutation selected from the group consisting of performing an ultrasound, amniocentesis, chorion villus biopsy, and combinations thereof.

In some embodiments in which an individual has one or more polymorphisms or mutations (such as a polymorphism or mutation associated with a disease or disorder such as cancer or an increased risk for a disease or disorder such as cancer) based on a result of a method of the invention, the clinical action includes performing additional testing or administering one or more therapies for a disease or disorder (such as a therapy for cancer, a therapy for the specific type of cancer or type of mutation the individual is diagnosed with, or any of the therapies disclosed herein). In some embodiments, the clinical action is additional testing to confirm the presence or absence of a polymorphism or mutation selected from the group consisting of biopsy, surgery, medical imaging (such as a mammogram or an ultrasound), and combinations thereof.

In some embodiments, the additional testing includes performing the same or a different method (such as any of the methods described herein) to confirm the presence or absence of the polymorphism or mutation (such as a CNV), such as testing either a second fraction of the same sample that was tested or a different sample from the same individual (such as the same pregnant mother, fetus, embryo, or individual at increased risk for cancer). In some embodiments, the additional testing is performed for an individual for whom the probability of a polymorphism or mutation (such as a CNV) is above a threshold value. In some embodiments, the additional testing is performed for an individual for whom the confidence or z-score for the determination of a polymorphism or mutation (such as a CNV) is above a threshold value (such as additional testing to confirm the presence of a likely polymorphism or mutation). In some embodiments, the additional testing is performed for an individual for whom the confidence or z-score for the determination of a polymorphism or mutation (such as a CNV) is between minimum and maximum threshold values (such as additional testing to increase the confidence that the initial result is correct). In some embodiments, the additional testing is performed for an individual for whom the confidence for the determination of the presence or absence of a polymorphism or mutation (such as a CNV) is below a threshold value (such as a "no call" result due to not being able to determine the presence or absence of the CNV with sufficient confidence). An exemplary Z core is calculated in Chiu et al. BMJ 2011; 342: c7401 (which is hereby incorporated by reference in its entirety) in which chromosome 21 is used as an example and can be replaced with any other chromosome or chromosome segment in the test sample.

Z score for percentage chromosome 21 in test case =

((percentage chromosome 21 in test case) −

(mean percentage chromosome 21 in reference controls))/

(standard deviation of percentage chromosome 21 in reference controls).

In some embodiments, the additional testing is performed for an individual for whom the initial sample did not meet quality control guidelines or had a fetal fraction or a tumor fraction below a threshold value. In some embodiments, the method includes selecting an individual for additional testing based on the result of a method of the invention, the probability of the result, the confidence of the result, or the z-score; and performing the additional testing on the individual (such as on the same or a different sample). In some embodiments, a subject diagnosed with a disease or disorder (such as cancer) undergoes repeat testing using a method of the invention or known testing for the disease or disorder at multiple time points to monitor the progression of the disease or disorder or the remission or reoccurrence of the disease or disorder.

Exemplary Implementation Methods

Any of the embodiments disclosed herein may be implemented in digital electronic circuitry, integrated circuitry, specially designed ASICs (application-specific integrated circuits), computer hardware, firmware, software, or in combinations thereof. Apparatus of the presently disclosed embodiments can be implemented in a computer program product tangibly embodied in a machine-readable storage device for execution by a programmable processor; and method steps of the presently disclosed embodiments can be performed by a programmable processor executing a program of instructions to perform functions of the presently disclosed embodiments by operating on input data and generating output. The presently disclosed embodiments can be implemented advantageously in one or more computer programs that are executable and/or interpretable on a programmable system including at least one programmable processor, which may be special or general purpose, coupled to receive data and instructions from, and to transmit data and instructions to, a storage system, at least one input device, and at least one output device. Each computer program can be implemented in a high-level procedural or object-oriented programming language or in assembly or machine language if desired; and in any case, the language can be a compiled or interpreted language. A computer program may be deployed in any form, including as a stand-alone program, or as a module, component, subroutine, or other unit suitable for use in a computing environment. A computer program may be deployed to be executed or interpreted on one computer or on multiple computers at one site, or distributed across multiple sites and interconnected by a communication network.

Computer readable storage media, as used herein, refers to physical or tangible storage (as opposed to signals) and includes without limitation volatile and non-volatile, removable and non-removable media implemented in any method or technology for the tangible storage of information such as computer-readable instructions, data structures, program modules or other data. Computer readable storage media includes, but is not limited to, RAM, ROM, EPROM, EEPROM, flash memory or other solid state memory technology, CD-ROM, DVD, or other optical storage, magnetic cassettes, magnetic tape, magnetic disk storage or other magnetic storage devices, or any other physical or material medium which can be used to tangibly store the desired information or data or instructions and which can be accessed by a computer or processor.

In some embodiments, the invention features a computer configured to accomplish one or more of the in vitro methods described herein. In some embodiments, the data is analyzed by the computer system as described herein. In some embodiments, genetic data (such as sequencing or microarray data) from at least 100; 200; 500; 750; 1,000; 2,000; 5,000; 7,500; 10,000; 20,000; 25,000; 30,000; 40,000; 50,000; 75,000; or 100,000 different loci is analyzed by the computer is less than 200, 100, 60, 30, 20, 10, 5, or 1 minute, or in less than 30 or 10 seconds to detect the present or absence of a mutation (such as a CNV or SNV) at the loci.

Any of the methods described herein may include the output of data in a physical format, such as on a computer screen, or on a paper printout. In explanations of any embodiments elsewhere in this document, it should be understood that the described methods may be combined with the output of the actionable data in a format that can be acted upon by a physician. In addition, the described methods may be combined with the actual execution of a clinical decision that results in a clinical treatment, or the execution of a clinical decision to make no action. Some of the embodiments described in the document for determining genetic data pertaining to a target individual may be combined with the decision to select one or more embryos for transfer in the context of IVF, optionally combined with the process of transferring the embryo to the womb of the prospective mother. Some of the embodiments described in the document for determining genetic data pertaining to a target individual may be combined with the notification of a potential chromosomal abnormality, or lack thereof, with a medical professional, optionally combined with the decision to abort, or to not abort, a fetus in the context of prenatal diagnosis. Some of the embodiments described herein may be combined with the output of the actionable data, and the execution of a clinical decision that results in a clinical treatment, or the execution of a clinical decision to make no action.

Exemplary Diagnostic Boxes

In an embodiment, the present disclosure comprises a diagnostic box that is capable of partly or completely carrying out any of the methods described in this disclosure. In an embodiment, the diagnostic box may be located at a physician's office, a hospital laboratory, or any suitable location reasonably proximal to the point of patient care. The box may be able to run the entire method in a wholly automated fashion, or the box may require one or a number of steps to be completed manually by a technician. In an embodiment, the box may be able to analyze at least the genotypic data measured on the maternal plasma. In an embodiment, the box may be linked to means to transmit the genotypic data measured on the diagnostic box to an external computation facility which may then analyze the genotypic data, and possibly also generate a report. The diagnostic box may include a robotic unit that is capable of transferring aqueous or liquid samples from one container to another. It may comprise a number of reagents, both solid and liquid. It may comprise a high throughput sequencer. It may comprise a computer.

Experimental Section

The presently disclosed embodiments are described in the following Examples, which are set forth to aid in the understanding of the disclosure, and should not be construed to limit in any way the scope of the disclosure as defined in the claims which follow thereafter. The following examples are put forth so as to provide those of ordinary skill in the art with a complete disclosure and description of how to use the described embodiments, and are not intended to limit the scope of the disclosure nor are they intended to represent that the Examples below are all or the only experiments performed. Efforts have been made to ensure accuracy with respect to numbers used (e.g. amounts, temperature, etc.) but some experimental errors and deviations should be accounted for. Unless indicated otherwise, parts are parts by volume, and temperature is in degrees Centigrade. It should be understood that variations in the methods as described may be made without changing the fundamental aspects that the Examples are meant to illustrate.

Example 1

The objective was to show that a Bayesian maximum likelihood estimation (MLE) algorithm that uses parent genotypes to calculate fetal fraction improves accuracy of non-invasive prenatal trisomy diagnosis compared to published methods.

Figure 14:
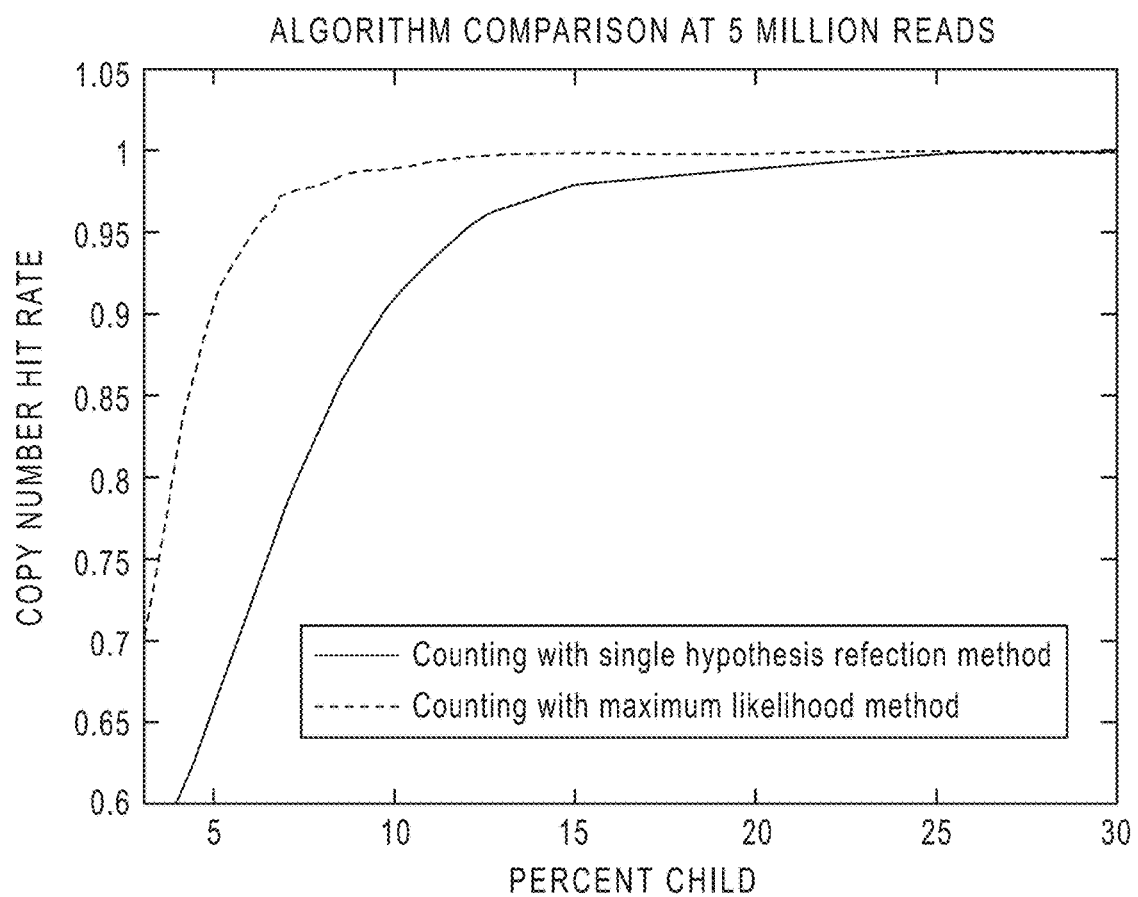
FIG. 14: Simulated ploidy call accuracies for counting method with two different analysis techniques.

Simulated sequencing data for maternal cfDNA was created by sampling reads obtained on trisomy-21 and respective mother cell lines. The rate of correct disomy and trisomy calls were determined from 500 simulations at various fetal fractions for a published method (Chiu et al. BMJ 2011; 342: c7401) and our MLE-based algorithm. We validated the simulations by obtaining 5 million shotgun reads from four pregnant mothers and respective fathers collected under an IRB-approved protocol. Parental genotypes were obtained on a 290K SNP array. (See FIG. 14)

In simulations, the MLE-based approach achieved 99.0% accuracy for fetal fractions as low as 9% and reported confidences that corresponded well to overall accuracy. We validated these results using four real samples wherein we obtained all correct calls with a computed confidence exceeding 99%. In contrast, our implementation of the published algorithm for Chiu et al. required 18% fetal fraction to achieve 99.0% accuracy, and achieved only 87.8% accuracy at 9% fetal DNA.

Fetal fraction determination from parental genotypes in conjunction with a MLE-based approach achieves greater accuracy than published algorithms at the fetal fractions expected during the 1st and early 2nd trimester. Furthermore, the method disclosed herein produces a confidence metric that is crucial in determining the reliability of the result, especially at low fetal fractions where ploidy detection is more difficult. Published methods use a less accurate threshold method for calling ploidy based on large sets of disomy training data, an approach that predefines a false positive rate. In addition, without a confidence metric, published methods are at risk of reporting false negative results when there is insufficient fetal cfDNA to make a call. In some embodiments, a confidence estimate is calculated for the called ploidy state.

Example 2

The objective was to improve non-invasive detection of fetal trisomy 18, 21, and X particularly in samples consisting of low fetal fraction by using a targeted sequencing approach combined with parent genotypes and Hapmap data in a Bayesian Maximum Likelihood Estimation (MLE) algorithm.

Maternal samples from four euploid and two trisomy-positive pregnancies and respective paternal samples were obtained under an IRB-approved protocol from patients where fetal karyotype was known. Maternal cfDNA was extracted from plasma and roughly 10 million sequence reads were obtained following preferential enrichment that targeted specific SNPs. Parent samples were similarly sequenced to obtain genotypes.

The described algorithm correctly called chromosome 18 and 21 disomy for all euploid samples and normal chromosomes of aneuploid samples. Trisomy 18 and 21 calls were correct, as were chromosome X copy numbers in male and female fetuses. The confidence produced by the algorithm was in excess of 98% in all cases.

The method described accurately reported the ploidy of all tested chromosomes from six samples, including samples comprised of less than 12% fetal DNA, which account for roughly 30% of $1^{st}$ and early $2^{nd}$-trimester samples. The crucial difference between the instant MLE algorithm and published methods is that it leverages parent genotypes and Hapmap data to improve accuracy and generate a confidence metric. At low fetal fractions, all methods become less accurate; it is important to correctly identify samples without sufficient fetal cfDNA to make a reliable call. Others have used chromosome Y specific probes to estimate fetal fraction of male fetuses, but concurrent parental genotyping enables estimation of fetal fraction for both sexes. Another inherent limitation of published methods using untargeted shotgun sequencing is that accuracy of ploidy calling varies among chromosomes due to differences in factors such as GC richness. The instant targeted sequencing approach is largely independent of such chromosome-scale variations and yields more consistent performance between chromosomes.

Example 3

The objective was to determine if trisomy is detectable with high confidence on a triploid fetus, using novel informatics to analyze SNP loci of free floating fetal DNA in maternal plasma.

20 mL of blood was drawn from a pregnant patient following abnormal ultrasound. After centrifugation, maternal DNA was extracted from the buffy coat (DNEASY, QIAGEN); cell-free DNA was extracted from plasma (QIAAMP QIAGEN). Targeted sequencing was applied to SNP loci on chromosomes 2, 21, and X in both DNA samples. Maximum-Likelihood Bayesian estimation selected the most likely hypothesis from the set of all possible ploidy states. The method determines fetal DNA fraction, ploidy state and explicit confidences in the ploidy determination. No assumptions are made about the ploidy of a reference chromosome. The diagnostic uses a test statistic that is independent of sequence read counts, which is the recent state of the art.

The instant method accurately diagnosed trisomy of chromosomes 2 and 21. Child fraction was estimated at 11.9% [CI 11.7-12.1]. The fetus was found to have one maternal and two paternal copies of chromosomes 2 and 21 with confidence of effectively 1 (error probability $<10^{-30}$). This was achieved with 92,600 and 258,100 reads on chromosomes 2 and 21 respectively.

This is the first demonstration of non-invasive prenatal diagnosis of trisomic chromosomes from maternal blood where the fetus was triploid, as confirmed by metaphase karyotype. Extant methods of non-invasive diagnosis would not detect aneuploidy in this sample. Current methods rely on a surplus of sequence reads on a trisomic chromosome relative to disomic reference chromosomes; but a triploid fetus has no disomic reference. Furthermore, extant methods would not achieve similarly high-confidence ploidy determination with this fraction of fetal DNA and number of sequence reads. It is straightforward to extend the approach to all 24 chromosomes.

Example 4

Figure 15:
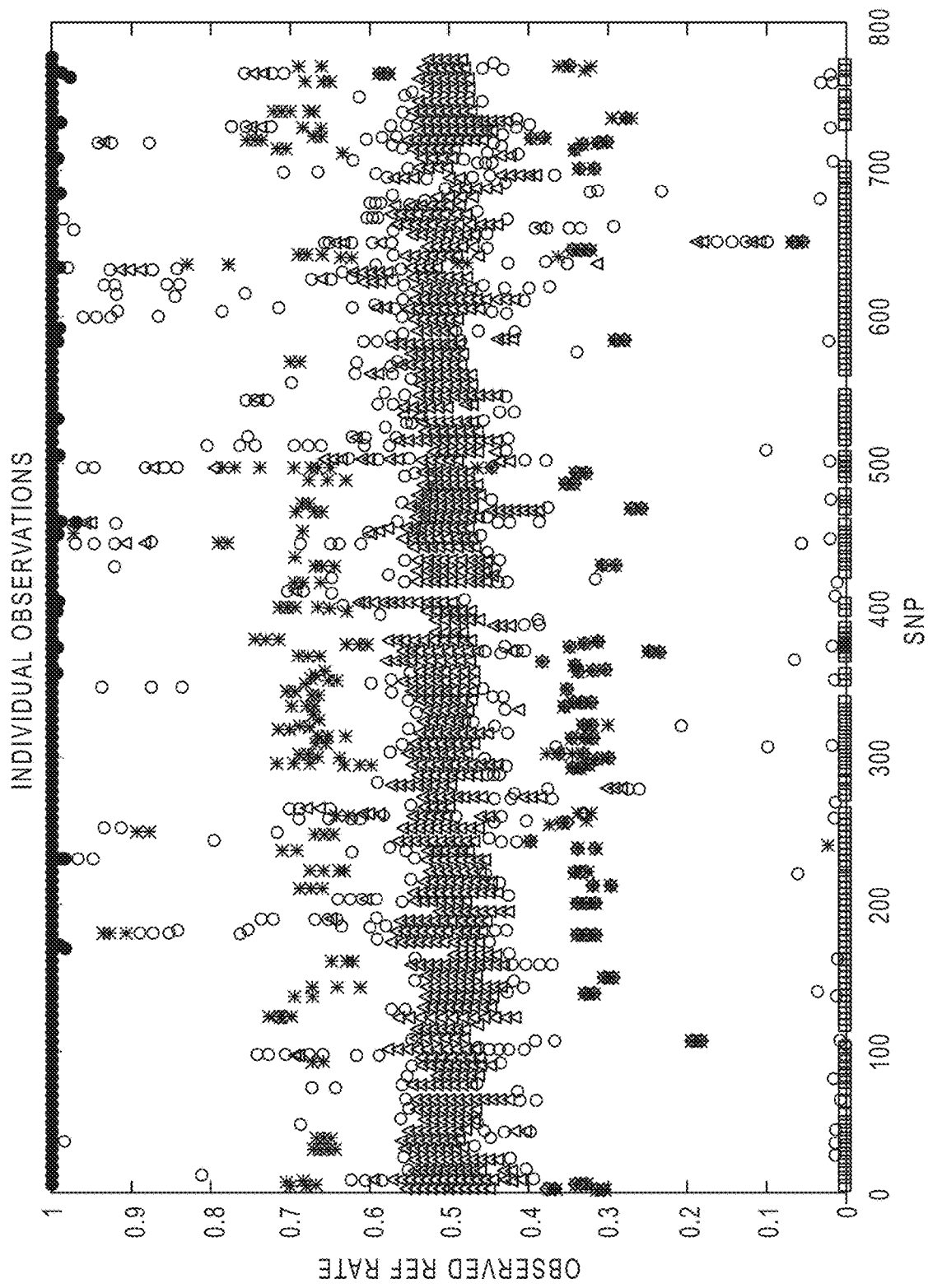
FIG. 15: Ratio of two alleles for a plurality of SNPs in a cell line in Example 4.
Figure 16:
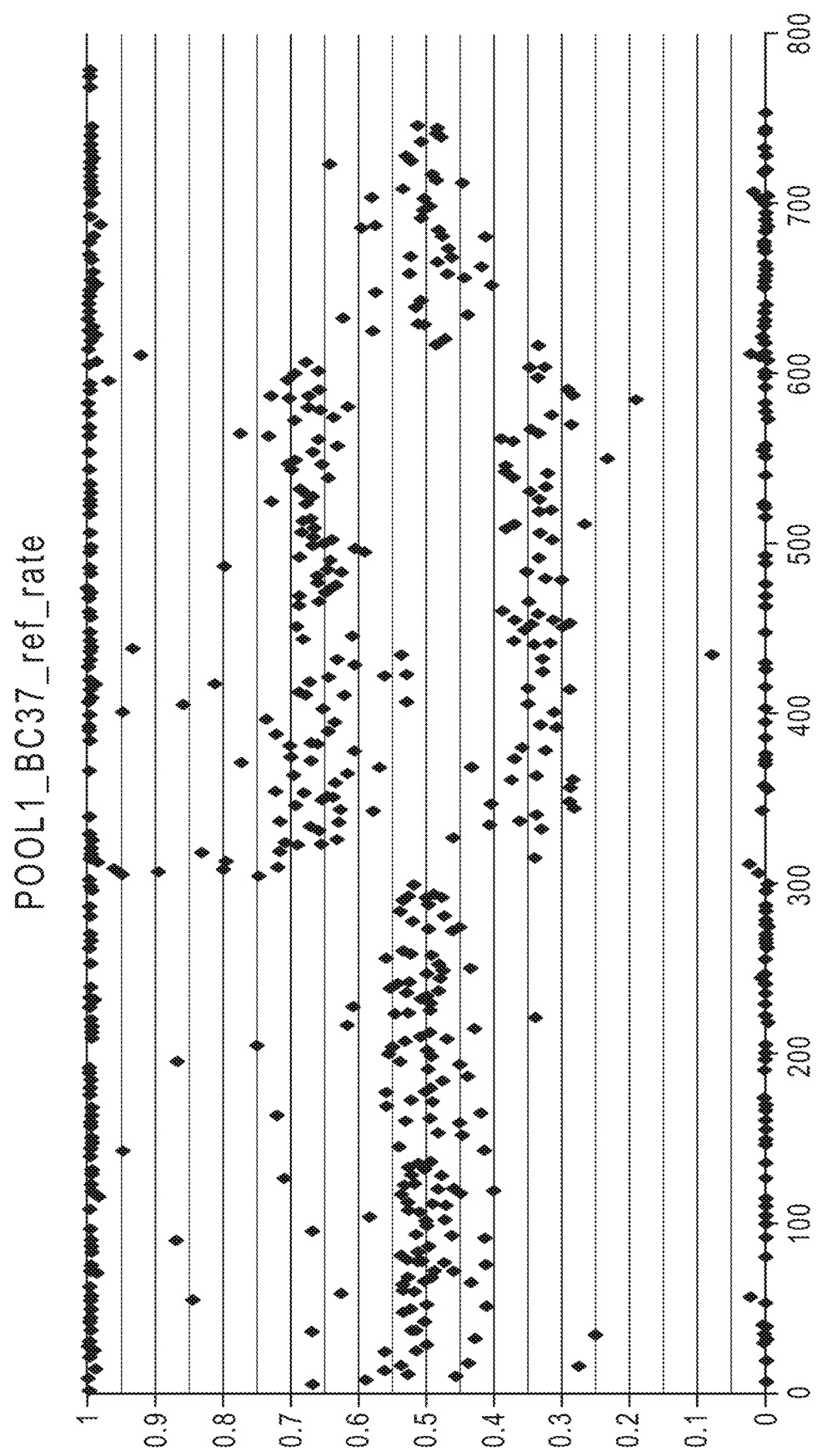
FIG. 16: Ratio of two alleles for a plurality of SNPs in a cell line in Example 4 sorted by chromosome.
Figure 17A:
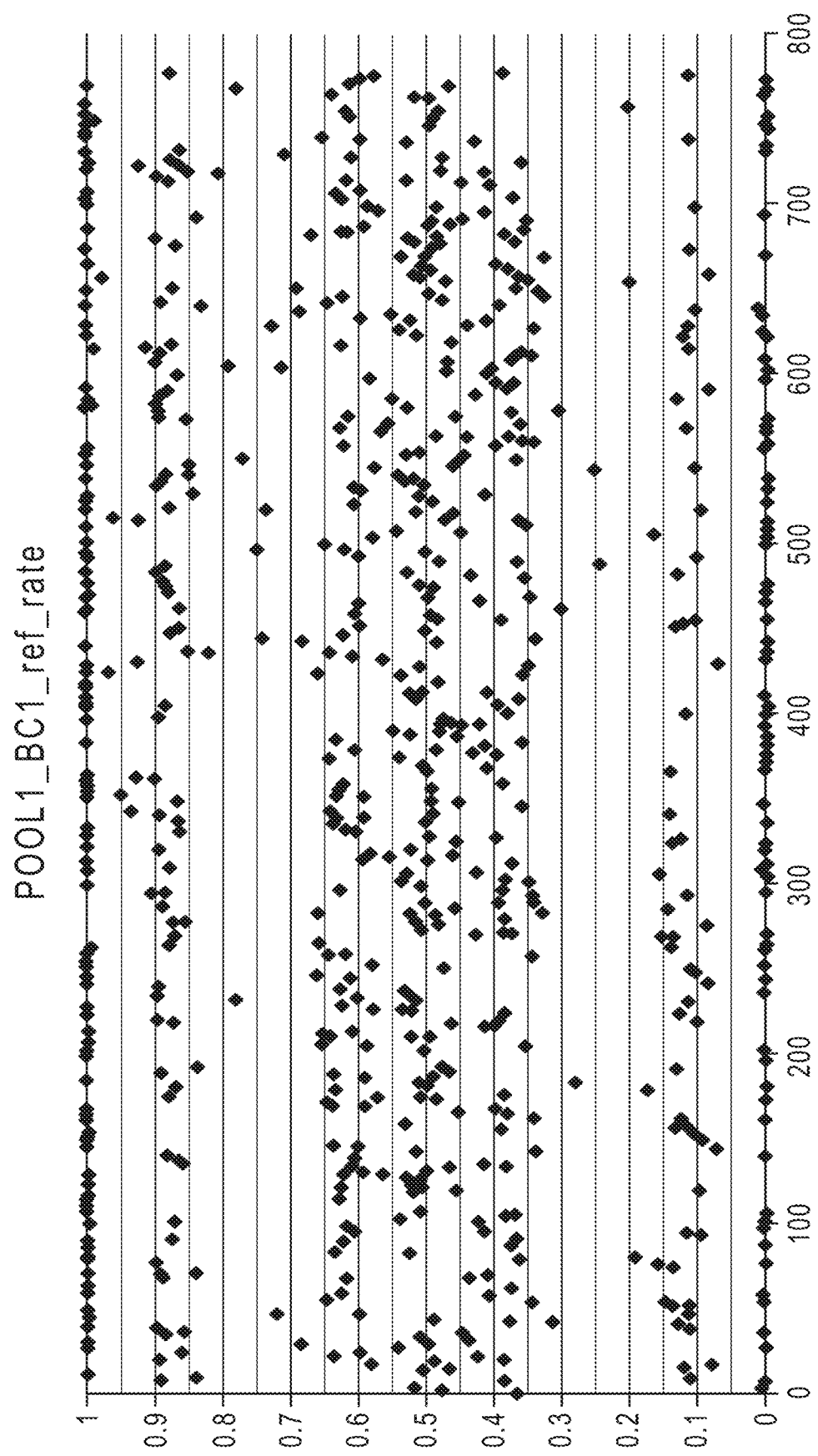
FIGS. 17A-17D: Ratio of two alleles for a plurality of SNPs in four pregnant women plasma samples, sorted by chromosome.
Figure 17B:
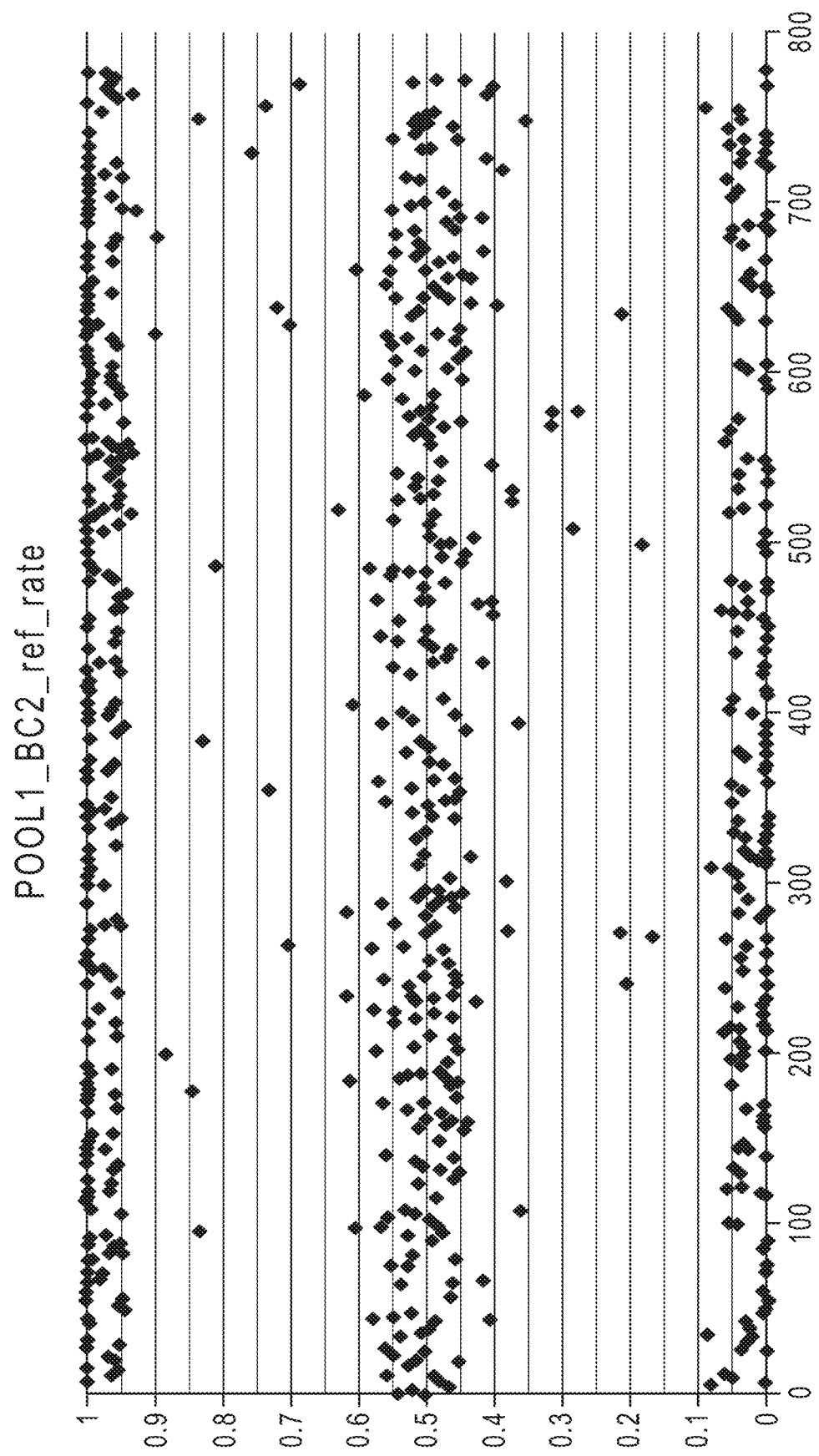
Figure 17C:
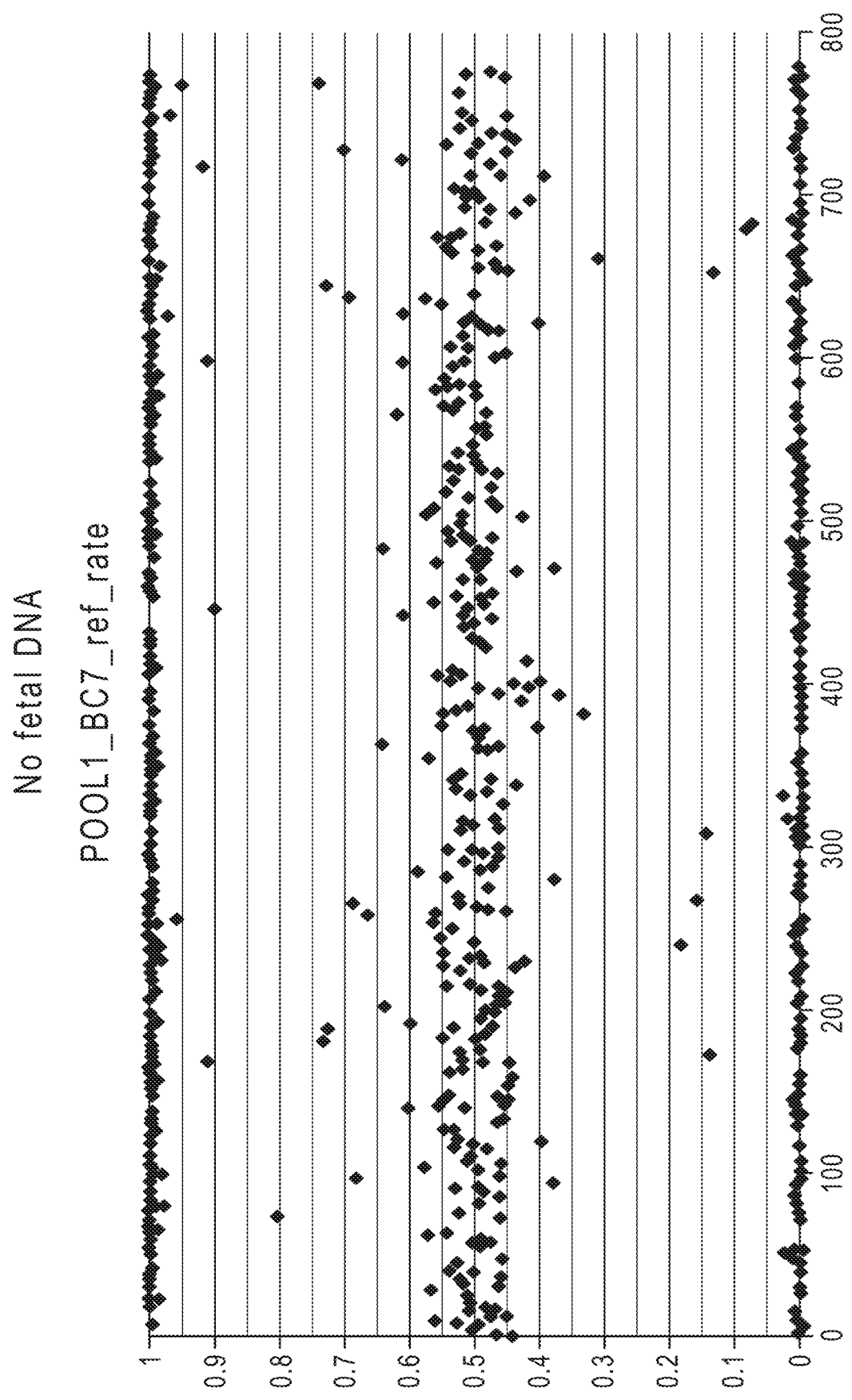
Figure 17D:
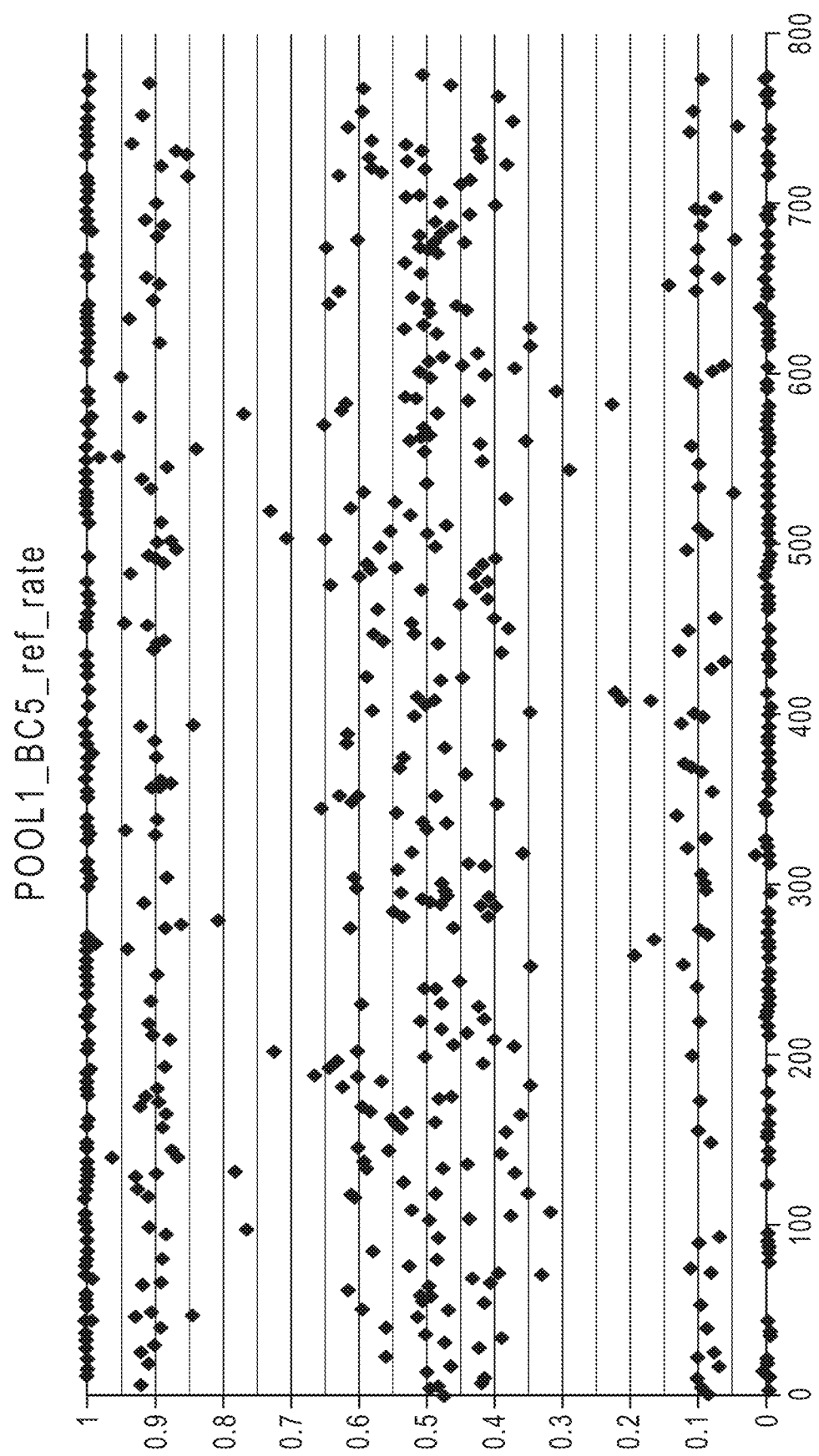

The following protocol was used for 800-plex amplification of DNA isolated from maternal plasma from a euploid pregnancy and also genomic DNA from a triploidy 21 cell line using standard PCR (meaning no nesting was used). Library preparation and amplification involved single tube blunt ending followed by A-tailing. Adaptor ligation was run using the ligation kit found in the AGILENT SURESELECT kit, and PCR was run for 7 cycles. Then, 15 cycles of STA (95° C. for 30 s; 72° C. for 1 min; 60° C. for 4 min; 65° C. for 1 min; 72° C. for 30 s) using 800 different primer pairs targeting SNPs on chromosomes 2, 21 and X. The reaction was run with 12.5 nM primer concentration. The DNA was then sequenced with an ILLUMINA IIGAX sequencer. The sequencer output 1.9 million reads, of which 92% mapped to the genome; of those reads that mapped to the genome, more than 99% mapped to one of the regions targeted by the targeted primers. The numbers were essentially the same for both the plasma DNA and the genomic DNA. FIG. 15 shows the ratio of the two alleles for the ~780 SNPs that were detected by the sequencer in the genomic DNA that was taken from a cell line with known trisomy at chromosome 21. Note that the allele ratios are plotted here for ease of visualization, because the allele distributions are not straightforward to read visually. The circles represent SNPs on disomic chromosomes, while the stars represent SNPs on a trisomic chromosome. FIG. 16 is another representation of the same data as in FIG. 15, where the Y-axis is the relative number of A and B measured for each SNP, and where the X-axis is the SNP number where the SNPs are separated by chromosome. In FIG. 16, SNP 1 to 312 are found on chromosome 2, from SNP 313 to 605 are found on chromosome 21 which is trisomic, and from SNP 606 to 800 are on chromosome X. The data from chromosomes 2 and X show a disomic chromosome, as the relative sequence counts lie in three clusters: AA at the top of the graph, BB at the bottom of the graph, and AB in the middle of the graph. The data from chromosome 21, which is trisomic, shows four clusters: AAA at the top of the graph, AAB around the 0.65 line (⅔), ABB around the 0.35 line (⅓), and BBB at the bottom of the graph.

FIGS. 17A-D show data for the same 800-plex protocol, but measured on DNA that was amplified from four plasma samples from pregnant women. For these four samples, we expect to see seven clusters of dots: (1) along the top of the graph are those loci where both the mother and the fetus are AA, (2) slightly below the top of the graph are those loci where the mother is AA and the fetus is AB, (3) slightly above the 0.5 line are those loci where the mother is AB and the fetus is AA, (4) along the 0.5 line are those loci where the mother and the fetus are both AB, (5) slightly below the 0.5 line are those loci where the mother is AB and the fetus is BB, (6) slightly above the bottom of the graph are those loci where the mother is BB and the fetus is AB, (1) along the bottom of the graph are those loci where both the mother and the fetus are BB. The smaller the fetal fraction, the less the separation between clusters (1) and (2), between clusters (3), (4) and (5), and between clusters (6) and (7). The separation is expected to be half of the fraction of DNA that is of fetal origin. For example if the DNA is 20% fetal, and 80% maternal, we expect (1) through (7) to be centered at 1.0, 0.9, 0.6, 0.5, 0.4, 0.1 and 0.0 respectively; see for example FIG. 17D, POOL1_BC5_ref_rate. If, instead the DNA is 8% fetal, and 92% maternal, we expect (1) through (7) to be centered at 1.00, 0.96, 0.54, 0.50, 0.46, 0.04 and 0.00 respectively; see for example FIG. 17B, POOL1_BC2_ref_rate. If there is not fetal DNA detected, we do not expect to see (2), (3), (5), or (6); alternately we could say that the separation is zero, and therefore (1) and (2) are on top of each other, as are (3), (4) and (5), and also (6) and (7); see e.g. FIG. 17C, POOL1_BC7_ref_rate. Note that the fetal fraction for FIG. 17A, POOL1_BC1_ref_rate is about 25%.

Example 5

Figure 18:
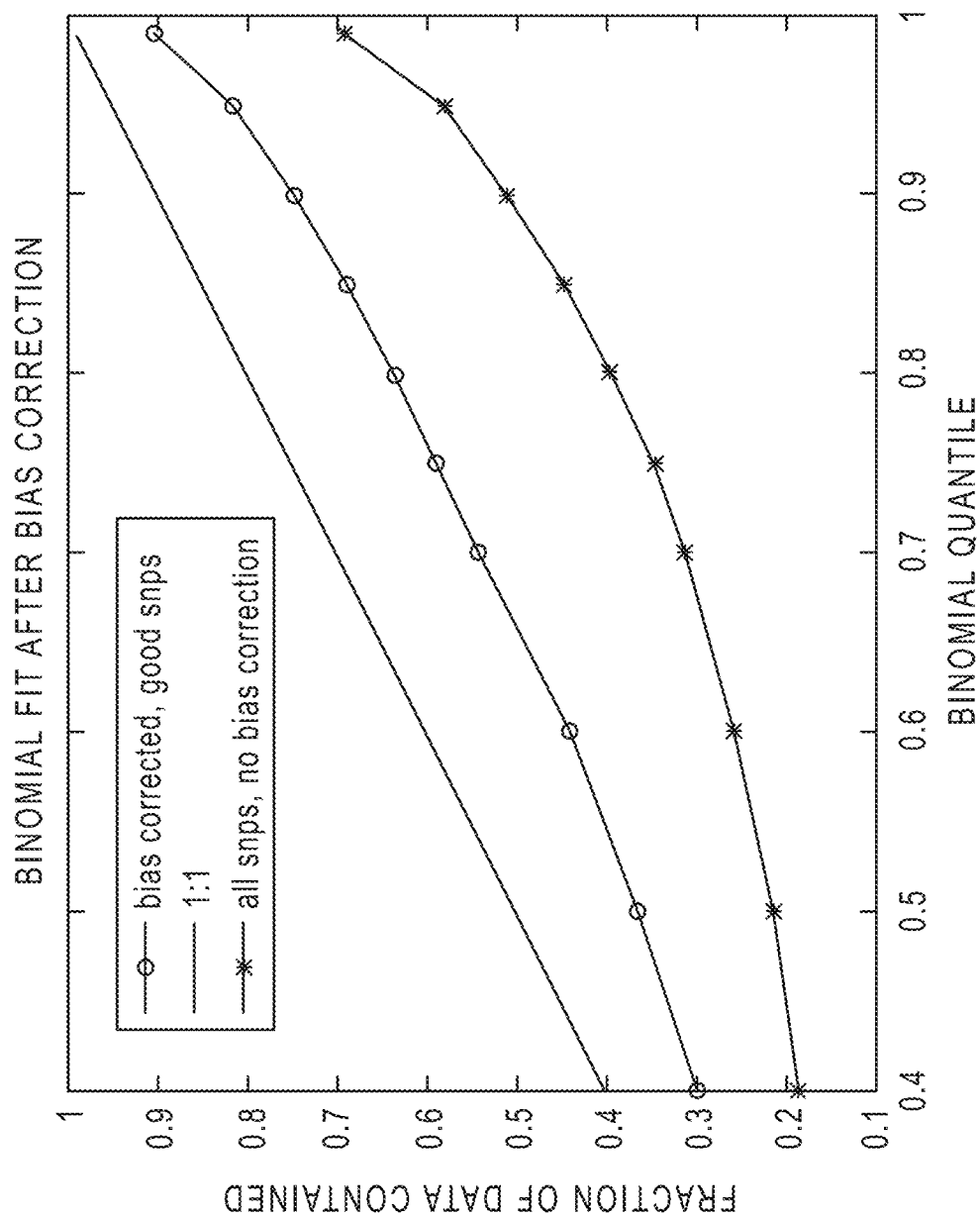
FIG. 18: Fraction of data that can be explained by binomial variance before and after data correction.

Most methods of DNA amplification and measurement will produce some allele bias, wherein the two alleles that are typically found at a locus are detected with intensities or counts that are not representative of the actual amounts of alleles in the sample of DNA. For example, for a single individual, at a heterozygous locus we expect to see a 1:1 ratio of the two alleles, which is the theoretical ratio expected for a heterozygous locus; however due to allele bias, we may see 55:45, or even 60:40. Also note that in the context of sequencing, if the depth of read is low, then simple stochastic noise could result in significant allele bias. In an embodiment, it is possible to model the behavior of each SNP such that if a consistent bias is observed for particular alleles, this bias can be corrected for. FIG. 18 shows the fraction of data that can be explained by binomial variance, before and after bias correction. In FIG. 18, the stars represent the observed allele bias on raw sequence data for the 800-plex experiment; the circles represent the allele bias after correction. Note that if there were no allele bias at all, we would expect the data to fall along the x=y line. A similar set of data that was produced by amplifying DNA using a 150-plex targeted amplification produced data that fell very closely on the 1:1 line after bias correction.

Example 6

Figure 19:
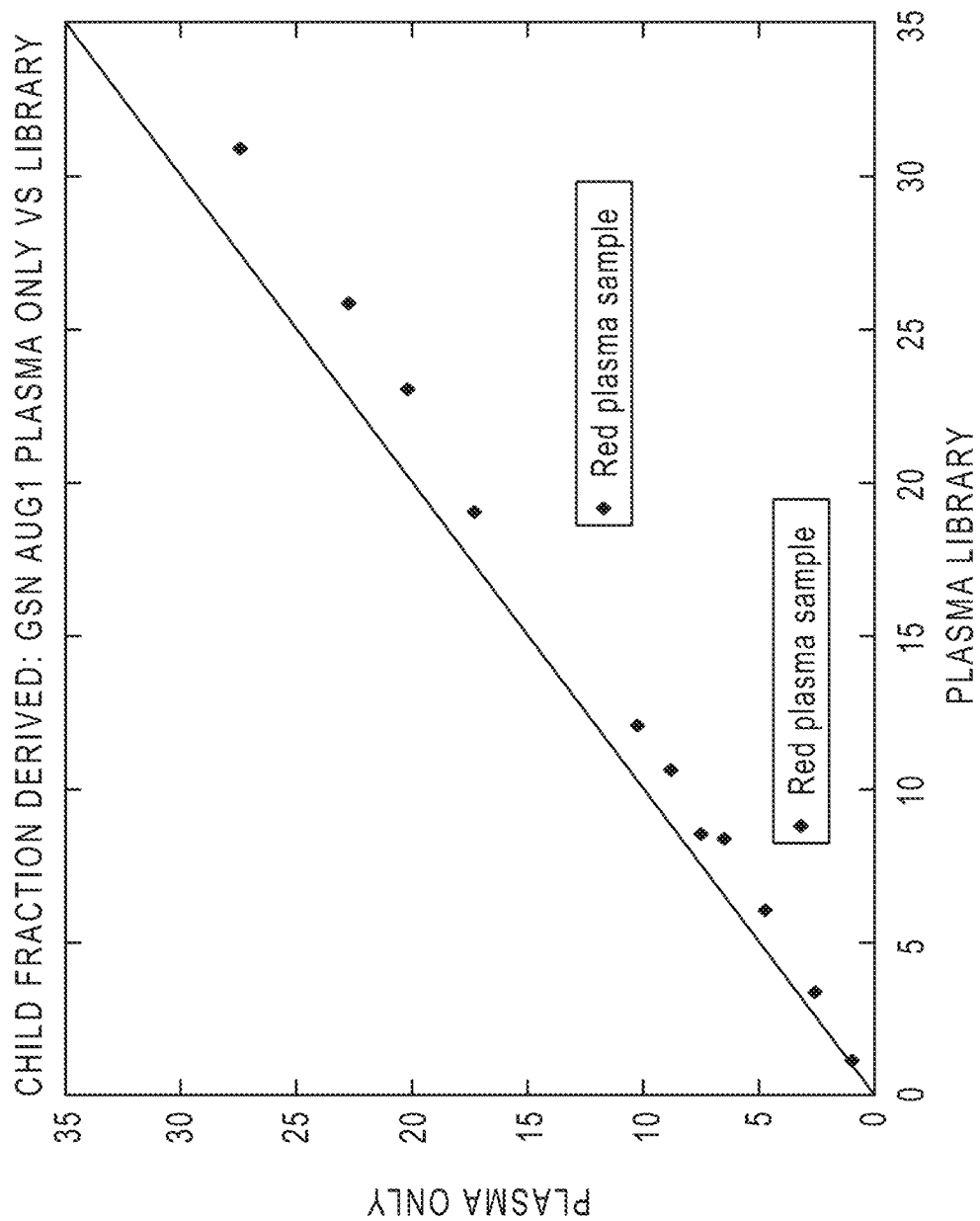
FIG. 19: Graph showing relative enrichment of fetal DNA in samples following a short library preparation protocol.

Universal amplification of DNA using ligated adaptors with primers specific to the adaptor tags, where the primer annealing and extension times are limited to a few minutes has the effect of enriching the proportion of shorter DNA strands. Most library protocols designed for creating DNA libraries suitable for sequencing contain such a step, and example protocols are published and well known to those in the art. In some embodiments of the invention, adaptors with a universal tag are ligated to the plasma DNA, and amplified using primers specific to the adaptor tag. In some embodiments, the universal tag can be the same tag as used for sequencing, it can be a universal tag only for PCR amplification, or it can be a set of tags. Since the fetal DNA is typically short in nature, while the maternal DNA can be both short and long in nature, this method has the effect of enriching the proportion of fetal DNA in the mixture. The free floating DNA, thought to be DNA from apoptotic cells, and which contains both fetal and maternal DNA, is short-mostly under 200 bp. Cellular DNA released by cell lysis, a common phenomenon after phlebotomy, is typically almost exclusively maternal, and is also quite long-mostly above 500 bp. Therefore, blood samples that have sat around for more than a few minutes will contain a mixture of short (fetal+maternal) and longer (maternal) DNA. Performing a universal amplification with relatively short extension times on maternal plasma followed by targeted amplification will tend to increase the relative proportion of fetal DNA when compared to the plasma that has been amplified using targeted amplification alone. This can be seen in FIG. 19 which shows the measured fetal percent when the input is plasma DNA (vertical axis) vs. the measured fetal percent when the input DNA is plasma DNA that has had a library prepared using the ILLUMINA GAIIx library preparation protocol. All the dots fall below the line, indicating that the library preparation step enriches the fraction of DNA that is of fetal origin. Two samples of plasma that were red, indicating hemolysis and therefore that there would be an increased amount of long maternal DNA present from cell lysis, show a particularly significant enrichment of fetal fraction when the library preparation is performed prior to targeted amplification. The method disclosed herein is particularly useful in cases where there is hemolysis or some other situation has occurred where cells comprising relatively long strands of contaminating DNA have lysed, contaminating the mixed sample of short DNA with the long DNA. Typically the relatively short annealing and extension times are between 30 seconds and 2 minutes, though they could be as short as 5 or 10 seconds or less, or as long as 5 or 10 minutes.

Example 7

The following protocol was used for 1,200-plex amplification of DNA isolated from maternal plasma from a euploid pregnancy and also genomic DNA from a triploidy 21 cell line using a direct PCR protocol, and also a semi-nested approach. Library preparation and amplification involved single tube blunt ending followed by A-tailing. Adaptor ligation was run using a modification of the ligation kit found in the AGILENT SURESELECT kit, and PCR was run for 7 cycles. In the targeted primer pool, there were 550 assays for SNPs from chromosome 21, and 325 assays for SNPs from each of chromosomes 1 and X. Both protocols involved 15 cycles of STA (95° C. for 30 s; 72° C. for 1 min; 60° C. for 4 min; 65° C. for 30 s; 72° C. for 30 s) using 16 nM primer concentration. The semi-nested PCR protocol involved a second amplification of 15 cycles of STA (95° C. for 30 s; 72° C. for 1 min; 60° C. for 4 min; 65° C. for 30 s; 72° C. for 30 s) using an inner forward tag concentration of 29 nM, and a reverse tag concentration of 1 uM or 0.1 uM. The DNA was then sequenced with an ILLUMINA IIGAX sequencer. For the direct PCR protocol, 73% of the reads map to the genome; for the semi-nested protocol, 97.2% of the sequence reads map to the genome. Therefore, the semi-nested protocol result in approximately 30% more information, presumably mostly due to the elimination of primers that are most likely to cause primer dimers.

Figure 20:
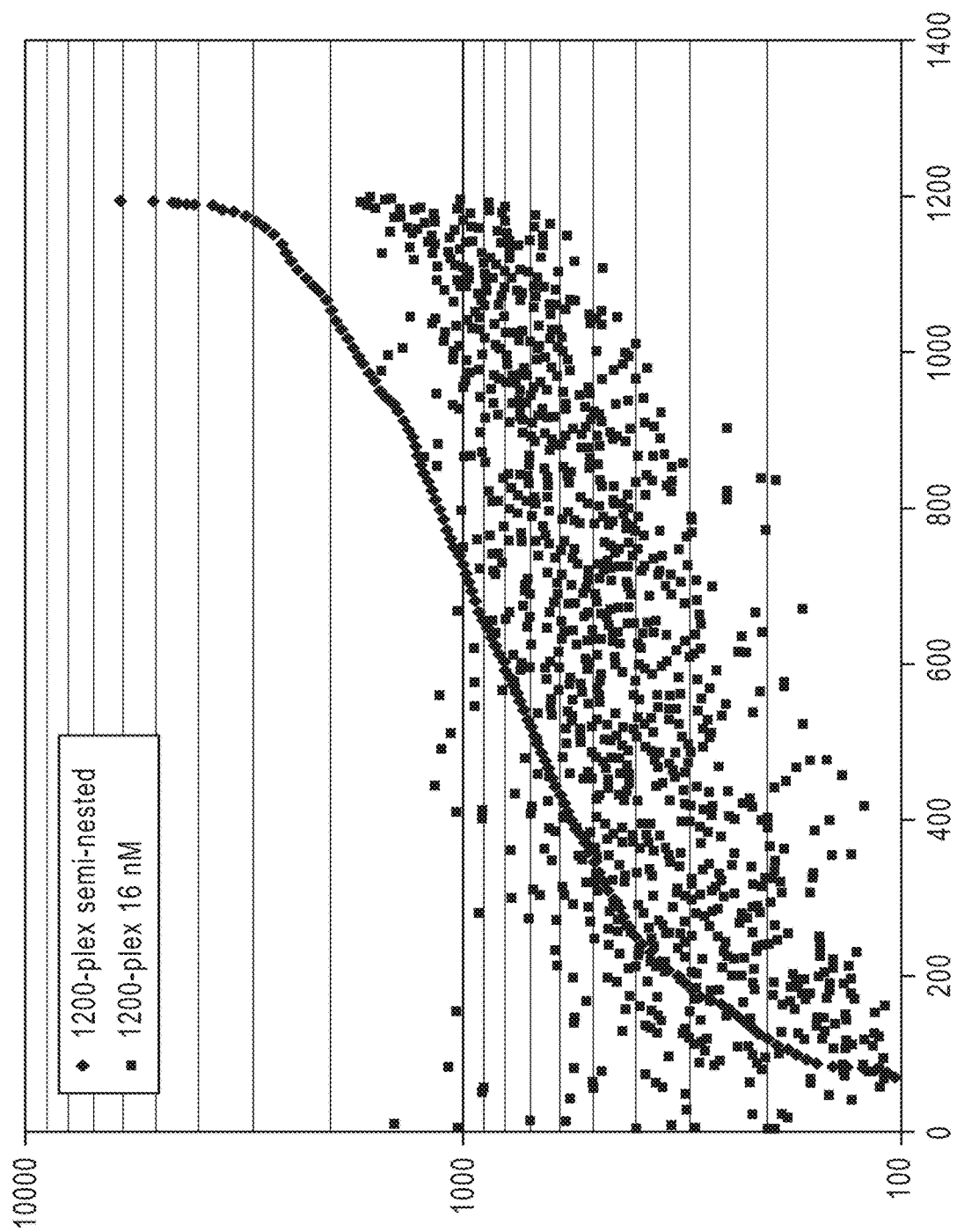
FIG. 20: Depth of read graph comparing direct PCR and semi-nested methods.

The depth of read variability tends to be higher when using the semi-nested protocol than when the direct PCR protocol is used (see FIG. 20) where the diamonds refer to the depth of read for loci run with the semi-nested protocol, and the squares refer to the depth of read for loci run with no nesting. The SNPs are arranged by depth of read for the diamonds, so the diamonds all fall on a curved line, while the squares appear to be loosely correlated; the arrangements of the SNPs is arbitrary, and it is the height of the dot that denotes depth of read rather than its location left to right.

Figure 21:
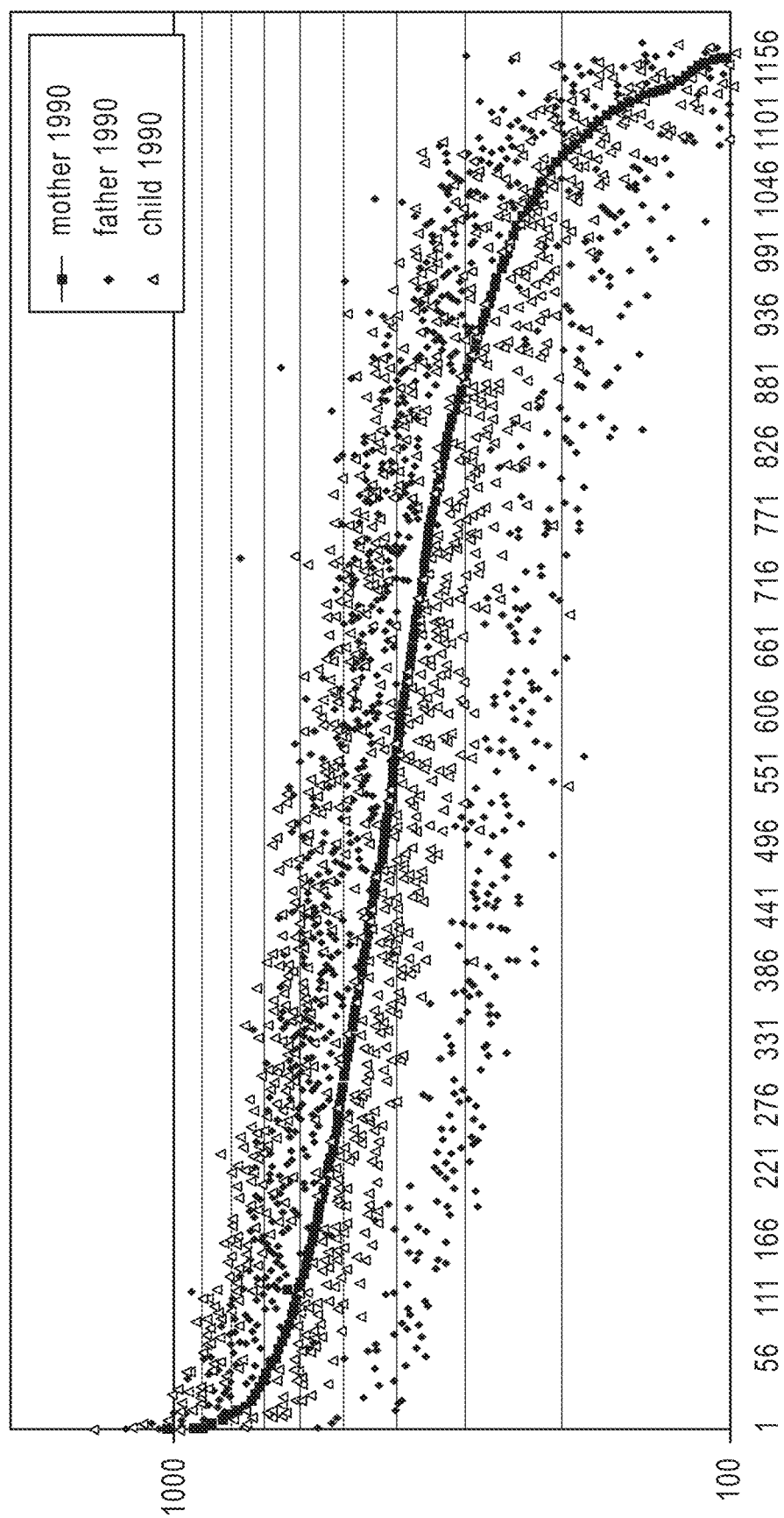
FIG. 21: Comparison of depth of read for direct PCR of three genomic samples.
Figure 22:
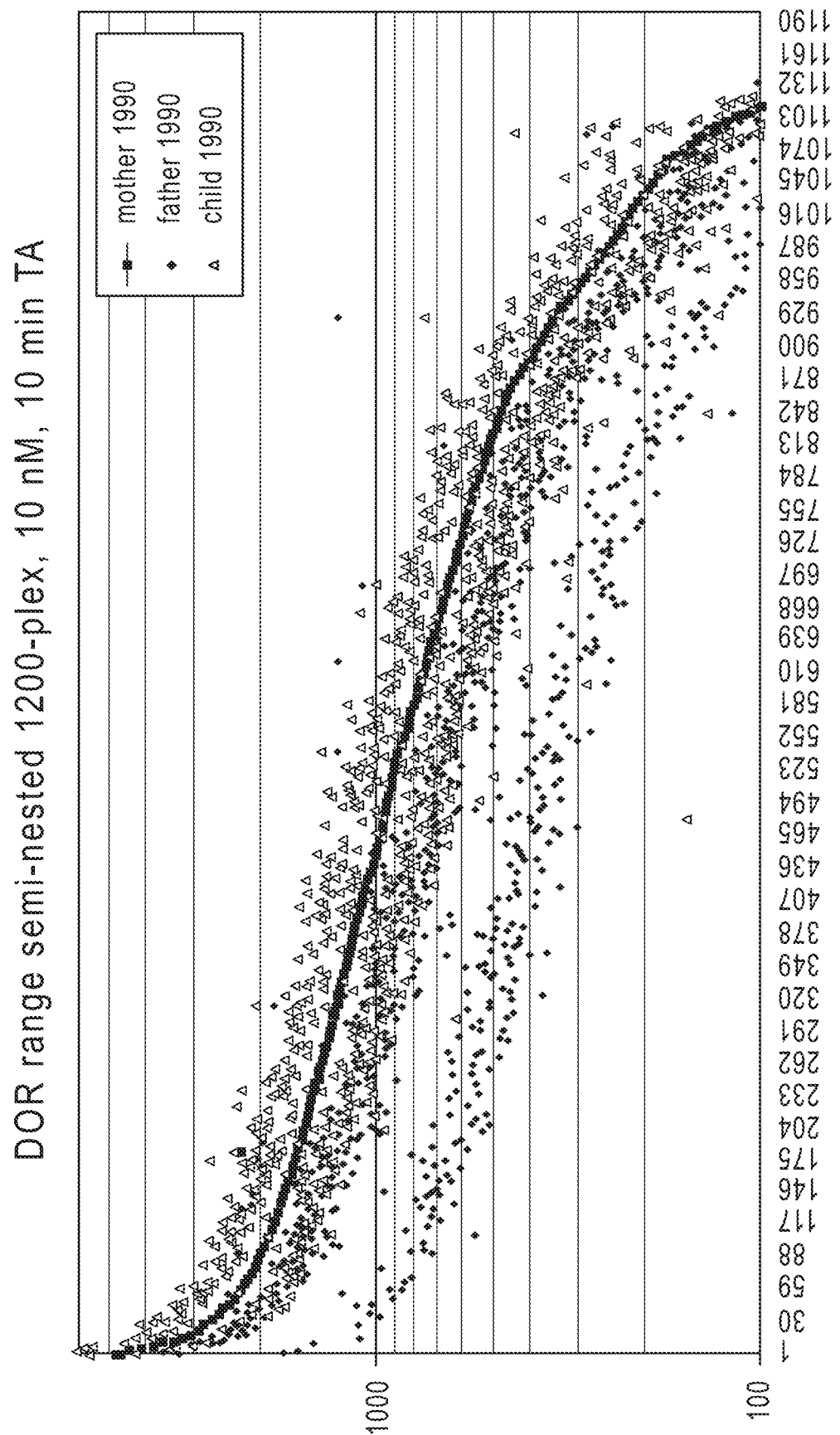
FIG. 22: Comparison of depth of read for semi-nested mini-PCR of three samples.

In some embodiments, the methods described herein can achieve excellent depth of read (DOR) variances. For example, in one version of this Example (FIG. 21) using a 1,200-plex direct PCR amplification of genomic DNA, of the 1,200 assays: 1186 assays had a DOR greater than 10; the average depth of read was 400; 1063 assays (88.6%) had a depth of read of between 200 and 800, and ideal window where the number of reads for each allele is high enough to give meaningful data, while the number of reads for each allele is not so high that the marginal use of those reads was particularly small. Only 12 alleles had higher depth of read with the highest at 1035 reads. The standard deviation of the DOR was 290, the average DOR was 453, the coefficient of variance of the DOR was 64%, there were 950,000 total reads, and 63.1% of the reads mapped to the genome. In another experiment (FIG. 22) using a 1,200-plex semi-nested protocol, the DOR was higher. The standard deviation of the DOR was 583, the average DOR was 630, the coefficient of variance of the DOR was 93%, there were 870,000 total reads, and 96.3% of the reads mapped to the genome. Note, in both these cases, the SNPs are arranged by the depth of read for the mother, so the curved line represents the maternal depth of read. The differentiation between child and father is not significant; it is only the trend that is significant for the purpose of this explanation.

Example 8

In an experiment, the semi-nested 1,200-plex PCR protocol was used to amplify DNA from one cell and from three cells. This experiment is relevant to prenatal aneuploidy testing using fetal cells isolated from maternal blood, or for preimplantation genetic diagnosis using biopsied blastomeres or trophectoderm samples. There were 3 replicates of 1 and 3 cells from 2 individuals (46 XY and 47 XX+21) per condition. Assays targeted chromosomes 1, 21 and X. Three different lysis methods were used: ARCTURUS, MPERv2 and Alkaline lysis. Sequencing was run multiplexing 48 samples in one sequencing lane. The algorithm returned correct ploidy calls for each of the three chromosomes, and for each of the replicates.

Example 9

In one experiment, four maternal plasma samples were prepared and amplified using a hemi-nested 9,600-plex protocol. The samples were prepared in the following way: Up to 40 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 45 uL TE buffer according to manufacturer's instructions. Universal ligation adapters were appended to the end of each molecule of 35 µL of purified plasma DNA and libraries were amplified for 7 cycles using adaptor specific primers. Libraries were purified with AGENCOURT AMPURE beads and eluted in 50 ul water.

3 ul of the DNA was amplified with 15 cycles of STA (95° C. for 10 min for initial polymerase activation, then 15 cycles of 95° C. for 30 s; 72° C. for 10 s; 65° C. for 1 min; 60° C. for 8 min; 65° C. for 3 min and 72° C. for 30 s; and a final extension at 72° C. for 2 min) using 14.5 nM primer concentration of 9600 target-specific tagged reverse primers and one library adaptor specific forward primer at 500 nM.

The hemi-nested PCR protocol involved a second amplification of a dilution of the first STAs product for 15 cycles of STA (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag concentration of 1000 nM, and a concentration of 16.6 u nM for each of 9600 target-specific forward primers.

An aliquot of the STA products was then amplified by standard PCR for 10 cycles with 1 uM of tag-specific forward and barcoded reverse primers to generate barcoded sequencing libraries. An aliquot of each library was mixed with libraries of different barcodes and purified using a spin column.

In this way, 9,600 primers were used in the single-well reactions; the primers were designed to target SNPs found on chromosomes 1, 2, 13, 18, 21, X and Y. The amplicons were then sequenced using an ILLUMINA GAIIX sequencer. Per sample, approximately 3.9 million reads were generated by the sequencer, with 3.7 million reads mapping to the genome (94%), and of those, 2.9 million reads (74%) mapped to targeted SNPs with an average depth of read of 344 and a median depth of read of 255. The fetal fraction for the four samples was found to be 9.9%, 18.9%, 16.3%, and 21.2%

Relevant maternal and paternal genomic DNA samples amplified using a semi-nested 9600-plex protocol and sequenced. The semi-nested protocol is different in that it applies 9,600 outer forward primers and tagged reverse primers at 7.3 nM in the first STA. Thermocycling conditions and composition of the second STA, and the barcoding PCR were the same as for the hemi-nested protocol.

The sequencing data was analyzed using informatics methods disclosed herein and the ploidy state was called at six chromosomes for the fetuses whose DNA was present in the 4 maternal plasma samples. The ploidy calls for all 28 chromosomes in the set were called correctly with confidences above 99.2% except for one chromosome that was called correctly, but with a confidence of 83%.

Figure 23:
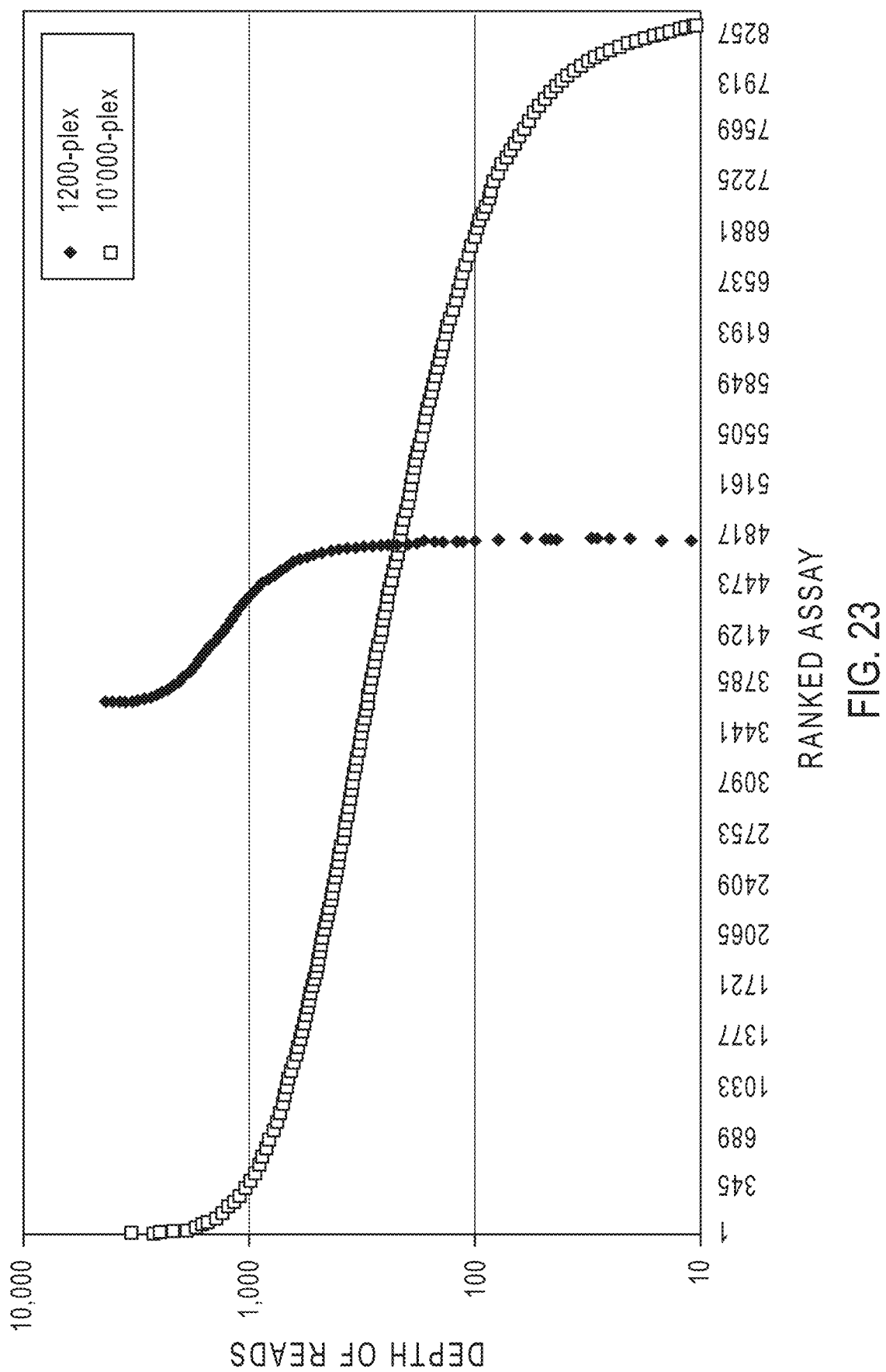
FIG. 23: Comparison of depth of read for 1,200-plex and 9,600-plex reactions.

FIG. 23 shows the depth of read of the 9,600-plex hemi-nesting approach along with the depth of read of the 1,200-plex semi-nested approach described in Example 7, though the number of SNPs with a depth of read greater than 100, greater than 200 and greater than 400 was significantly higher than in the 1,200-plex protocol. The number of reads at the 90th percentile can be divided by the number of reads at the 10th percentile to give a dimensionless metric that is indicative of the uniformity of the depth of read; the smaller the number, the more uniform (narrow) the depth of read. The average 90th percentile/10th percentile ratio is 11.5 for the method run in Example 9, while it is 5.6 for the method run in Example 7. A narrower depth of read for a given protocol plexity is better for sequencing efficiency, as fewer sequence reads are necessary to ensure that a certain percentage of reads are above a read number threshold.

Example 10

In one experiment, four maternal plasma samples were prepared and amplified using a semi-nested 9,600-plex protocol. Details of Example 10 were very similar to Example 9, the exception being the nesting protocol, and including the identity of the four samples. The ploidy calls for all 28 chromosomes in the set were called correctly with confidences above 99.7%. 7.6 million (97%) of reads mapped to the genome, and 6.3 million (80%) of the reads mapped to the targeted SNPs. The average depth of read was 751, and the median depth of read was 396.

Example 11

In one experiment, three maternal plasma samples were split into five equal portions, and each portion was amplified using either 2,400 multiplexed primers (four portions) or 1,200 multiplexed primers (one portion) and amplified using a semi-nested protocol, for a total of 10,800 primers. After amplification, the portions were pooled together for sequencing. Details of Example 11 were very similar to Example 9, the exception being the nesting protocol, and the split and pool approach. The ploidy calls for all 21 chromosomes in the set were called correctly with confidences above 99.7%, except for one missed call where the confidence was 83%. 3.4 million reads mapped to targeted SNPs, the average depth of read was 404 and the median depth of read was 258.

Example 12

In one experiment, four maternal plasma samples were split into four equal portions, and each portion was amplified using 2,400 multiplexed primers and amplified using a semi-nested protocol, for a total of 9,600 primers. After amplification, the portions were pooled together for sequencing. Details of Example 12 were very similar to Example 9, the exception being the nesting protocol, and the split and pool approach. The ploidy calls for all 28 chromosomes in the set were called correctly with confidences above 97%, except for one missed call where the confidence was 78%. 4.5 million reads mapped to targeted SNPs, the average depth of read was 535 and the median depth of read was 412.

Example 13

In one experiment, four maternal plasma samples were prepared and amplified using a 9,600-plex triply hemi-nested protocol, for a total of 9,600 primers. Details of Example 12 were very similar to Example 9, the exception being the nesting protocol which involved three rounds of amplification; the three rounds involved 15, 10 and 15 STA cycles respectively. The ploidy calls for 27 of 28 chromosomes in the set were called correctly with confidences above 99.9%, except for one that was called correctly with 94.6%, and one missed call with a confidence of 80.8%. 3.5 million reads mapped to targeted SNPs, the average depth of read was 414 and the median depth of read was 249.

Example 14

In one Example 45 sets of cells were amplified using a 1,200-plex semi-nested protocol, sequenced, and ploidy determinations were made at three chromosomes. Note that this experiment is meant to simulate the conditions of performing pre-implantation genetic diagnosis on single-cell biopsies from day 3 embryos, or trophectoderm biopsies from day 5 embryos. 15 individual single cells and 30 sets of three cells were placed in 45 individual reaction tubes for a total of 45 reactions where each reaction contained cells from only one cell line, but the different reactions contained cells from different cell lines. The cells were prepared into 5 ul washing buffer and lysed the by adding 5 ul ARCTURUS PICOPURE lysis buffer (APPLIED BIOSYSTEMS) and incubating at 56° C. for 20 min, 95° C. for 10 min.

The DNA of the single/three cells was amplified with 25 cycles of STA (95° C. for 10 min for initial polymerase activation, then 25 cycles of 95° C. for 30 s; 72° C. for 10 s; 65° C. for 1 min; 60° C. for 8 min; 65° C. for 3 min and 72° C. for 30 s; and a final extension at 72° C. for 2 min) using 50 nM primer concentration of 1200 target-specific forward and tagged reverse primers.

The semi-nested PCR protocol involved three parallel second amplification of a dilution of the first STAs product for 20 cycles of STA (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag specific primer concentration of 1000 nM, and a concentration of 60 nM for each of 400 target-specific nested forward primers. In the three parallel 400-plex reactions the total of 1200 targets amplified in the first STA were thus amplified.

An aliquot of the STA products was then amplified by standard PCR for 15 cycles with 1 uM of tag-specific forward and barcoded reverse primers to generate barcoded sequencing libraries. An aliquot of each library was mixed with libraries of different barcodes and purified using a spin column.

In this way, 1,200 primers were used in the single cell reactions; the primers were designed to target SNPs found on chromosomes 1, 21 and X. The amplicons were then sequenced using an ILLUMINA GAIIX sequencer. Per sample, approximately 3.9 million reads were generated by the sequencer, with 500,000 to 800,000 million reads mapping to the genome (74% to 94% of all reads per sample).

Relevant maternal and paternal genomic DNA samples from cell lines were analyzed using the same semi-nested 1200-plex assay pool with a similar protocol with fewer cycles and 1200-plex second STA, and sequenced.

The sequencing data was analyzed using informatics methods disclosed herein and the ploidy state was called at the three chromosomes for the samples.

Figure 24:
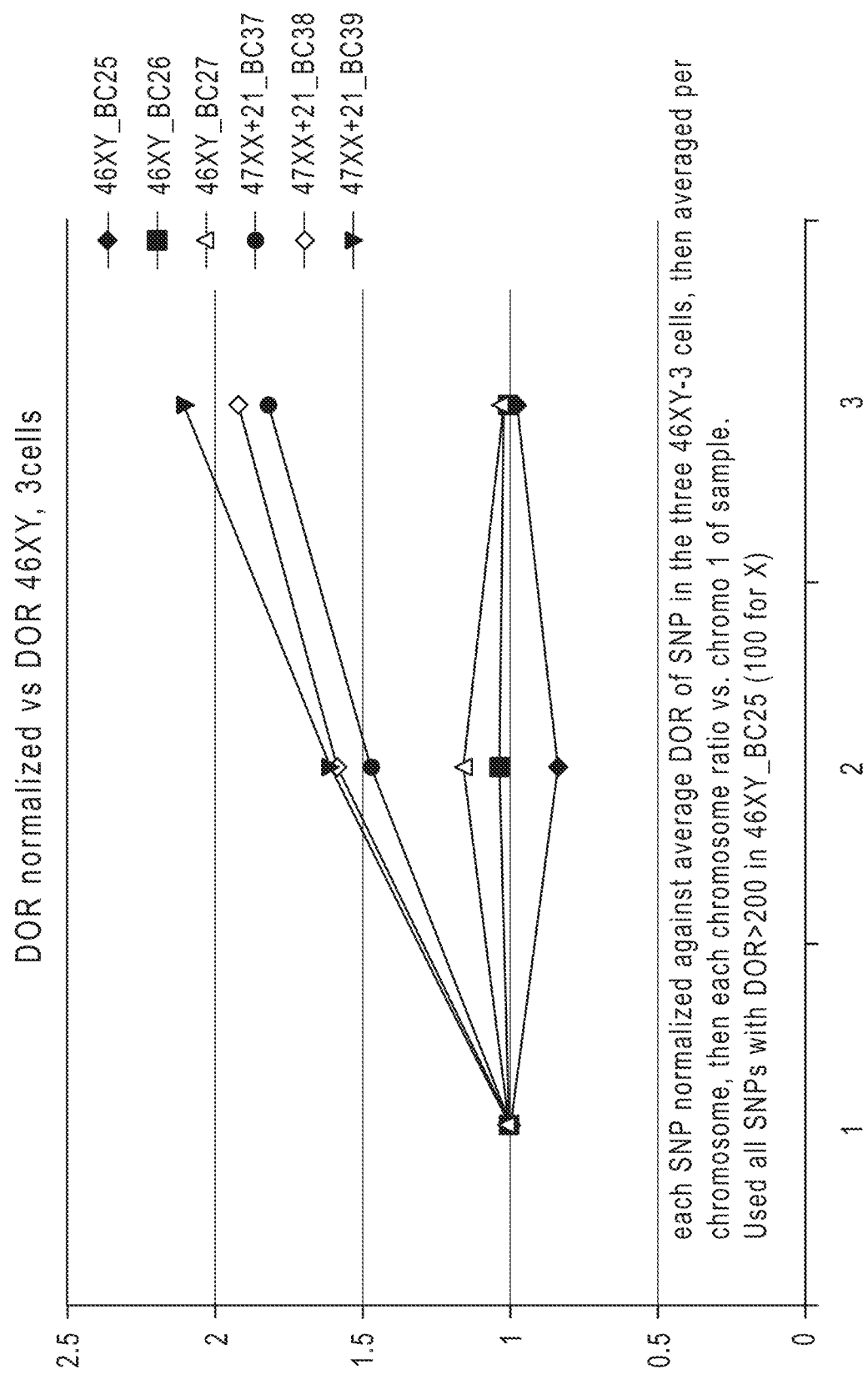
FIG. 24: Read count ratios for six cells at three chromosomes.

FIG. 24 shows normalized depth of read ratios (vertical axis) for six samples at three chromosomes (1=chrom 1; 2=chrom 21; 3=chrom X). The ratios were set to be equal to the number of reads mapping to that chromosome, normalized, and divided by the number of reads mapping to that chromosome averaged over three wells each comprising three 46XY cells. The three sets of data points corresponding to the 46XY reactions are expected to have ratios of 1:1. The three sets of data points corresponding to the 47XX+21 cells are expected to have ratios of 1:1 for chromosome 1, 1.5:1 for chromosome 21, and 2:1 for chromosome X.

Figure 25A:
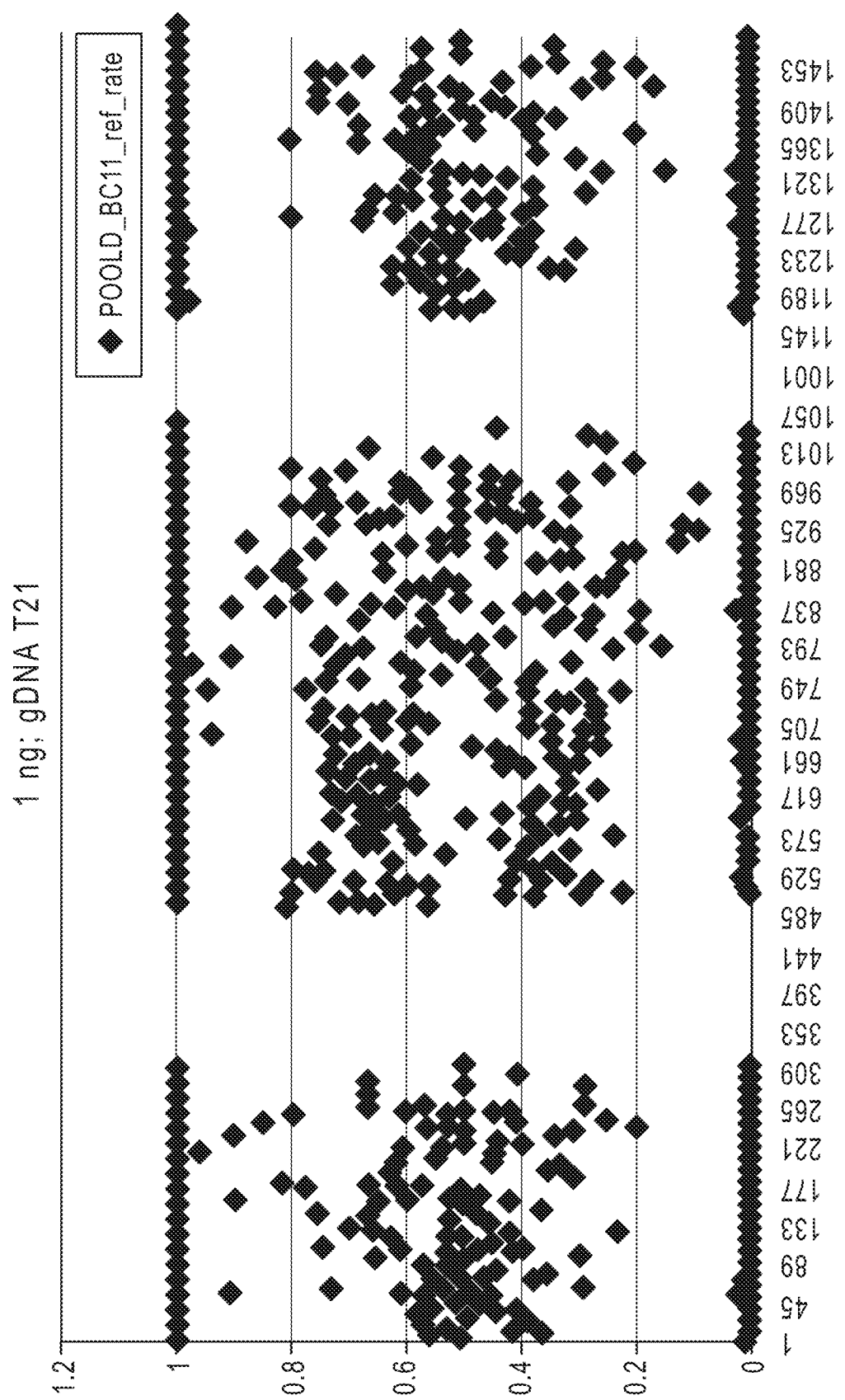
FIGS. 25A-25C: Allele ratios for two three-cell reactions (FIGS. 25B and 25C) and a third reaction run on 1 ng of genomic DNA at three chromosomes (FIG. 25A).
Figure 25B:
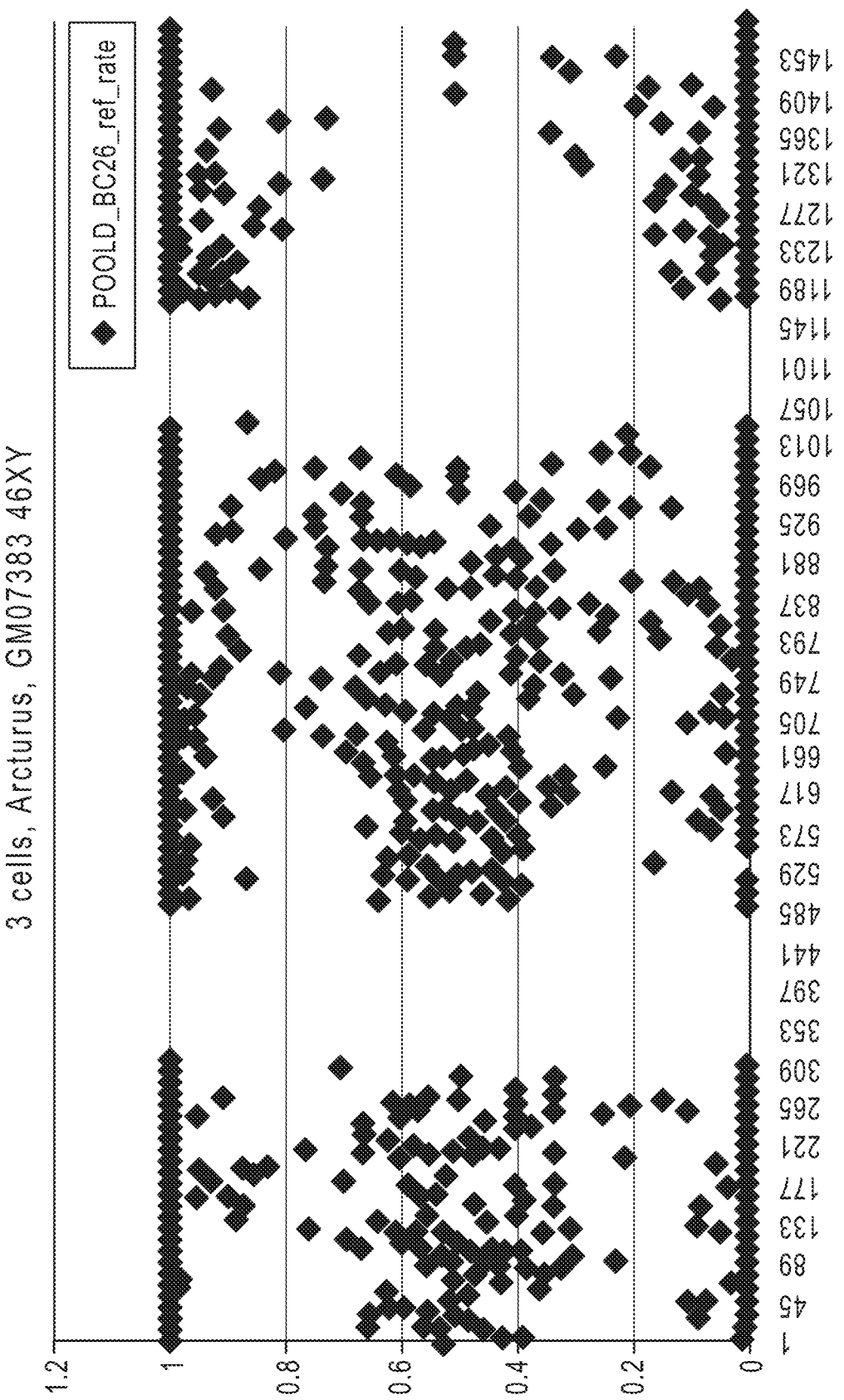
Figure 25C:
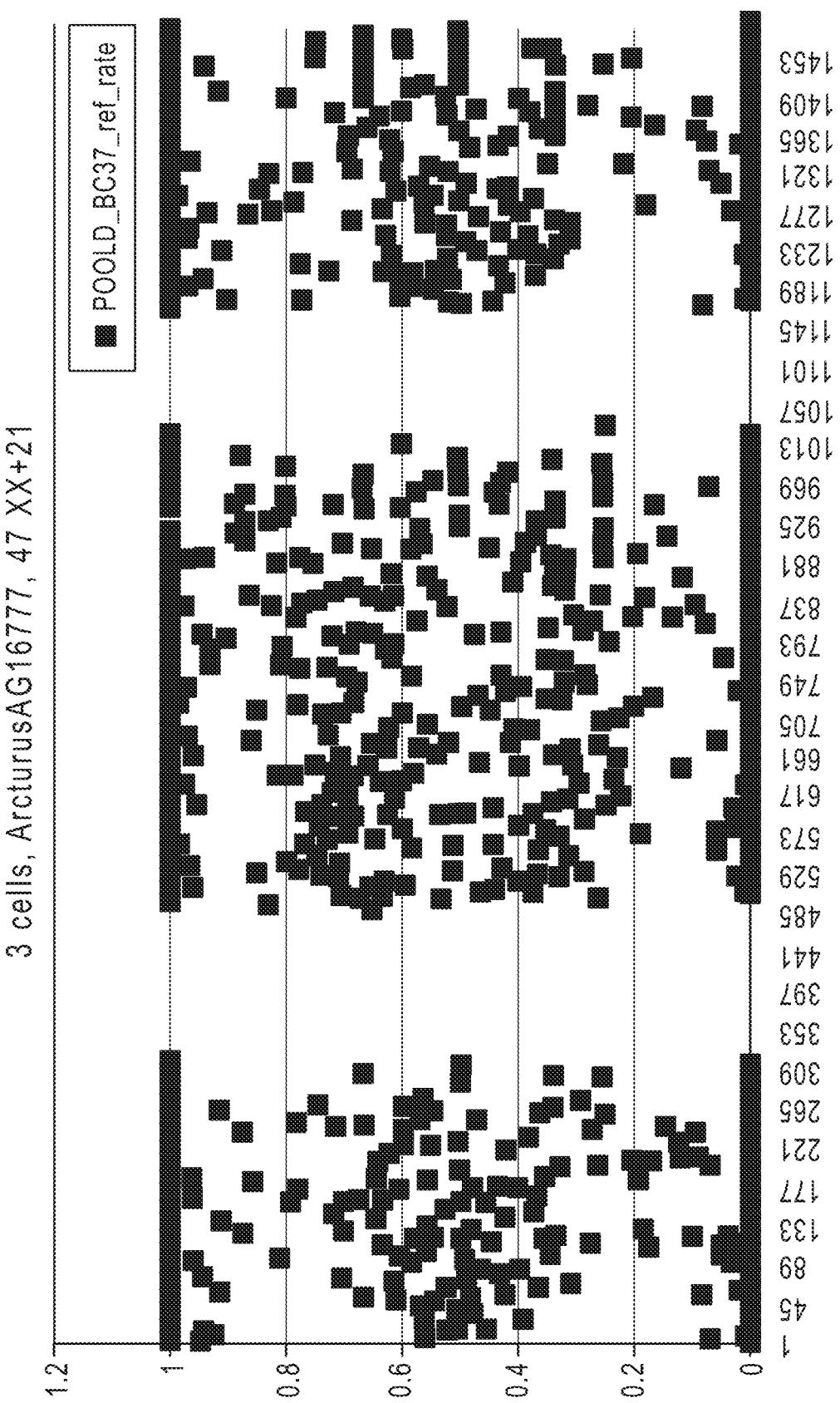
Figure 26A:
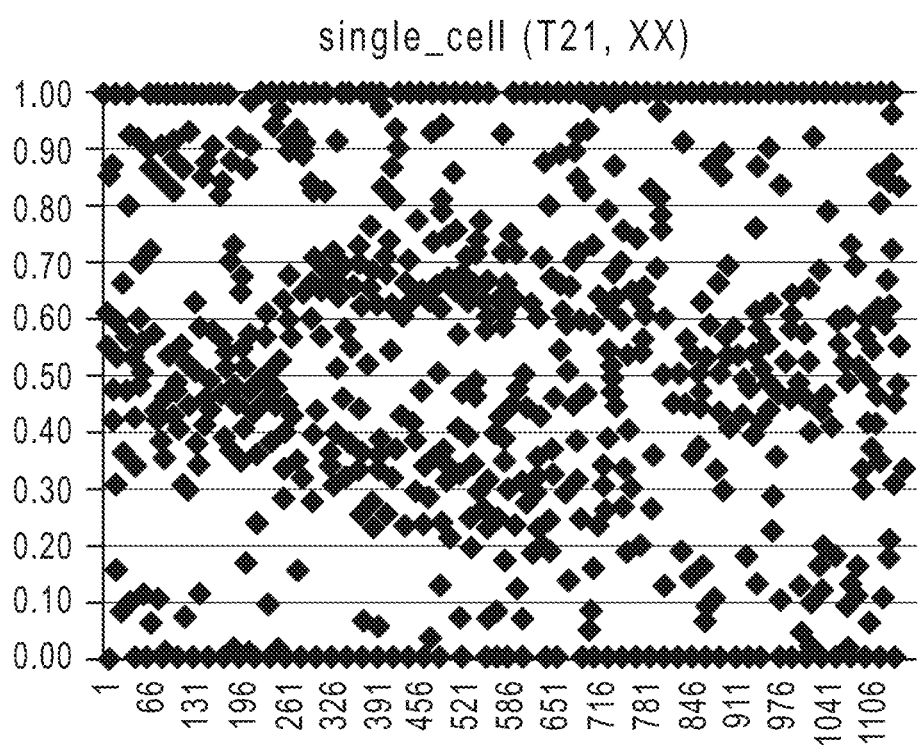
FIGS. 26A and 26B: Allele ratios for two single-cell reactions (FIGS. 26A and 26B) at three chromosomes.
Figure 26B:
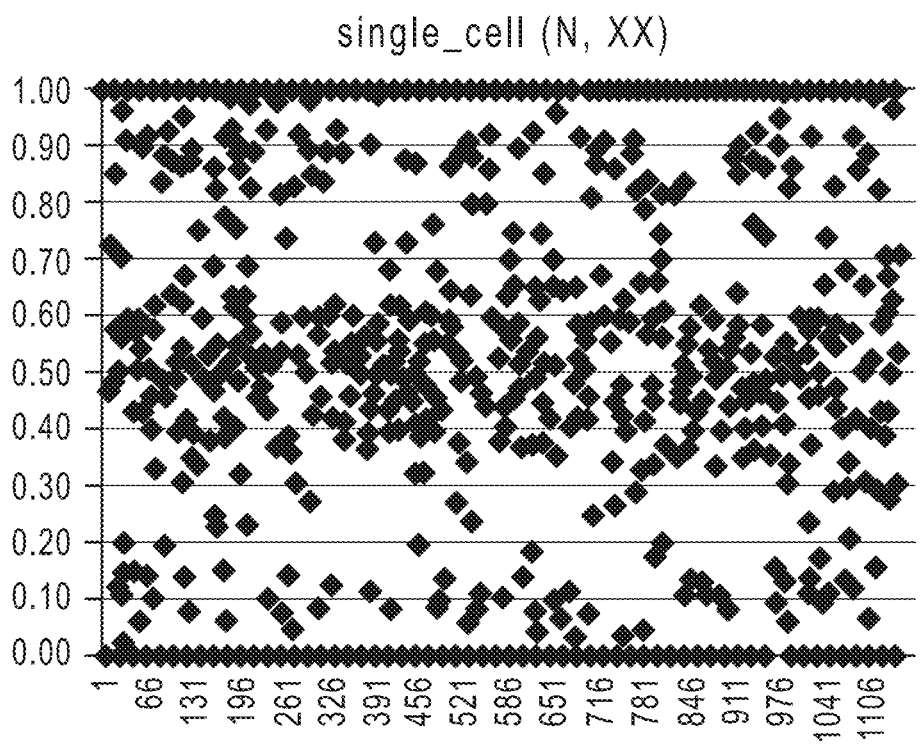

FIG. 25A-25C show allele ratios plotted for three chromosomes (1, 21, X) for three reaction. The reaction in the lower left shows a reaction on three 46XY cells (FIG. 25B). The left region are the allele ratios for chromosome 1, the middle region are the allele ratios for chromosome 21, and the right region are the allele ratios for chromosome X. For the 46XY cells, for chromosome 1 we expect to see ratios of 1, 0.5 and 0, corresponding to AA, AB and BB SNP genotypes. For the 46XY cells, for chromosome 21 we expect to see ratios of 1, 0.5 and 0, corresponding to AA, AB and BB SNP genotypes. For the 46XY cells, for chromosome X we expect to see ratios of 1 and 0, corresponding to A, and B SNP genotypes. The reaction in the lower right shows a reaction on three 47XX+21 cells (FIG. 25C). The allele ratios are segregated by chromosome as in the lower left graph. For the 47XX+21 cells, for chromosome 1 we expect to see ratios of 1, 0.5 and 0, corresponding to AA, AB and BB SNP genotypes. For the 47XX+21 cells, for chromosome 21 we expect to see ratios of 1, 0.67, 0.33 and 0, corresponding to AAA, AAB, ABB and BBB SNP genotypes. For the 47XX+21 cells, for chromosome X we expect to see ratios of 1, 0.5 and 0, corresponding to AA, AB, and BB SNP genotypes. The plot in the upper right was made on a reaction comprising 1 ng of genomic DNA from the 47XX+21 cell line (FIG. 25A). FIG. and 26B shows the same graphs as in FIG. 25A-25C, but for reactions performed on only one cell. The left graph was a reaction that contained a 47XX+21 cell (FIG. 26A), and the right graph was for a reaction that contained a 46XX cell (FIG. 26B).

From the graphs shown in FIGS. 25A-25C and FIGS. 26A and 26B, it is visually apparent that there are two clusters of dots for chromosomes where we expect to see ratios of 1 and 0; three clusters of dots for chromosomes where we expect to see ratios of 1, 0.5, and 0, and four clusters of dots for chromosomes where we expect to see ratios of 1, 0.67, 0.33 and 0. The parental support algorithm was able to make correct calls on all of the three chromosomes for all of the 45 reactions.

Example 15

In one experiment, maternal plasma samples were prepared and amplified using a hemi-nested 19,488-plex protocol. The samples were prepared in the following way: up to 20 mL of maternal blood were centrifuged to isolate the buffy coat and the plasma. The genomic DNA in the maternal sample was prepared from the buffy coat and paternal DNA was prepared from a blood sample or saliva sample. Cell-free DNA in the maternal plasma was isolated using the QIAGEN CIRCULATING NUCLEIC ACID kit and eluted in 50 uL TE buffer according to manufacturer's instructions. Universal ligation adapters were appended to the end of each molecule of 40 µL of purified plasma DNA and libraries were amplified for 9 cycles using adaptor specific primers. Libraries were purified with AGENCOURT AMPURE beads and eluted in 50 ul DNA suspension buffer.

6 ul of the DNA was amplified with 15 cycles of STAR 1 (95° C. for 10 min for initial polymerase activation, then 15 cycles of 96° C. for 30 s; 65° C. for 1 min; 58° C. for 6 min; 60° C. for 8 min; 65° C. for 4 min and 72° C. for 30 s; and a final extension at 72° C. for 2 min) using 7.5 nM primer concentration of 19,488 target-specific tagged reverse primers and one library adaptor specific forward primer at 500 nM.

The hemi-nested PCR protocol involved a second amplification of a dilution of the STAR 1 product for 15 cycles (STAR 2) (95° C. for 10 min for initial polymerase activation, then 15 cycles of 95° C. for 30 s; 65° C. for 1 min; 60° C. for 5 min; 65° C. for 5 min and 72° C. for 30 s; and a final extension at 72° C. for 2 min) using reverse tag concentration of 1000 nM, and a concentration of 20 nM for each of 19,488 target-specific forward primers.

An aliquot of the STAR 2 products was then amplified by standard PCR for 12 cycles with 1 uM of tag-specific forward and barcoded reverse primers to generate barcoded sequencing libraries. An aliquot of each library was mixed with libraries of different barcodes and purified using a spin column.

In this way, 19,488 primers were used in the single-well reactions; the primers were designed to target SNPs found on chromosomes 1, 2, 13, 18, 21, X and Y. The amplicons were then sequenced using an ILLUMINA GAIIX sequencer. For plasma samples, approximately 10 million reads were generated by the sequencer, with 9.4-9.6 million reads mapping to the genome (94-96%), and of those, 99.95% mapped to targeted SNPs with a mean depth of read of 460 and a median depth of read of 350. For comparison, a perfectly even distribution would be: 10M reads/19,488 targets=513 reads/target. For primer-dimers, 30,000 reads were from sequenced primer-dimers (0.3% of the reads generated by the sequencer). For genomic samples, 99.4-99.7% of the reads mapped to the genome, of those, 99.99% of the mapped to targeted SNPs, and 0.1% of the reads generated by the sequencer were primer-dimers.

For plasma samples with 10 million sequencing reads, typically at least 19,350 of the 19,488 targeted SNPs (99.3%) are amplified and sequenced. For DNA samples with 2M sequencing reads, typically at least 19,000 targeted SNPs (97.5%) are amplified and sequenced. The lower number may be due to sampling noise since the number of reads is lower and the sequencer misses some of the amplified products. If desired, the number of sequencing reads can be increased to increase the number of targeted SNPs that are amplified and sequenced.

Relevant maternal and paternal genomic DNA samples amplified using a semi-nested 19,488 outer forward primers and tagged reverse primers at 7.5 nM in the STAR 1. Thermocycling conditions and composition of STAR 2, and the barcoding PCR were the same as for the hemi-nested protocol.

The average fetal fraction for 407 samples was found to be 14.8%. The sequencing data was analyzed using informatics methods disclosed herein and the ploidy state was called at four chromosomes (13, 18, 21, Y) for the fetuses whose DNA was present in 378 of the 407 maternal plasma samples, and at chromosome X in 375 of the 407 maternal plasma samples. The ploidy calls for all 1,887 chromosomes in the set were called correctly with confidences above 90%. 1882 of the 1887 calls were above 95%; and 1,862 of the 1,887 calls were called with confidences above 99%.

A similar control experiment was performed using water instead of DNA extracted from plasma in the plasma PCR protocol. Based on six such trials of an experiment, 5-6% of the sequenced reads were primer-dimers. Other sequenced reads were due to background noise. This experiment demonstrates that even in the absence of a nucleic acid sample with target loci for the primers to hybridize to (rather than hybridizing to other primers and forming amplified primer dimers) few primer dimers are formed.

Example 16

The following Example illustrates an exemplary method for designing and selecting a library of primers that can be used in any of the multiplexed PCR methods of the invention. The goal is to select primers from an initial library of candidate primers that can be used to simultaneously amplify a large number of target loci (or a subset of target loci) in a single reaction. For an initial set of candidate target loci, primers did not have to be designed or selected for each target locus. Preferably, primers are designed and selected for a large portion of the most desirable target loci.

Step 1

A set of candidate target loci (such as SNPs) were selected based on publically available information about desired parameters for the target loci, such as frequency of the SNPs within a target population or heterozygosity rate of the SNPs (worldwide web at ncbi.nlm.nih.gov/projects/SNP/; Sherry S T, Ward M H, Kholodov M, et al. dbSNP: the NCBI database of genetic variation. Nucleic Acids Res. 2001 Jan. 1; 29 (1): 308-11, which are each incorporated by reference in its entirety). For each candidate locus, one or more PCR primer pairs were designed using the Primer3 program (the worldwide web at primer3.sourceforge.net; libprimer3 release 2.2.3, which is hereby incorporated by reference in its entirety). If there were no feasible designs for PCR primers for a particular target locus, then that target locus was eliminated from further consideration. If desired, a "target locus score" (higher score representing higher desirability) can be calculated for most or all of the target loci, such as a target locus score calculated based on a weighted average of various desired parameters for the target loci. The parameters may be assigned different weights based on their importance for the particular application that the primers will be used for. Exemplary parameters include the heterozygosity rate of the target locus, the disease prevalence associated with a sequence (e.g., a polymorphism) at the target locus, the disease penetrance associated with a sequence (e.g., a polymorphism) at the target locus, the specificity of the candidate primer(s) used to amplify the target locus, the size of the candidate primer(s) used to amply the target locus, and the size of the target amplicon. In some embodiments, the specificity of the candidate primer for the target locus includes the likelihood that the candidate primer will mis-prime by binding and amplifying a locus other than the target locus it was designed to amplify. In some embodiments, one or more or all the candidate primers that mis-prime are removed from the library.

Step 2

A thermodynamic interaction score was calculated between each primer and all primers for all other target loci from Step 1 (see, e.g., Allawi, H. T. & SantaLucia, J., Jr. (1998), "Thermodynamics of Internal C-T Mismatches in DNA", Nucleic Acids Res. 26, 2694-2701; Peyret, N., Seneviratne, P. A., Allawi, H. T. & SantaLucia, J., Jr. (1999), "Nearest-Neighbor Thermodynamics and NMR of DNA Sequences with Internal A-A, C-C, G-G, and T-T Mismatches", *Biochemistry* 38, 3468-3477; Allawi, H. T. & SantaLucia, J., Jr. (1998), "Nearest-Neighbor Thermodynamics of Internal A-C Mismatches in DNA: Sequence Dependence and pH Effects", *Biochemistry* 37, 9435-9444.; Allawi, H. T. & SantaLucia, J., Jr. (1998), "Nearest Neighbor Thermodynamic Parameters for Internal G-A Mismatches in DNA", *Biochemistry* 37, 2170-2179; and Allawi, H. T. & SantaLucia, J., Jr. (1997), "Thermodynamics and NMR of Internal G-T Mismatches in DNA", *Biochemistry* 36, 10581-10594; MultiPLX 2.1 (Kaplinski L, Andreson R, Puurand T, Remm M. MultiPLX: automatic grouping and evaluation of PCR primers. Bioinformatics. 2005 Apr. 15; 21 (8): 1701-2, which are each hereby incorporated by reference in its entirety). This step resulted in a 2D matrix of interaction scores. The interaction score predicted the likelihood of primer-dimers involving the two interacting primers. The score was calculated as follows:

$$\text{interaction\_score} = \max(-\text{deltaG\_2}, 0.8*(-\text{deltaG\_1}))$$

where deltaG_2=Gibbs energy (energy required to break the dimer) for a dimer that is extensible by PCR on both ends, i.e., the 3' end of each primer anneals to the other primer; and deltaG_1=Gibbs energy for a dimer that is extensible by PCR on at least one end.

Step 3:

For each target locus, if there was more than one primer-pair design, then one design was selected using the following method:

For each primer-pair design for the locus, find the worst-case (highest) interaction score for the two primers in that design and all primers from all designs for all other target loci.

Pick the design with the best (lowest) worst-case interaction score.

Step 4

A graph was built such that each node represented one locus and its associated primer-pair design (e.g., a Maximal Clique problem). One edge was created between every pair of nodes. A weight was assigned to each edge equal to the worst-case (highest) interaction score between the primers associated with the two nodes connected by the edge.

Step 5

If desired, for every pair of designs for two different target loci where one of the primers from one design and one of the primers from the other design would anneal to overlapping target regions, an additional edge was added between the nodes for the two design. The weight of these edges was set equal to the highest weight assigned in Step 4. Thus, Step 5 prevents the library from having primers that would anneal to overlapping target regions, and thus interfere with each other during a multiplex PCR reaction.

Step 6

An initial interaction score threshold was calculated as follows:

weight_threshold =
max(edge_weight) − 0.05 * (max(edge_weight) − min(edge_weight))

where max(edge_weight) is the maximum edge weight in the graph; and min(edge_weight) is the minimum edge weight in the graph.

The initial bounds for the threshold were set as follows:

max_weight_threshold=max(edge_weight)

min_weight_threshold=min(edge_weight)

Step 7

A new graph was constructed consisting of the same set of nodes as the graph from Step 5, only including edges with weights that exceed weight_threshold. Thus, step ignores interactions with scores equal to or below weight_threshold.

Step 8

Nodes (and all of the edges connected to the removed nodes) were removed from the graph of Step 7 until there were no edges left. Nodes were removed by applying the following procedure repeatedly:

Find the node with the highest degree (highest number of edges). If there is more than one then pick one arbitrarily.

Define the set of nodes consisting of the node picked above and all of the nodes connected to it, but excluding any nodes that have degree less than the node picked above.

Choose the node from the set that has the lowest target locus score (lower score representing lower desirability) from Step 1. Remove that node from the graph.

Step 9

If the number of nodes remaining in the graph satisfies the required number of target loci for the multiplexed PCR pool (within an acceptable tolerance), then the method was continued at Step 10.

If there were too many or too few nodes remaining in the graph, then a binary search was performed to determine what threshold values would result in the desired number of nodes remaining in the graphs. If there were too many nodes in the graph then, the weight threshold bounds were adjusted as follows:

max_weight_threshold=weight_threshold

Otherwise (if there are two few nodes in the graph), then the weight threshold bounds were adjusted as follows:

min_weight_threshold=weight_threshold

Then, the weight threshold was adjusted follows:

$$\text{weight\_threshold} = (\text{max\_weight\_threshold} + \text{min\_weight\_threshold})/2$$

Steps 7-9 were repeated.

Step 10

The primer-pair designs associated with the nodes remaining in the graph were selected for the library of primers. This primer library can be used in any of the methods of the invention.

If desired, this method of designing and selecting primers can be performed for primer libraries in which only one primer (instead of a primer pair) is used for amplification of a target locus. In this case, a node presents one primer per target locus (rather than a primer pair).

Example 17

Figure 27:
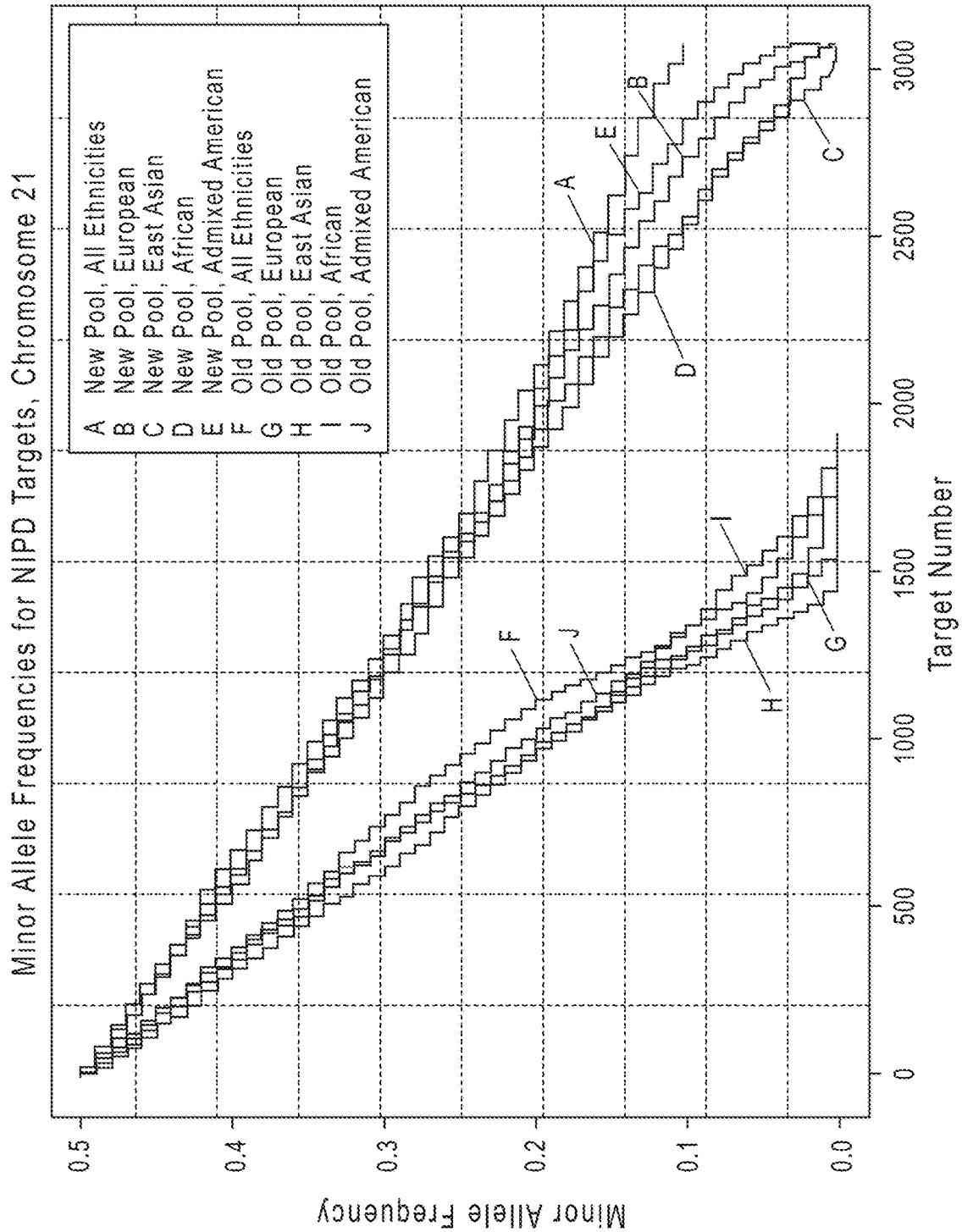
FIG. 27: Comparison of two primer libraries showing the number of loci with a particular minor allele frequency that are targeted by each primer library.
Figure 28A:
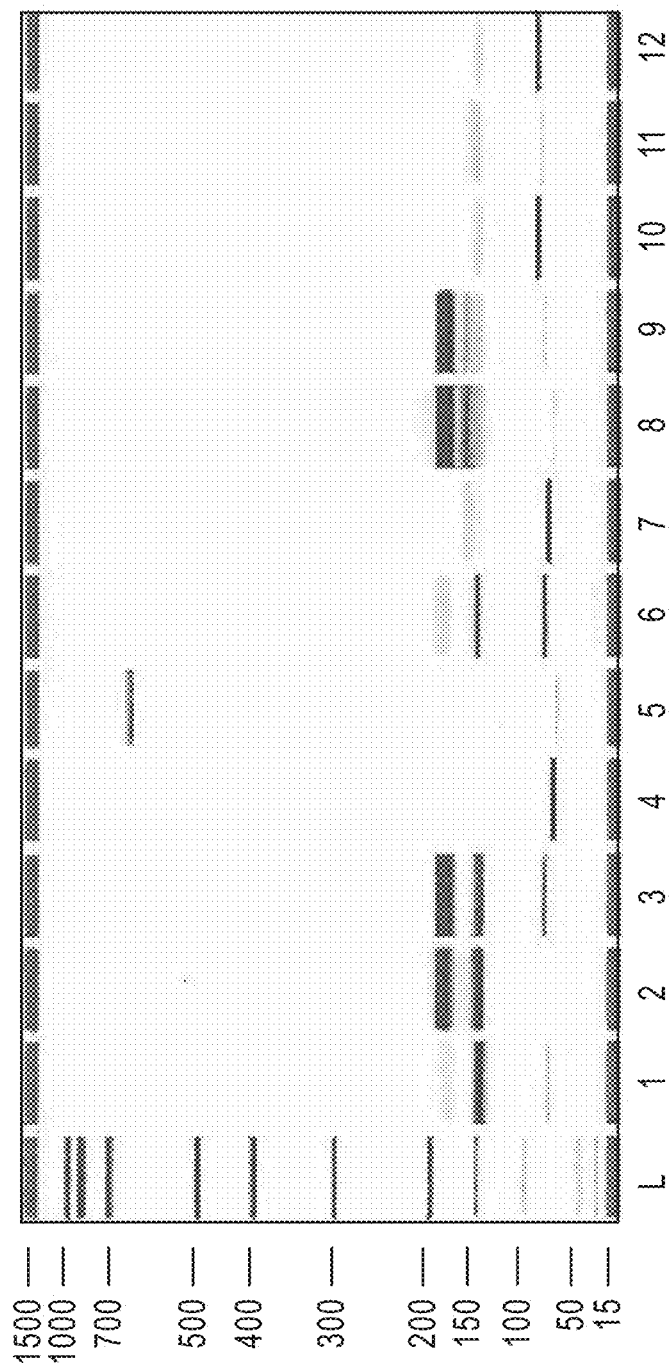
FIG. 28A: Graph of the electrophoresis of PCR products.
Figure 28B:
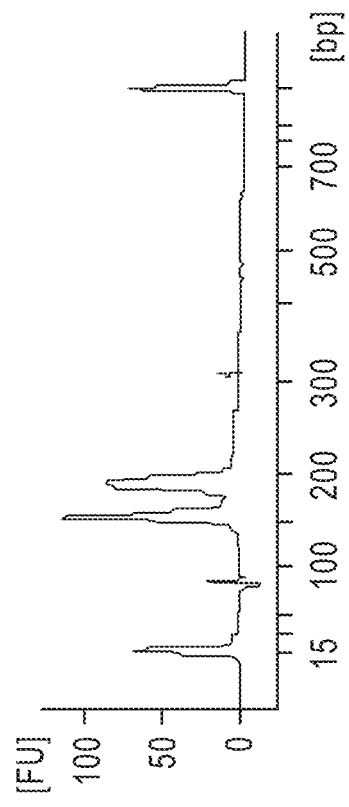
FIGS. 28B-28M are electropherograms of lanes 1-12, respectively, in FIG. 28A.
Figure 28C:
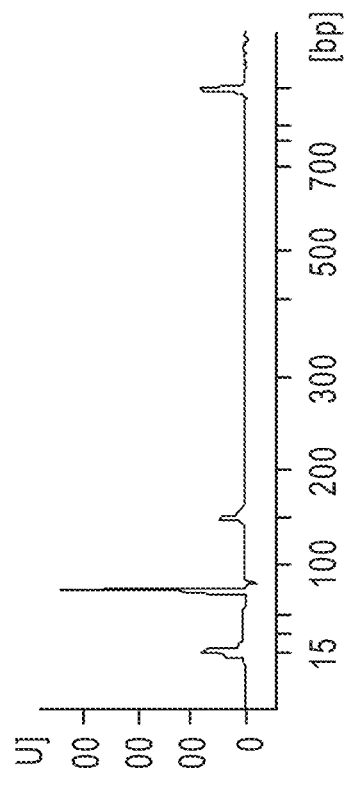
Figure 28D:
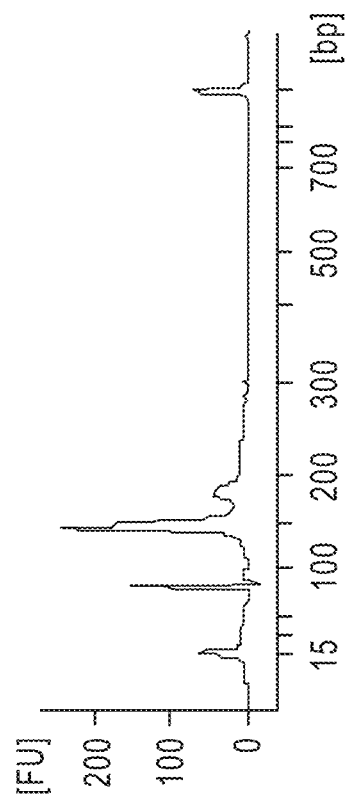
Figure 28E:
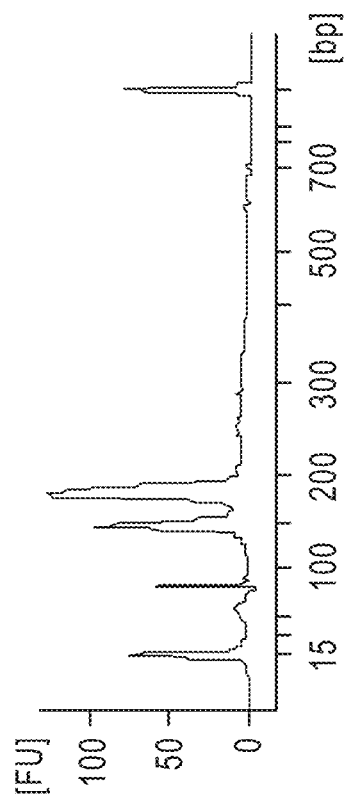
Figure 28F:
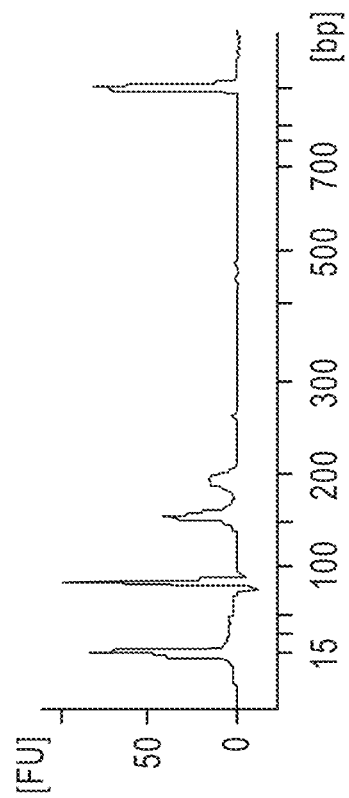
Figure 28G:
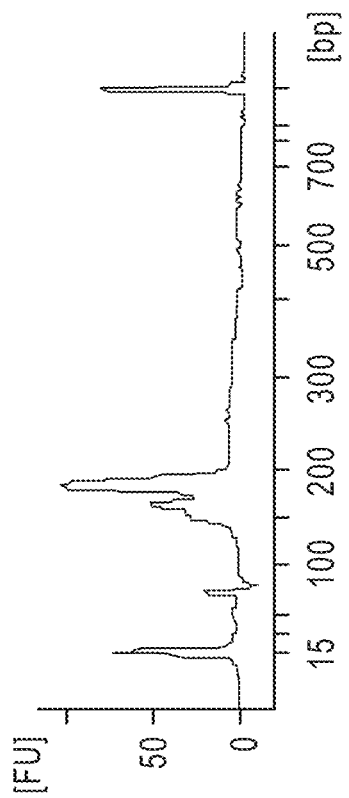
Figure 28H:
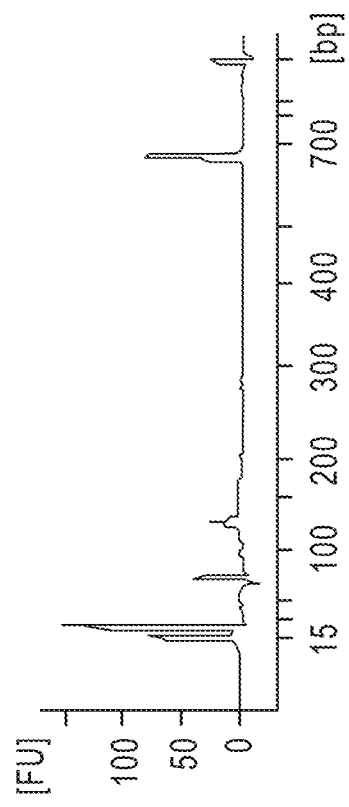
Figure 28I:
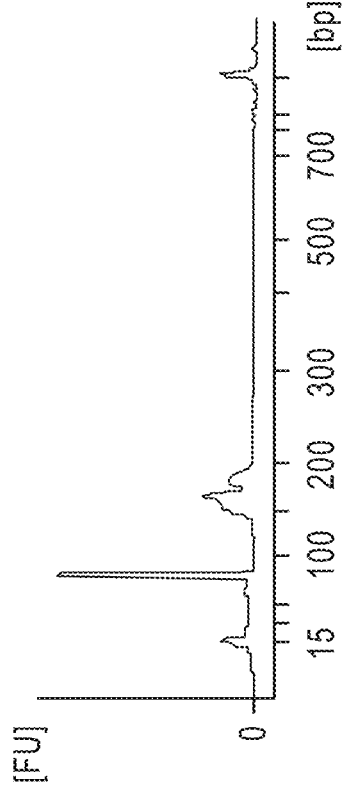
Figure 28K:
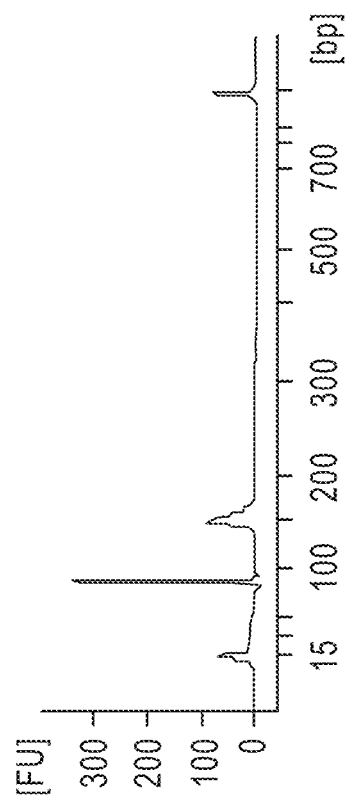
Figure 28M:
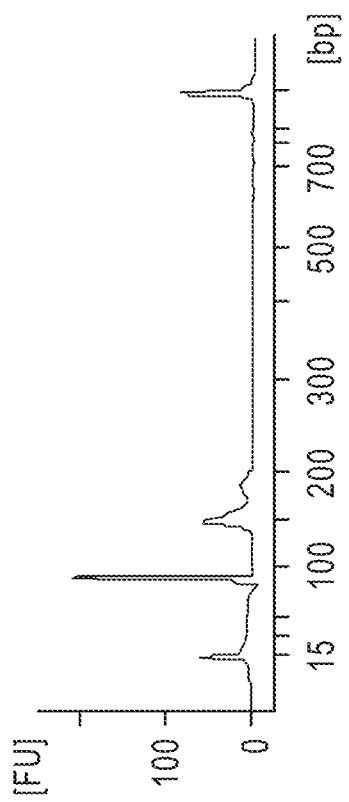
Figure 28J:
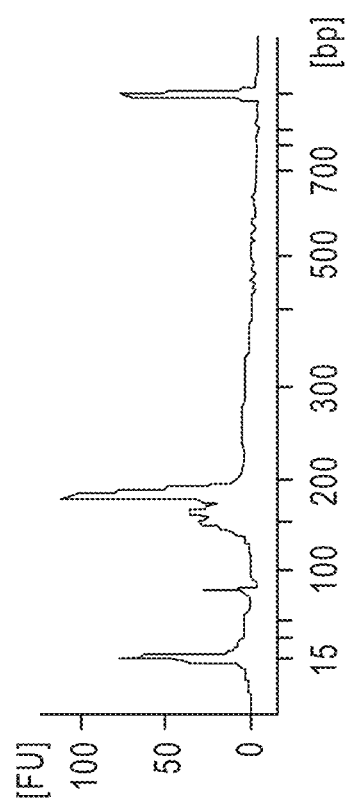
Figure 28L:
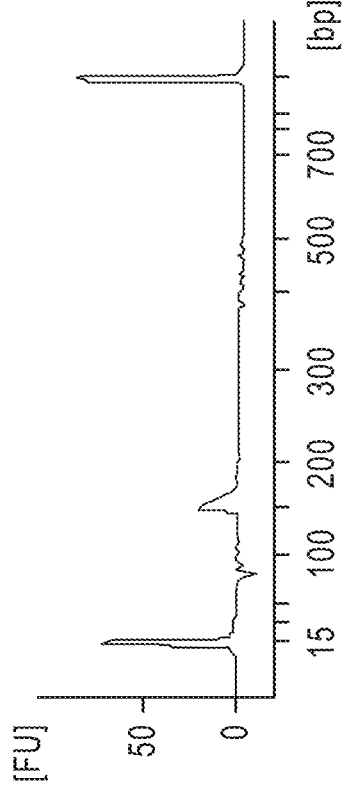

FIG. 27 is a graph comparing two primer libraries designed using the methods of the invention. This graph shows the number of loci with a particular minor allele frequency that are targeted by each primer library. During the selection of the "new pool" library, more primers were retained. This library enables the amplification of more target loci, especially target loci with relatively large minor allele frequencies (which are the more informative alleles for some method of the invention, such as for detecting fetal chromosomal abnormalities).

These primer libraries were used in the following multiplex PCR method. Blood (20-40 mL) was collected from each subject into two to four CELL-FREE™ DNA tubes (Streck). Plasma (a minimum of 7 mL) was isolated from each sample via a double centrifugation protocol of 2,000 g for 20 min, followed by 3,220 g for 30 min, with supernatant transfer following the first spin. cfDNA was isolated from 7-20 mL plasma using the QIAGEN QIAamp Circulating Nucleic Acid kit and eluted in 45 uL TE buffer. Pure maternal genomic DNA was isolated from the buffy coat obtained following the first centrifugation, and pure paternal genomic DNA was prepared similarly from a blood, saliva or buccal sample.

Maternal cfDNA, maternal genomic DNA, and paternal genomic DNA samples were pre-amplified for 15 cycles using 11,000 target-specific assays and an aliquot was transferred to a second PCR reaction of 15 cycles using nested primers. Finally, samples were prepared for sequencing by adding barcoded tags in a third 12-cycle round of PCR. Thus, 11,000 targets were amplified in a single reaction; the targets included SNPs found on chromosomes 13, 18, 21, X, and Y. The amplicons were then sequenced using an ILLUMINA GAIIx or HISEQ sequencer. Parental genotypes were sequenced at a lower read depth (~20% of cfDNA read depth) than the fetal genotypes.

Example 18

If desired, the size and quantity of the PCR products can be analyzed using standard methods, such as the use of the Agilent Technologies 2100 Bioanalyzer (FIG. 28A-M). For example, direct PCR methods described herein without nesting were used in 2,400-plex (FIGS. 28B-28G) and 19,488-plex experiments (FIGS. 28H to 28M). The amount of primer was 10 nM for FIGS. 28B-28D and 28H to 28J. The amount of primer was 1 nM for FIGS. 28E-28G and 28K to 28M. The amount of input DNA was 24 ng for FIGS. 28B, 28E, 28H, and 28K; 80 ng for FIGS. 28C, 28F, 28I, and 28L; and 250 ng for FIGS. 28D, 28G, 28J, and 28M. More input DNA resulted in a greater proportion of the desired 180 base pair product. The peak at 140 base pairs is a primer dimer product.

Example 19

Figure 29:
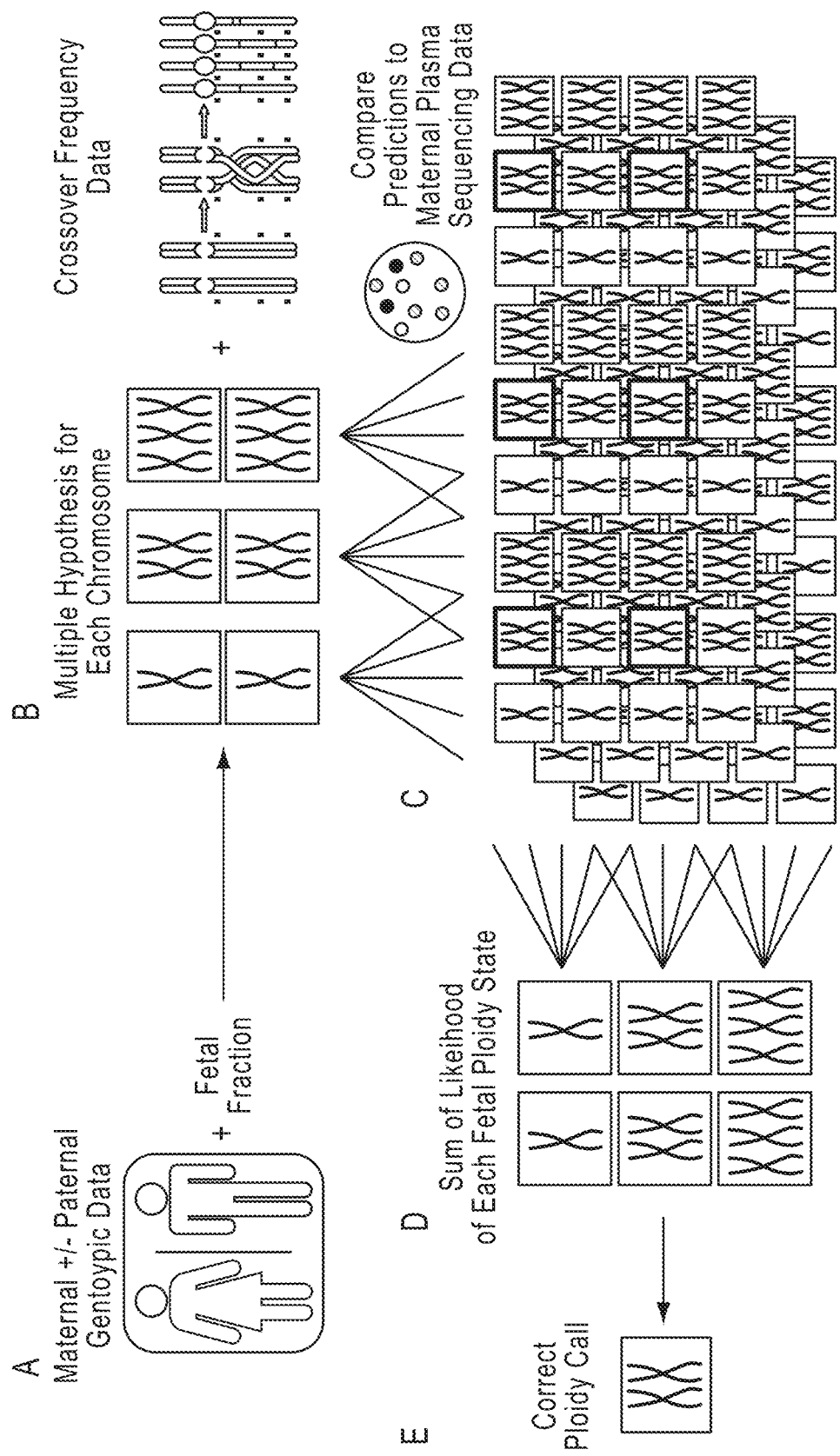
FIG. 29: Cartoon depiction of a method of the invention for the determination of a fetal aneuploidy (FIG. 29, step A). Maternal and paternal genotype data (from blood or buccal swabs) and crossover frequency data from the HapMap database are utilized to generate (FIG. 29, step B) multiple independent hypotheses for each potential fetal ploidy state in silico (FIG. 29, step C). Each of these hypotheses is expanded to include sub-hypotheses with take into consideration the different possible crossover points. The data model predicts what the sequencing data would look like (the expected allele distributions) given each hypothetical fetal genotype and at different fetal cfDNA fractions, and is compared to the actual sequencing data; the likelihood for each hypothesis is determined using Bayesian statistics. In this hypothetical example, the hypotheses with the highest likelihoods (euploidy) are determined (FIG. 29, step D). The individual likelihoods from FIG. 29, step C are summed for each copy number hypothesis family (monosomy, disomy, or triploidy). The hypothesis with the maximum likelihood is called as the ploidy state, reveals the fetal fraction, and represents the sample-specific calculated accuracy.

A proof-of-principle study demonstrated the detection of T13, T18, T21, 45,X, and 47,XXY with equally high accuracies across all chromosomes.
Patients Pregnant couples were enrolled at specific prenatal care centers under protocols approved by an Institutional Review Board pursuant to local laws. Inclusion criteria were at least 18 years of age, gestational age of at least nine weeks, singleton pregnancies, and signed informed consent. Blood samples were drawn from pregnant mothers, and a blood or buccal sample was collected from the father. Samples from 2 pregnancies with T13 (Patau Syndrome), 2 with T18 (Edwards Syndrome), 2 with T21 (Down's Syndrome), 2 with 45,X, 2 with 47,XXY, and 90 normal pregnancies were selected prior to testing from a cohort of ~500 women to test which chromosomal abnormalities the method detects. Normal fetal karyotype was confirmed by molecular karyotyping for the samples where post-birth child tissue was available. Euploid sample were drawn prior to invasive testing from low-risk women. Aneuploid samples were drawn at least 7 days after invasive testing and aneuploidy was confirmed via cytogenetic karyotyping or fluorescence in situ hybridization at independent laboratories.
Sample Preparation and Multiplex PCR For the data in FIGS. 30, 30D, 30E, 30G, and 30H, and 31A-31G, sample preparation and 19,488-plex-PCR were performed as described in Example 15. For the data in FIG. 30F, sample preparation and 11,000-plex-PCR were performed as described in Example 17.
Methodology and Data Analysis The algorithm considers parental genotypes and crossover frequency data (such as data from the HapMap database) to calculate expected allele distributions for 19,488 polymorphic loci for a very large number possible fetal ploidy states, and at various fetal cfDNA fractions. (FIG. 29). Unlike allele ratio based-methods, it also takes into account linkage disequilibrium, and uses non-Gaussian data models to describe the expected distribution of allele measurements at a SNP given observed platform characteristics and amplification biases. It then compares the various predicted allele distributions to the actual allelic distributions as measured in the cfDNA sample (FIG. 29 step C), and calculates the likelihood of each hypothesis (monosomy, disomy, or trisomy, for which there are numerous hypotheses based on the various potential crossovers) based on the sequencing data. The algorithm sums the likelihoods of each individual monosomy, disomy, or trisomy hypotheses (FIG. 29 step D), and calls the ploidy state with the maximum overall likelihood as the copy number and fetal fraction (FIG. 29 step E). Although laboratory researchers were not blinded to sample karyotype, the algorithm called the ploidy states without human intervention and was blind to the truth.
Data Interpretation
Graphical Representations of the Generated Data To determine the ploidy state of a chromosome of interest, the algorithm considers the distribution of sequence counts from each of two possible alleles at 3,000 to 4,000 SNPs per chromosome. It is important to note that the algorithm makes ploidy calls using an approach that does not lend itself to visualization. Thus, for the purposes of illustration, the data is displayed here in a simplified fashion as ratios of the two most likely alleles, labeled as A and B, so that the relevant trends can be more readily visualized. This simplified illustration does not take into account some of the features of the algorithm. For example, two important aspects of the algorithm that are not possible to illustrate with a method of visualization that displays allele ratios are: 1) the ability to leverage linkage disequilibrium, i.e. the influence that a measurement at one SNP has on the likely identity of a neighboring SNP, and 2) the use of non-Gaussian data models that describe the expected distribution of allele measurements at a SNP given platform characteristics and amplification biases. Also note that the algorithm only considers the two most common alleles at each SNP, ignoring other possible alleles.

The graphical representations in FIGS. 30, 30D-30H include samples for which two, one, or three fetal chromosomes are present. Generally, these indicate euploidy (FIG. 30) monosomy (FIG. 30D), and trisomy (FIGS. 30E-30H), respectively. In all plots, each spot represents a single SNP, where the targeted SNPs are plotted sequentially from left to right for one chromosome along the horizontal axes. The vertical axes indicate the number of reads for the A allele as a fraction of the total number of reads for both the A and B alleles for that SNP. Note that the measurements are made on total cfDNA isolated from maternal blood, and the cfDNA includes both maternal and fetal cfDNA; thus, each spot represents the combination of the fetal and maternal DNA contribution for that SNP. Therefore, increasing the proportion of maternal cfDNA from 0% to 100% will gradually shift some spots up or down within the plots, depending on the maternal and fetal genotype. This is described in more detail below with the corresponding plots.

If desired to facilitate visualization, the spots may be color-coded according to maternal genotype, as maternal genotype contributes more to the localization of each spot and the majority of trisomies are maternally-inherited; this assists in visualizing ploidy states. Specifically, SNPs for which the maternal genotype is AA may be indicated in red, those for which the maternal genotype is AB may be indicated in green, and those for which the maternal genotype is BB may be indicated in blue.

In all cases, SNPs that are homozygous for the A allele (AA) in both the mother and the fetus are found tightly associated with the upper limit of the plots, as the fraction of A allele reads is high because there should be no B alleles present. Conversely, SNPs that are homozygous for the B allele in both the mother and the fetus are found tightly associated with the lower limit of the plots, as the fraction of A allele reads is low because there should be only B alleles. The spots that are not tightly associated with the upper and lower limits of the plots represent SNPs for which the mother, the fetus, or both are heterozygous; these spots are useful for identifying fetal ploidy, but can also be informative for determining paternal versus maternal inheritance. These spots segregate based on both maternal and fetal genotypes and fetal fraction, and as such the precise position of each individual spot along the y-axis depends on both stoichiometry and fetal fraction. For example, loci where the mother is AA and the fetus is AB are expected to have a different fraction of A allele reads, and thus different positioning along the y-axis, depending on the fetal fraction.
Two Chromosomes Present FIG. 30 depict data that indicate the presence of two chromosomes when the sample is entirely maternal (no fetal cfDNA present, FIG. 30 (0% FF plot)), contains a moderate fetal cfDNA fraction (FIG. 30 (12% FF plot)), or contains a high fetal cfDNA fraction (FIG. 30 (26% FF plot)).

Figure 30:
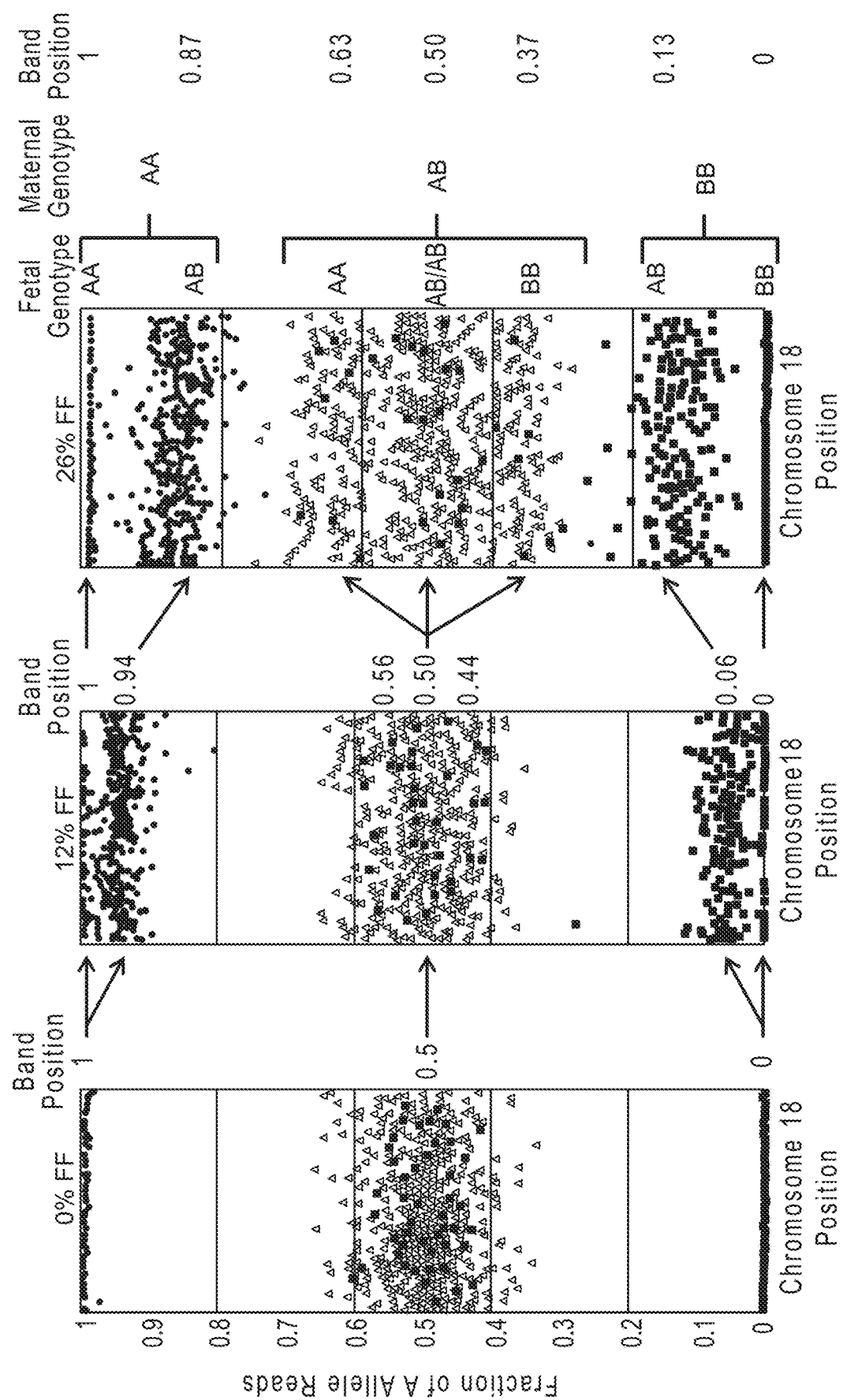
FIGS. 30, 30D-H: Typical graphical representations of euploidy (FIG. 30), monosomy (FIG. 30D), and trisomy (FIGS. 30E-30H). For all plots, the x-axis represents the linear position of the individual polymorphic loci along each chromosome (as indicated below the plots), and the y-axis represents the number of A allele reads as a fraction of the total (A+B) allele reads. Maternal and fetal genotypes, as well as the position on the y-axis around which the bands are centered, are indicated to the right of the plots. If desired to facilitate visualization, the plots may be color-coded according to maternal genotype, such that red (filled circles as shown in FIGS. 30, 30D-H) indicates a maternal genotype of AA, blue (filled squares as shown in FIGS. 30, 30D-H) indicates a maternal genotype of BB, and green (open triangles as shown in FIGS. 30, 30D-H) indicates a maternal genotype of AB. If desired, maternal allele contributions may be indicated in color in the "Fetal Genotype" column. Allele contributions are indicated as maternal|fetal, such that alleles for which the mother is AA and the fetus is AB are indicated as AA|AB.
Figure 30E:
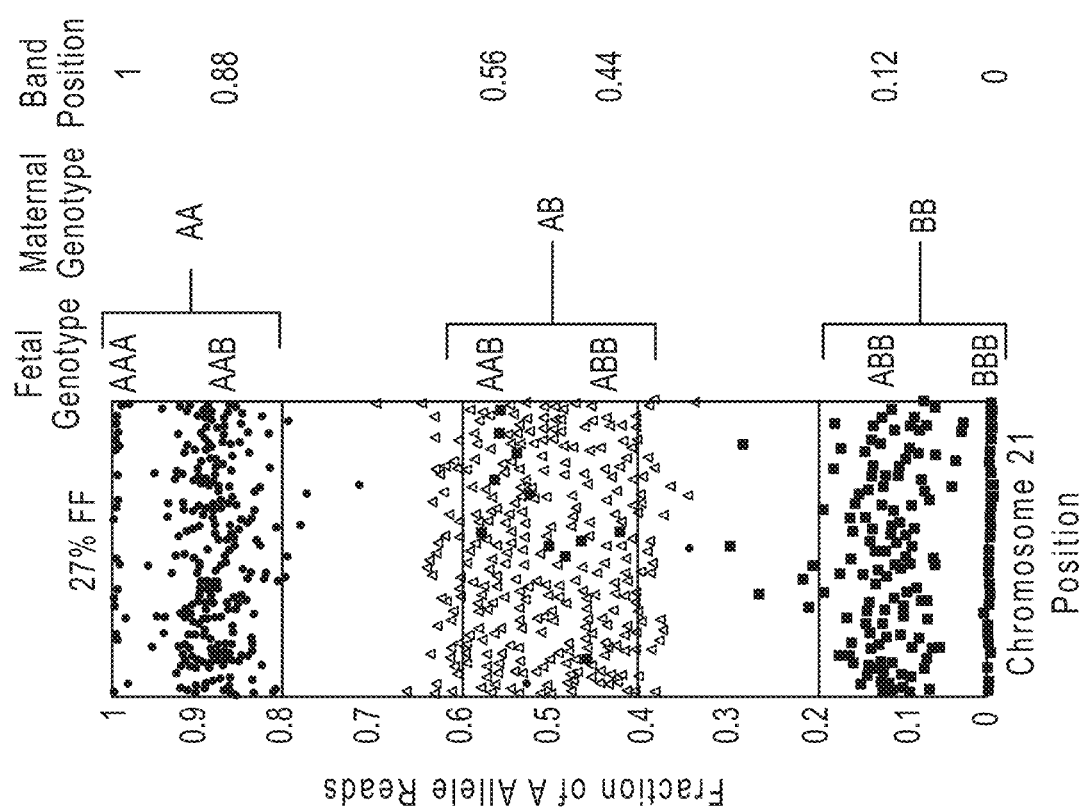

FIG. 30, 0% FF plot, shows data obtained from cfDNA isolated from the blood of a non-pregnant woman. When there is no fetal cfDNA present and the sample contains only maternal cfDNA, the plots represent purely the euploid maternal genotype; the hallmark pattern includes "clusters" of spots: a filled circle cluster tightly associated with the top of the plot (SNPs where the maternal genotype is AA), a filled square cluster tightly associated with the bottom of the plot (SNPs where the maternal genotype is BB), and a single, centered open triangle cluster (SNPs where the maternal genotype is AB).

When fetal cfDNA is present, the location of the spots shifts such that the clusters segregate into discrete "bands". Note that for samples with a fetal fraction of 0%, the groupings of spots are referred to as "clusters" (as in FIG. 30, 0% FF plot), and for all samples with a fetal fraction of >0%, the groupings of spots are referred to as "bands" (as in FIGS. 30 (12% FF plot), 30 (26% FF plot), 30D-30J). If the fetal fraction is high enough, these discrete bands will be readily visible. Specifically, FIG. 30 12% and 26% FF plots demonstrate the characteristic pattern associated with two fetal chromosomes present at moderate and high fetal fractions, respectively. This pattern includes three central open triangle bands that correspond to SNPs that are heterozygous in the mother, and two "peripheral" bands each at both the top (filled circles) and bottom (filled square) of the plots that correspond to SNPs that are homozygous in the mother.

FIG. 30, 12% FF plot, shows data obtained from cfDNA isolated from a plasma sample from a woman carrying a euploid fetus and with a 12% fetal cfDNA fraction. Here, the clusters of spots tightly associated with the top and bottom of the plot segregate into two discrete bands each: one filled circles and one filled square external peripheral band that remains tightly associated with the upper or lower limit of the plots, and one filled circle and one filled square internal peripheral band that has separated from the limits of the plots. These internal peripheral bands, centered around 0.92 and 0.08, represent SNPs for which the maternal genotype is AA and the fetal genotype is AB (indicated in filled circles), and SNPs for which the maternal genotype is BB and the fetal genotype is AB (indicated in filled square), respectively. The center cluster of open triangle spots broadens, but at this fetal fraction the segregation into distinct bands is not readily visible.

At a high fetal cfDNA fraction, the typical pattern that indicates the presence of two chromosomes (a trio of open triangle bands as well as two filled circles and two filled square peripheral bands) is readily apparent. FIG. 30, 26% FF plot, displays data obtained from a plasma sample from a woman carrying a euploid fetus at a fetal cfDNA fraction of 26%. Here, the peripheral bands have separated such that the internal band has shifted towards the center of the plot due to the altered levels of B alleles from the increased fetal cfDNA fraction. Significantly, at higher fetal fractions, the separation of the center open triangle cluster into three distinct bands is now readily apparent. This central trio of bands, in this case clustering around 0.37, 0.50 and 0.63, corresponds to those SNPs where the maternal genotype is AB, and the fetal genotype is AA (top), AB (middle) and BB (bottom).

Figure 30D:
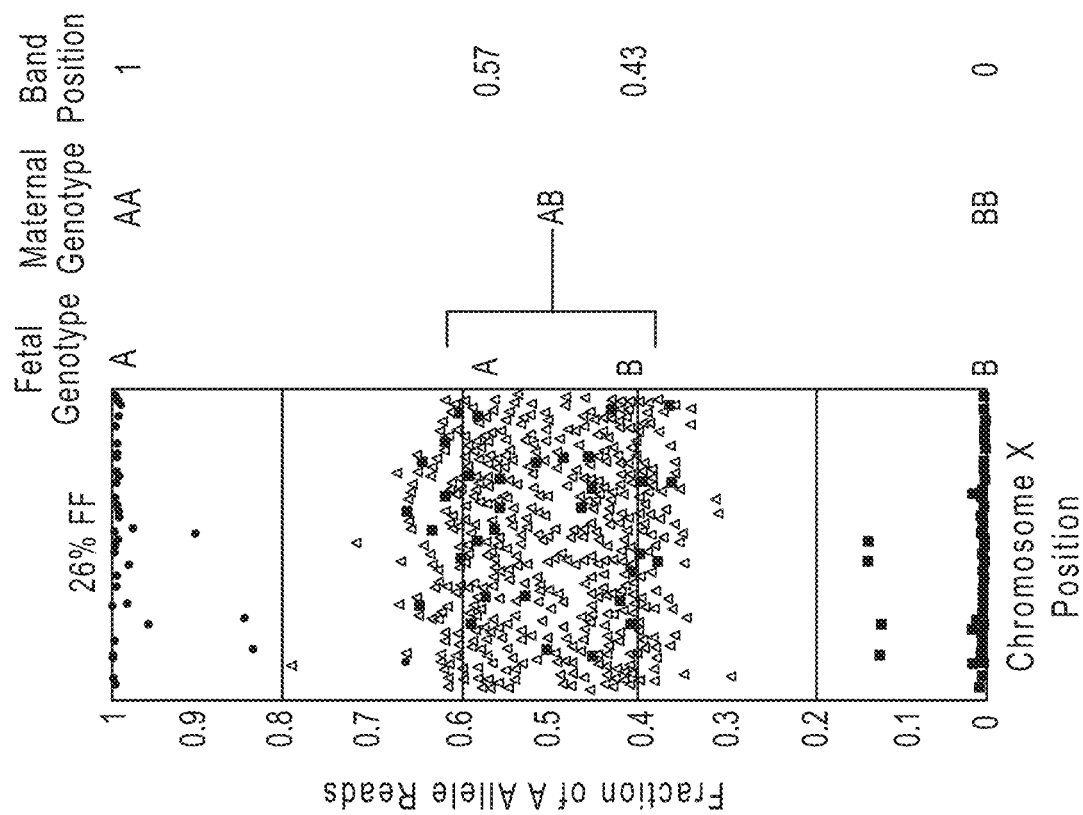
Figure 30G:
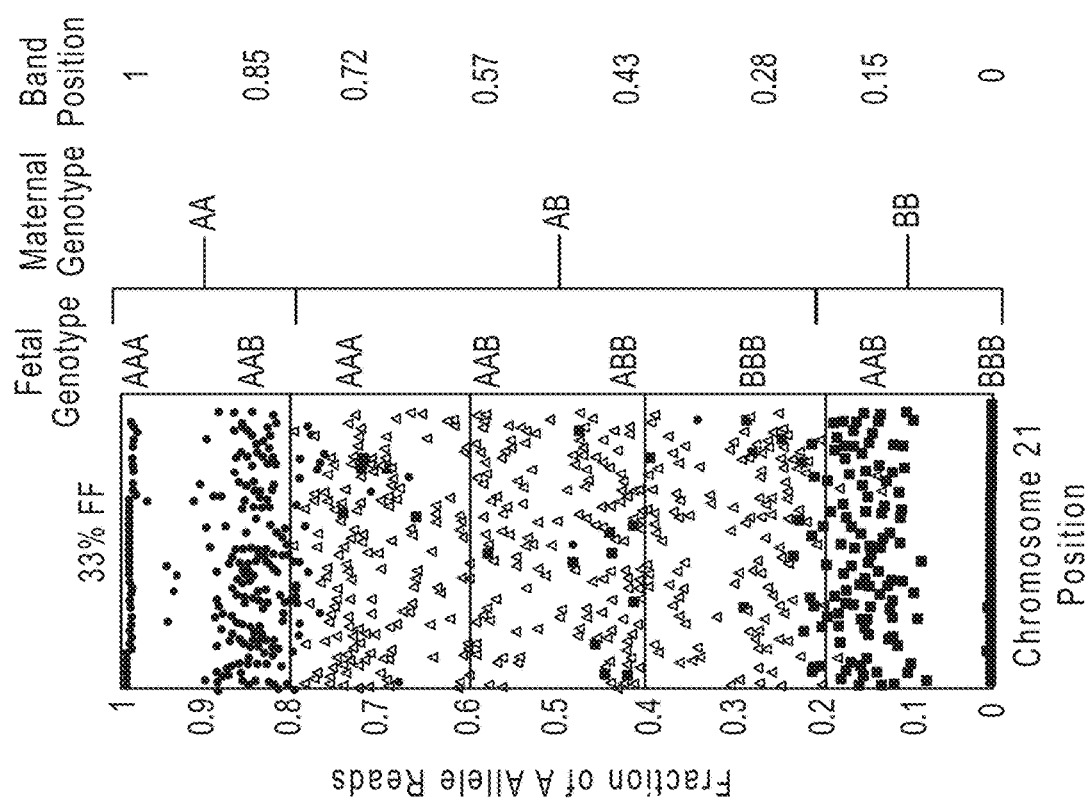
Figure 30F:
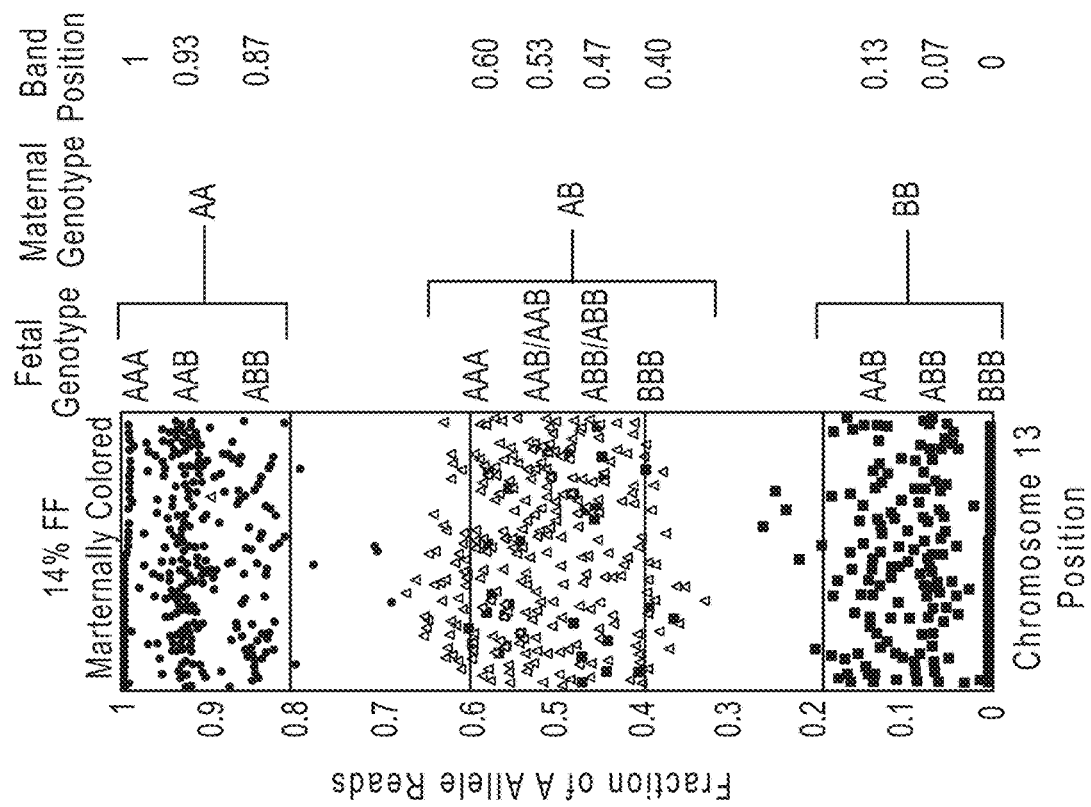
Figure 30H:
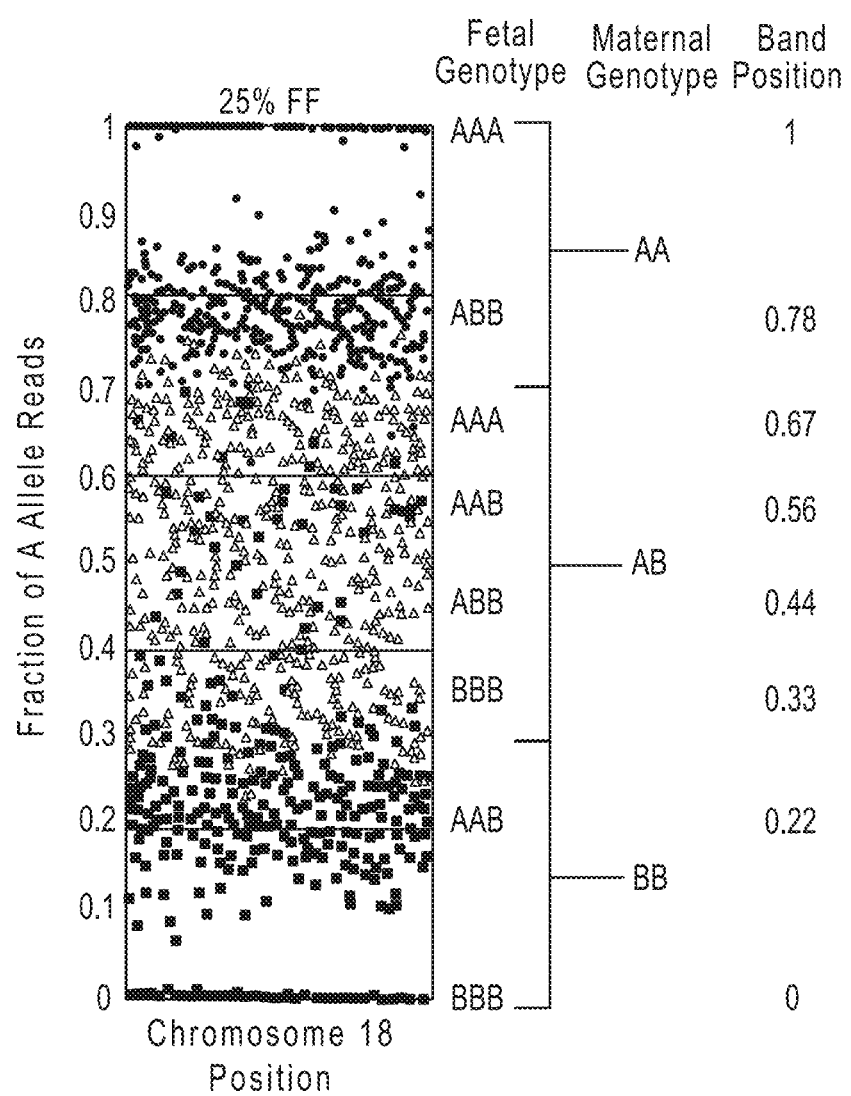

These hallmark patterns, namely three open triangle bands and four peripheral bands (two filled circles and two filled square), indicate the presence of two chromosomes, as in autosomal euploidy or for the X chromosome in a female (XX) fetus.
One Chromosome Present When the fetus only inherits a single chromosome, and thus only inherits a single allele, heterozygosity of the fetus is not possible. As such, the only possible fetal SNP identities are A or B. Thus, maternally-inherited monosomic chromosomes have a characteristic pattern of two central open triangle bands that represent SNPs for which the mother is heterozygous, and only have single peripheral filled circles and filled square bands that represent SNPs for which the mother is homozygous, and which remain tightly associated with the upper and lower limits of the plots (1 and 0), respectively (FIG. 30D). Note the absence of internal peripheral bands. This pattern indicates the presence of one chromosome, as in maternally-inherited autosomal monosomy, or for the X chromosome in a male (XY) fetus.
Three Chromosomes Present Trisomic chromosomes have three characteristic patterns. The first pattern indicates maternally-inherited meiotic trisomy, a meiotic error where the fetus inherited two homologous, non-identical chromosomes from the mother (FIG. 30E); this pattern includes two central open triangle bands with two each of the peripheral filled circles and filled square bands. The second pattern indicates paternally-inherited meiotic trisomy, where the fetus inherited two homologous, non-identical chromosomes from the father (FIG. 30F); this pattern includes four central open triangle bands and three each of the peripheral filled circles and filled square bands.

The third pattern indicates either maternally-(FIG. 30G) or paternally-inherited (FIG. 30H) mitotic trisomy, a mitotic error where the fetus inherited two identical chromosomes from either the mother or the father; this pattern includes four central open triangle bands with two each of the peripheral filled circles and filled square bands. Maternally- and paternally-inherited mitotic trisomies can be distinguished by the placement of the flanking filled circles and filled square bands, such that the filled circles and filled square internal peripheral bands (those not associated with the limits of the plots) are closer to the center in paternally-inherited mitotic trisomy. This is due to the paternal contribution of identical chromosomes. Note that our previous results indicate that at the blastomere stage, 66.7% of maternally-inherited trisomies are meiotic, and that only 10.2% of trisomies are paternally-inherited.

For the Y chromosome, the PS method considers a different set of hypotheses: zero, one, or two chromosomes present. As there is no maternal contribution to the sequence reads at each locus and because heterozygous loci are not possible (cases of two Y chromosomes necessarily involve two identical chromosomes), the bands remain tightly associated with the top (A alleles) or the bottom (B alleles) of the plot (data not shown), and analysis is greatly simplified, relying on quantitative allele count data. Note that since the method interrogates SNPs, it uses homologous non-recombinant SNPs from the Y chromosome, thus obtaining data on both X and Y for one probe pair.

Identifying Aneuploidies

Identification of autosomal aneuploidies using this plot-based visualization method is straightforward given a sufficient fetal fraction, and requires only identifying plots for which there are an abnormal number of chromosomes present, as described above. Combining the knowledge of copy number of the X and Y chromosomes identifies whether sex chromosome aneuploidies are present. Specifically, plots representing a fetus with a 47,XXX genotype will have a typical "three-chromosome" pattern, and plots representing a fetus with a 47,XXY genotype will have the typical "two-chromosome" pattern for the X chromosome, but will also have allele reads indicating the presence of one Y chromosome. The method is similarly able to call 47,XYY, where a "one chromosome" pattern indicates the presence of a single X chromosome, and allele reads indicate the presence of two Y chromosomes. A fetus with a 45,X genotype will have the typical "one-chromosome" pattern for the X chromosome, and data indicating zero Y chromosomes.

Effects of Fetal Fraction

As discussed above, the number of sequence reads from the fetus contributes to the precise location of each spot along the y-axis in the plots. As fetal fraction will affect the proportion of reads that originate from the fetus and the mother, it will also affect the positioning of each spot. At a high fraction of fetal cfDNA (generally above ~20%), as in FIGS. 30 (26% FF plot), 30D, 30E, 30G, and 30H, it is readily apparent that although the spots cluster based mainly on maternal genotype, the presence of fetal DNA from alleles whose genotype is distinct from the maternal genotype shift the clusters into multiple, distinct bands. However, as the fetal fraction decreases (as in FIGS. 30 (12% FF plot) and 30F), the spots regress towards the poles and center of the plot, resulting in tighter clusters. Specifically, the set of peripheral filled circles bands, where the maternal genotype is AA, regress towards the top of the plot; the set of peripheral filled square bands, where the maternal genotype is BB, regress towards the bottom; the set of central open triangle bands, where the mother is heterozygous, condense into a single cluster at the center of the plot (compare FIG. 30, 12% and 26% FF plots). Although aneuploidy is not readily apparent by eye using this visualization technique for low fetal fraction cases, the algorithm is able to identify ploidy states with a very low fetal fraction, such as 3% fetal fraction. It is able to do this because the statistical technique compares the observed data to very precise data models that predict the allele distributions for a given sample parameter set (including copy number, parental genotypes, and fetal fraction, for example). Data model precision is critical in low fetal fraction cases, as the differences between the allele distributions for different ploidy states are proportional to the fetal fraction. In addition, the algorithm is able to determine when a data set does not contain enough data to make a confident fetal ploidy determination.

Results

Figure 31A:
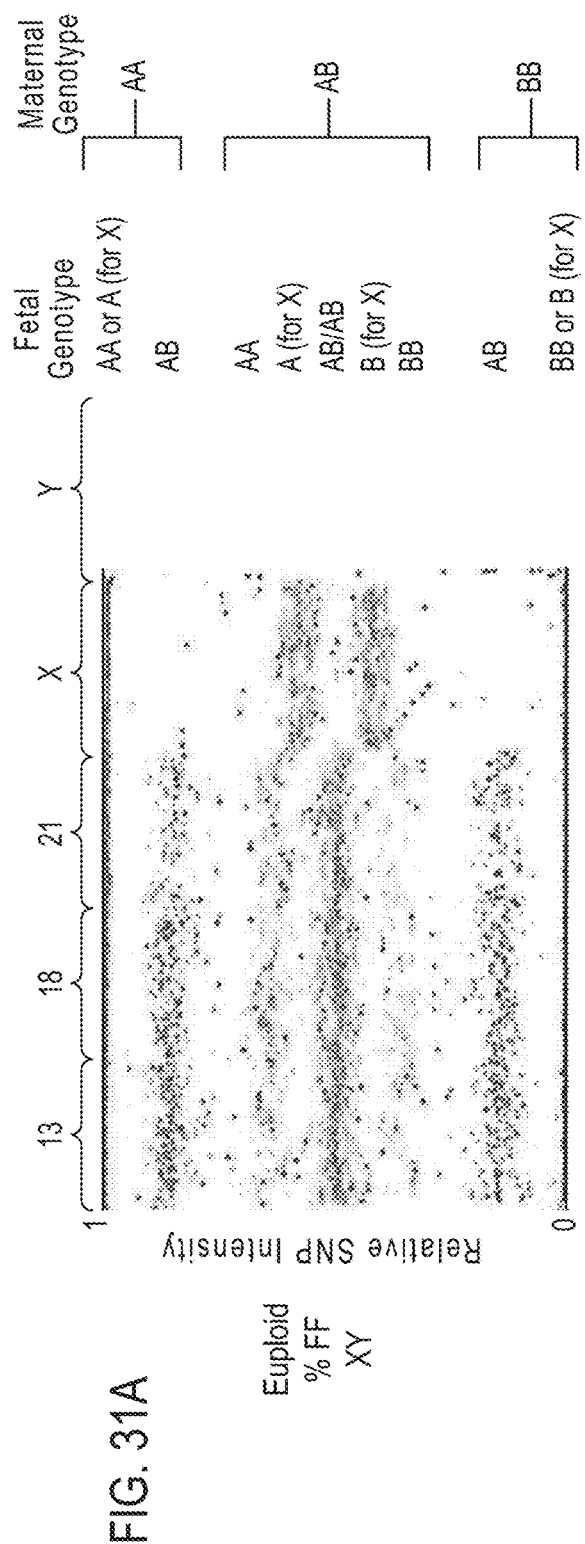
FIGS. 31A-31G: Graphical representations of (FIG. 31A) euploid, (FIG. 31B) T13, (FIG. 31C) T18, (FIG. 31D) T21, (FIG. 31E) 45,X, (FIG. 31F) 47,XXY, and (FIG. 31G) 47,XYY, test samples as indicated. Each chromosome is indicated at the top of the plot, fetal and maternal genotypes are indicated to the right of the plots, the x-axis represents the linear position of the SNPs along each chromosome, and the y-axis indicates the number of A allele reads as a fraction of the total reads. Note the altered cluster positioning based on fetal fraction, as described herein. Each spot represents a single SNP locus. Fetal and maternal genotypes are indicated to the right of the plot, and chromosome identities are indicated at the top of the plots.

Sequencing reads that mapped to targeted SNPs were deemed to be informative and were used by the algorithm. More than 95% of targeted loci were observed in the sequencing results. The plots for visualizing key ploidy calls are depicted in FIG. 31A-31G. FIG. 31A indicates a euploid sample. Here, chromosomes 13, 18, and 21 have the typical "two chromosome" pattern (as described herein). This includes a trio of center open triangle bands, and two filled circles and two filled square peripheral bands. This, together with the two center open triangle bands for the X chromosome and the presence of Y chromosome bands along the plots' peripheries, indicate a euploid XY genotype.

Figure 31B:
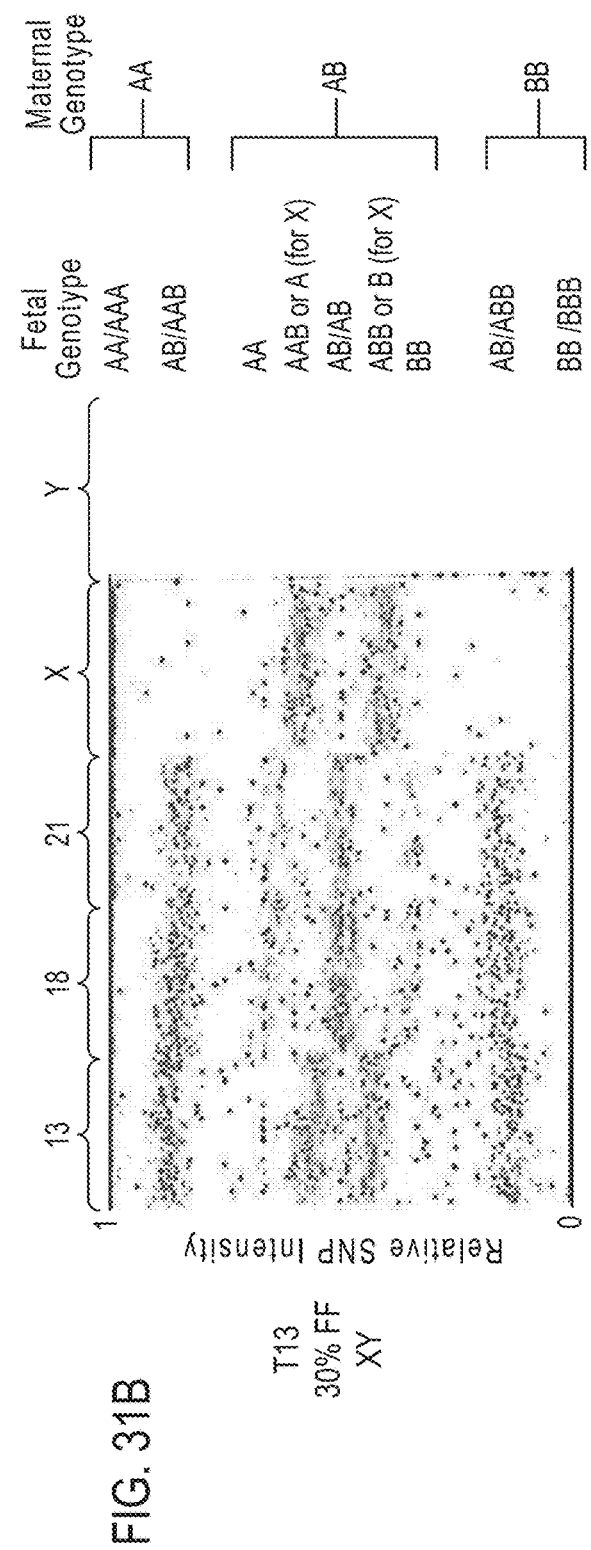
Figure 31C:
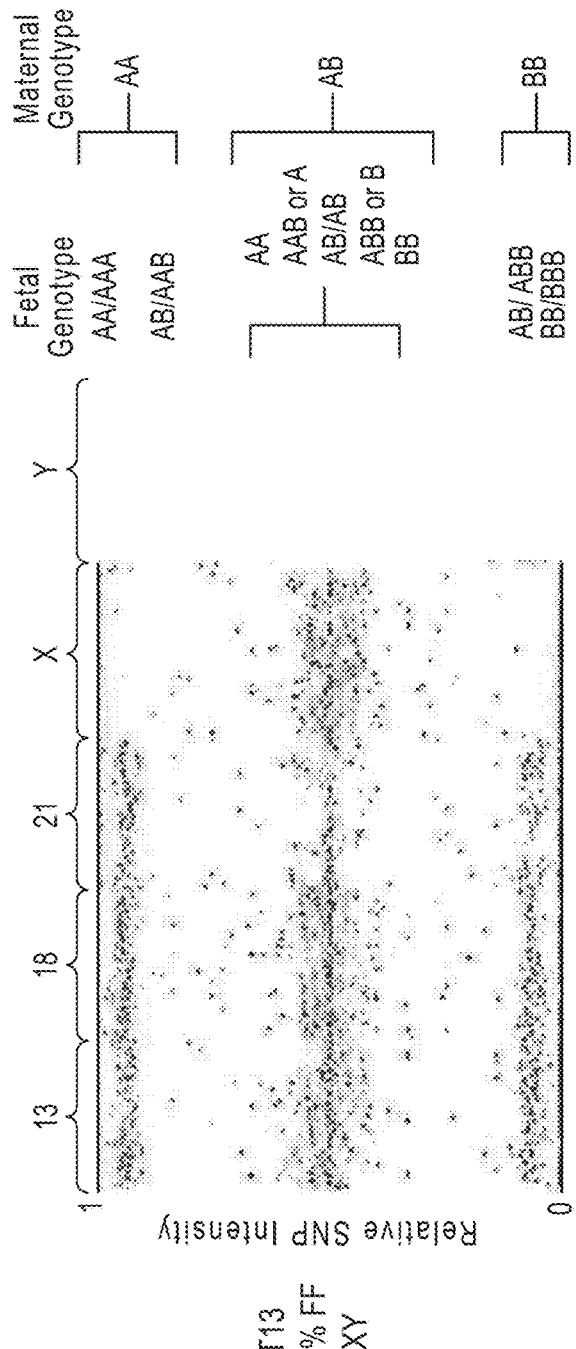
Figure 31D:
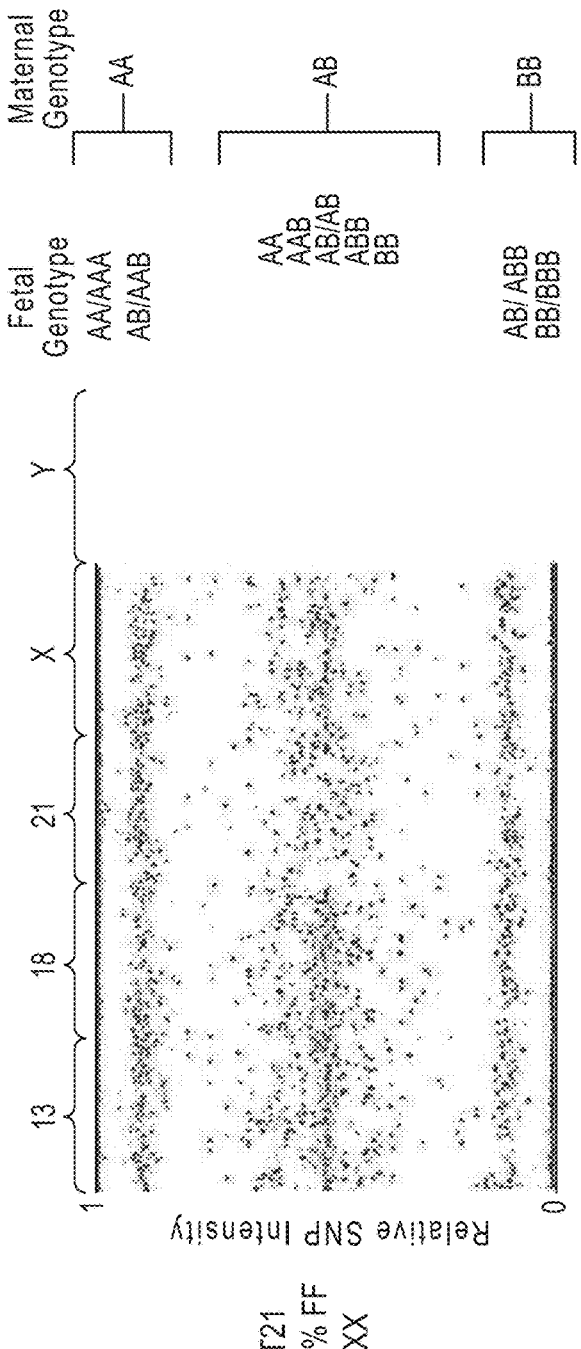
Figure 31E:
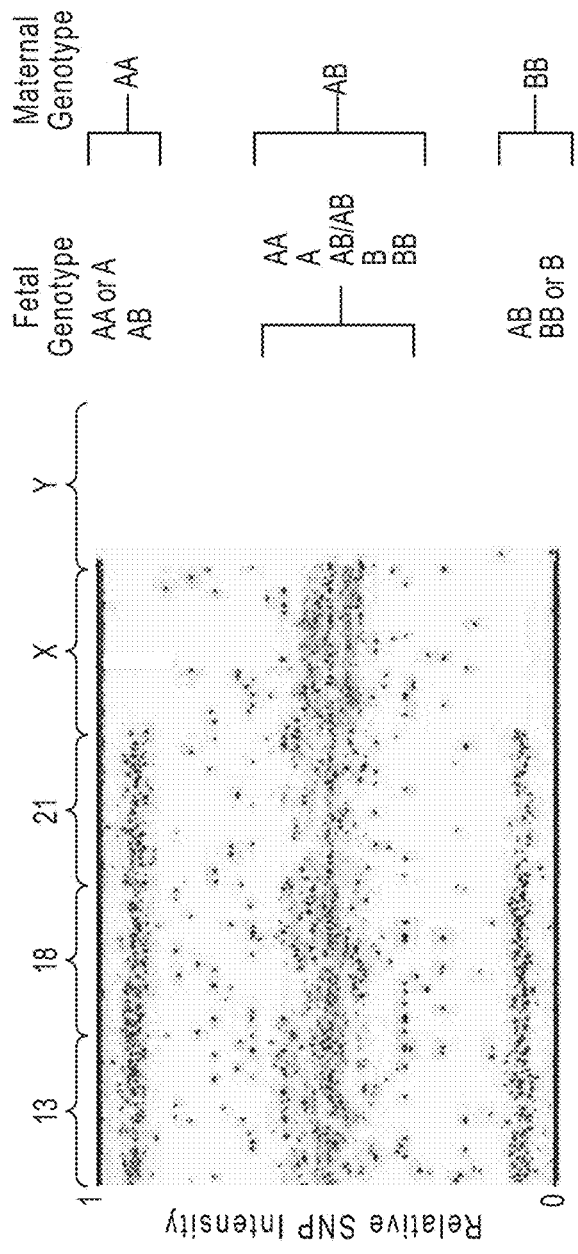
Figure 31F:
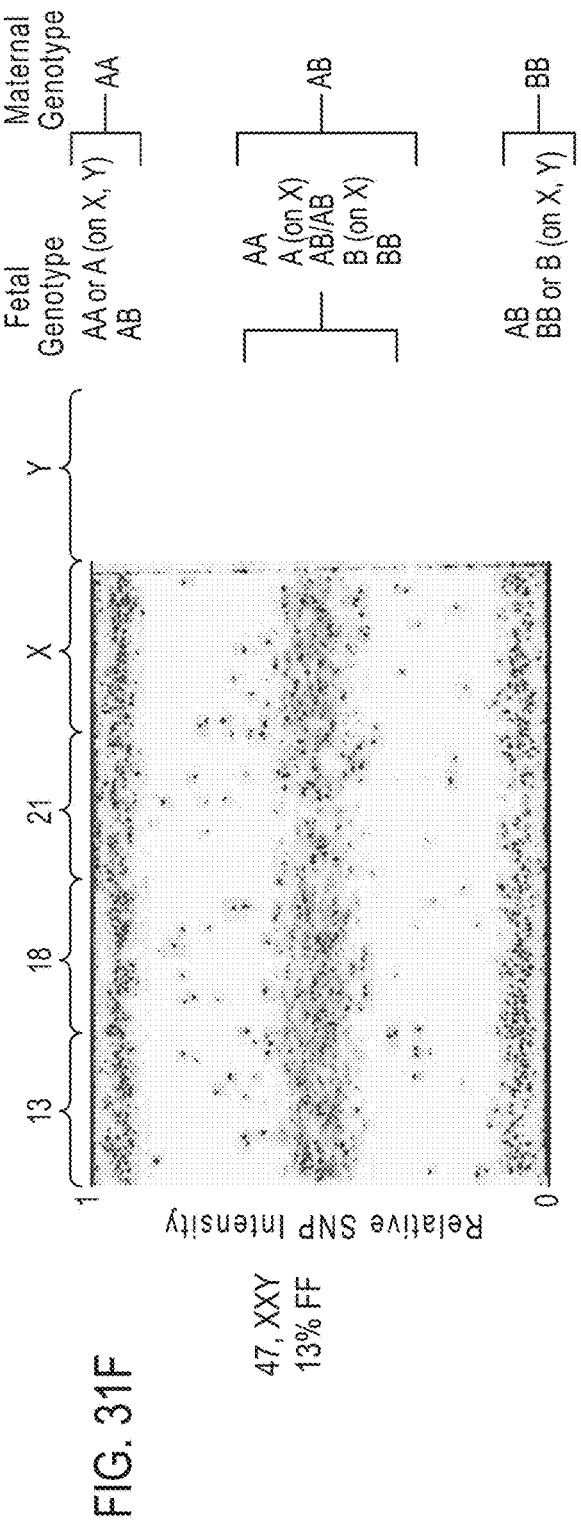

The most prevalent autosomal trisomies, T13, T18, and T21, are indicated by the plots in FIGS. 31B, 31C, and 31D, respectively. Specifically, FIG. 31B depicts a T13 sample. Here, chromosomes 18 and 21 display the typical "two chromosome" pattern, chromosome X displays the typical "one chromosome" pattern, and there are reads from the Y chromosome. Together, this indicates disomy at chromosomes 18 and 21, and identifies a fetal XY genotype. However, chromosome 13 depicts a typical "three chromosome" pattern-specifically. Similarly, FIG. 31C depicts a T18 sample, and FIG. 31D depicts a T21 sample.

Figure 31G:
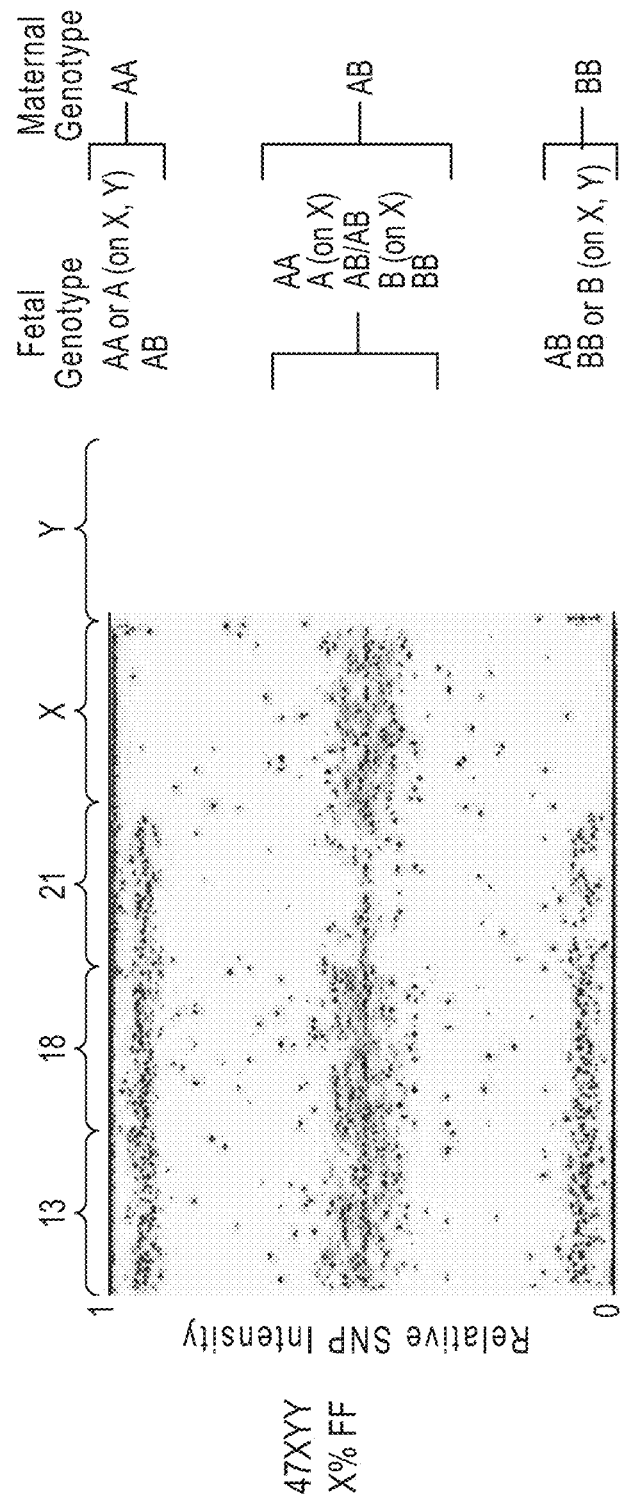

The method is also able to detect sex chromosome aneuploidies, including 45,X (FIG. 31E), 47,XXY (FIG. 31F), and 47,XYY (FIG. 31G). Note that the method is calling copy number at chromosomes 13, 18, 21, X, and Y; the overall chromosome number is reported assuming disomy at the remaining chromosomes. The X chromosome regions of the plot depicting a 45,X sample reveals the presence of a single chromosome. However, the lack of reads from the Y chromosome, coupled with the "two chromosome" pattern for chromosomes 13, 18, and 21, indicate a 45,X genotype. Conversely, the 47,XXY samples generate a plot revealing the presence of two X chromosomes. The data also revealed reads for alleles from the Y chromosome. Together with the presence of two copies of chromosomes 13, 18, and 21, this indicates a 47,XXY genotype. A 47,XYY genotype is indicated by the presence of a "one chromosome" pattern for the X chromosome, and reads indicating the presence of two Y chromosomes.

Discussion

This method detected T13, T18, T21, 45,X, 47,XXY, and 47,XYY non-invasively from maternal blood. This method interrogates cfDNA from maternal plasma by targeted multiplex PCR amplification and high-throughput sequencing of 19,488 SNPs. This, coupled with the method's sophisticated informatics analyses that take into account parental genotypic information and numerous sample parameters, including fetal fraction and DNA quality, more robustly detects the fetal signal and makes highly accurate ploidy calls at all of the five chromosomes implicated in the seven most common types of at-birth aneuploidy (T13, T18, T21, 45,X, 47,XXX, 47,XXY, and 47,XYY). This method offers a number of clinical advantages over previous methods, including and most significantly greater clinical coverage and sample-specific calculated accuracies (analogous to a personalized risk score).

Increased Clinical Coverage

This method offers approximately a two-fold increase in aneuploidy coverage compared to clinically available NIPT methodologies, given its ability to accurately detect autosomal trisomies and sex chromosome aneuploidies. The method presented here is the only noninvasive test that calls ploidy at the sex chromosomes with high accuracy. Prior DNA mixing experiments and separate plasma samples analyzed in our experimental assays suggest that this method will detect a larger cohort of sex chromosome anomalies, including 47,XXX. The method presented here also detects aneuploidies at chromosomes 13, 18, and 21 with high sensitivities and specificities, and with appropriate primer design is expected to be able to detect copy number at the remaining chromosomes as well.

Sample-Specific Calculated Accuracies

Significantly, this method calculates a sample-specific accuracy for ploidy calls on each chromosome in each sample. Accuracies calculated by this method are expected to significantly lower the rate of incorrect calls by identifying and flagging individual samples that have poor quality DNA or low fetal fractions that are likely to result in a poor accuracy test result. By contrast, massively parallel shotgun sequencing (MPSS)-based methods produce a positive or negative call using a single-hypothesis rejection test, and their accuracy estimate is based on a published study cohort rather than on the characteristics of the individual sample, which are assumed to have the same accuracy as the cohort. However, individual accuracies for samples with parameters in the tail of the cohort distribution may differ significantly. This is exacerbated at low fetal fractions, as in early gestational age, or for samples with low DNA quality. These samples are generally not identified and flagged for follow-up, which can result in missed calls. The present method, however, takes into account many parameters, including fetal fraction and a number of DNA quality metrics, to make each chromosome copy number call, calculating a sample-specific accuracy for that call. This allows the method to identify individual samples with low accuracy and flag them for follow-up. This is expected to nearly eliminate missed calls, especially at the early stages of pregnancy when fetal fractions are typically low. The presumption is that a no call is much preferred to a missed call, since a no call simply requires a redraw and reanalysis.

Converting Calculated Accuracies to Traditional Risk Scores

This method can offer an adjusted risk of aneuploidy for high-risk pregnant women, where the adjusted risk takes into account an a priori risk (Benn P, Cuckle H, Pergament E. Non-invasive prenatal diagnosis for Down syndrome: the paradigm will shift, but slowly. Ultrasound Obstet Gynecol 2012; 39:127-130, which is hereby incorporated by reference in its entirety). Although the present method offers each patient a customized calculated accuracy, for clinical use these accuracies can be converted to traditional risk scores, which also denote the risk of an aneuploid pregnancy but are expressed as fractions. Traditional risk scores take into account various parameters, including maternal age-related risk and serum levels of biochemical markers, to offer a risk score above which a mother is considered high-risk and for whom follow-up invasive diagnostic procedures are recommended. This method significantly refines this risk score, thus reducing both the false positive and false negative rates, and offering a more accurate assessment of individual maternal risk. A calculated accuracy as used here is the likelihood that the ploidy call is correct, and is expressed as a percentage, but the calculated accuracies used in Experiment 19 do not include an age-related risk. Because calculation of a risk score typically includes an age-related risk, the calculated accuracies and traditional risk scores are not interchangeable; they must be combined to convert into a traditional risk score. The formula to combine the age-related risk with the calculated accuracy is:

$$\frac{R_1 R_2}{R_1 R_2 + [1 - R_1][1 - R_2]}$$

where $R_1$ is the risk score as calculated by the present method and $R_2$ is the risk score as calculated by first trimester screening.

SNP-Based Methods Negate Issues with Amplification Variation

An inherent drawback to the counting methods used by some other methods is that they determine fetal ploidy state by measuring the ratio of the number of reads mapping to the chromosome of interest (e.g., chromosome 21) to those mapping to a reference chromosome. Chromosomes with high or low GC content, including chromosomes 13, X, and Y, amplify with high variability. This can result in signal variation that is comparable in magnitude to the fetal cfDNA signal, which can confound copy number calls by altering the ratio of allele reads from the chromosome-of-interest to those from the reference chromosome. This can result in low accuracy for chromosomes 13, X, and Y. Significantly, this problem is exacerbated at low fetal cfDNA fractions, as tends to be the case at early gestational ages.

In contrast, SNP-based methods do not rely on consistent amplification levels between chromosomes, and are thus expected to provide results that are equally accurate across all chromosomes. Because the present method looks, in part, at relative counts of different alleles at polymorphic loci, which by definition differ only by a single nucleotide, it does not require the use of reference chromosomes, and this obviates the problems with chromosome-to-chromosome amplification variation that are inherent to methods that rely on quantitating read counts. Unlike quantitative methods that require reference chromosomes that are euploid, the present method is expected to be able to detect triploidy as well as copy-number neutral anomalies like uniparental disomy.

The Importance of Early Detection

Figure 32:
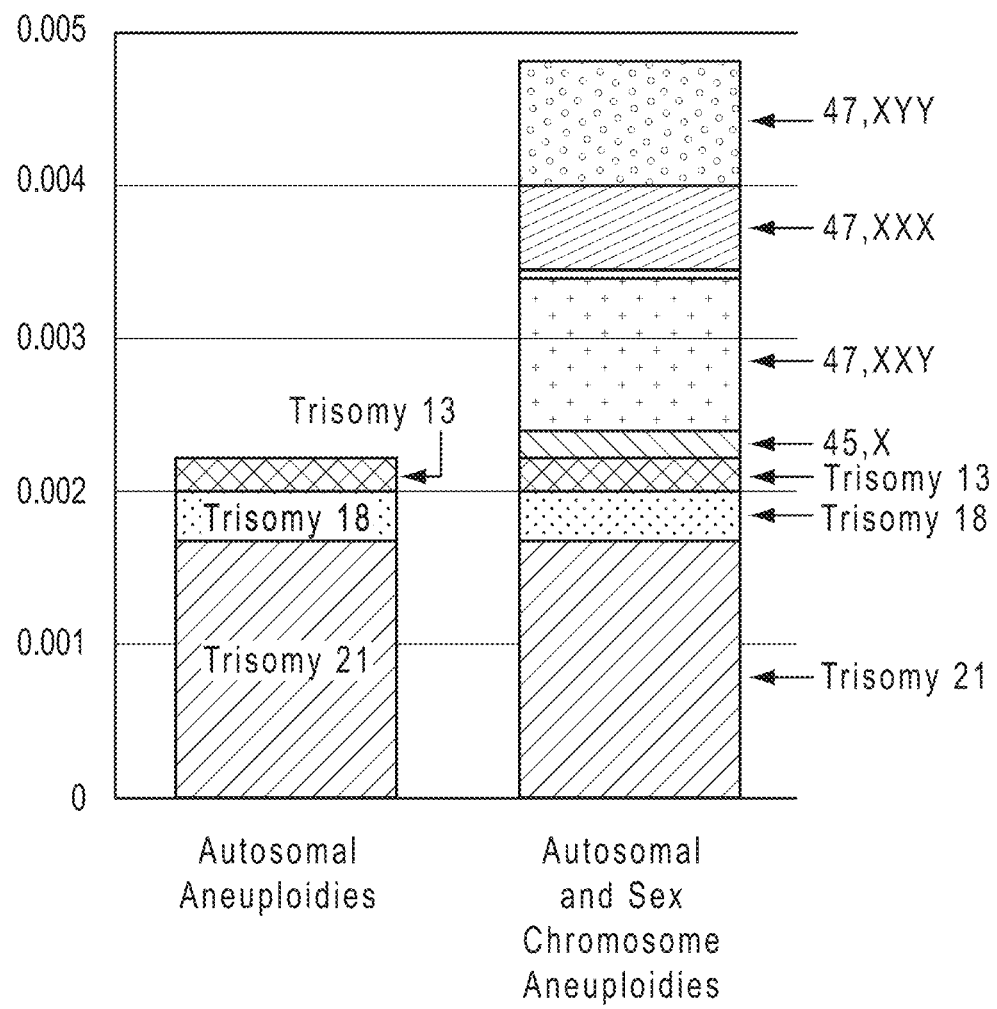
FIG. 32: The combined at-birth prevalence of sex chromosome aneuploidies is greater than that of autosomal aneuploidies.

Significantly, the combined at-birth prevalence of sex chromosome aneuploidies is higher than that of the most common autosomal aneuploidies (FIG. 32). However, there are currently no routine non-invasive screening methods that reliably detect sex chromosome abnormalities. Thus, sex chromosome anomalies are generally detected prenatally as a side-effect of routine testing for Down syndrome or other autosomal aneuploidies; a large proportion of cases are missed entirely. Early and accurate detection is crucial for many of these disorders where early therapeutic intervention improves clinical outcomes. For example, Turner syndrome is often not diagnosed until adolescence, although its overall at-birth prevalence is 1 in 2,500 females. Growth hormone therapy is known to prevent short stature that results from the disorder, but treatments are significantly more effective when initiated prior to the age of 4. Additionally, estrogen replacement therapy can stimulate secondary sexual characteristics in patients with Turner syndrome, but again therapy must be initiated in the pre-teen years, before the syndrome is usually detected. Together, this underscores the importance of early, routine, and safe detection of sex chromosome aneuploidies. This method offers the first approach with the potential to serve as a routine screen for sex chromosome anomalies.

Example 20

The following experiment illustrates an exemplary method for designing and selecting primers that can be used in any of the multiplexed PCR methods of the invention. In some embodiments, primers from an initial library of candidate primers are selected so that they can be used to simultaneously amplify a large number of target loci (or a subset of target loci) in a single reaction. In some embodiments, primers from an initial library of candidate primers are selected to form multiple primer pools such that each pool can be used to simultaneously amplify a subset of target loci in a single reaction. Preferably, primers are designed and selected for a large portion or all of the most desirable target loci. Preferably, the minimum number of pools needed to amplify the target loci are created.

Step 1

Calculate a first score for each primer pair design using one or more of the following parameters: number of SNPs within the primers, location of SNPs within the primers, distance from an end of the amplicon to the target bases within the amplicon, number of target loci in an amplicon, heterozygosity rate of the target locus, disease prevalence associated with a sequence (e.g., a polymorphism) at the target locus, disease penetrance associated with a sequence (e.g., a polymorphism) at the target locus, specificity of the candidate primer for the target locus, size of the candidate primer, melting temperature of the candidate primer, melting temperature of the target amplicon, GC content of the target amplicon, GC content of the 3' end of the candidate primer, homopolymer length in the candidate primer, amplification efficiency of the target amplicon, and size of the target amplicon.

Step 2

Compare each primer pair to every other primer pair, and calculate a second score for the pair using one or more of the following parameters: likelihood of dimer formation, amplicon overlap, number of primer designs for a particular target locus, and distance between amplicons. In some embodiments, the score is infinite if amplicons overlap so that two different primer pairs that generate overlapping amplicons are not included in the same primer pool.

Step 3

Aggregate the first score and the second score together (such as by using a weighted average of the scores).

Step 4

If desired, order all target loci into one contiguous list based upon their genomic location in ascending order.

Step 5

Build a minimum priority queue data structure that prioritizes the pairs of designs (in which each design is one primer pair so that a pair of designs includes two primer pairs with a total of 4 primers) based on their score (such as the aggregate score from step 3). In some embodiments, the score for a pair of designs is the worse score (such as the worse aggregate score from step 3) out of the scores for all 4 primers in the pair of designs. The pair of designs with the best (most desirable) score is first in the queue, and the pair of designs with the worst (least desirable) score is last in the queue. If desired, pairs of designs with a score above a threshold (least desirable) are removed from the library of candidate primers such that they are not included in the final pool(s) (for example, these primers may be omitted from the queue). In some embodiments, pairs of design with an interaction score above (worse than) 20, 18, 16, 14, 12, 10, 9, 8, 7, 6, 5, 4, 3, 2, or 1 kcal/mol are removed from the library of candidate primers. In some embodiments, pairs of design with a ΔG value below (worse than) −20, −18, −16, −14, −12, −10, −9, −8, −7, −6, −5, −4, −3, −2, or −1 kcal/mol are removed from the library of candidate primers.

Each design pair can be stored as a node of a doubly linked list with initial "next" and "previous" pointers set to NULL.

Step 6

Begin forming all pools simultaneously by doing the following steps. Take the design pair with the best (most desirable) score from the priority queue and add it to "the potential pools." Begin storing designs in N number of doubly linked list data structures with the design pairs. N represents the current number of different primer pools. Initially, N=1, since there is only one primer pool. In some embodiments, a second pool is only created if necessary to include the desired target loci or the desired level of coverage of target loci. Check to see if the design pair removed from the queue is "connected" to any other existing design pair. By "connected" for purposes of this step is meant that a single design in one pair is the same as a single design in another pair. If two pairs are connected, then assign the appropriate next and previous pointers to one another. If two pairs are not connected, then add them to the "potential pools" In some embodiments, a design pair is only placed in a particular pool if it would be connected to at most two other design pairs in that pool (otherwise it can be assigned to a different pool).

Check to see if (i) any linked list spans from the first target to the last target (such that all the desired target loci are included) or (ii) if a pool meets the cutoff for the desired minimum pool level. If it does, that list now forms a pool and can be added to the "final pools" list.

Step 7

If desired, check to see if the desired level of coverage (such as all the bases in the target loci being included in amplicons from 4 different primer pairs) that is desired for each location. Repeat step 6 until achieving the desired level of coverage.

The resulting primer pool(s) can be used in any of the methods of the invention.

Example 21

The following Example illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Each pool is used to simultaneously amplify a large number of target loci (or a subset of target loci) in a single reaction volume. Preferably, primers are designed and selected for a large portion of the most desirable target loci or for all of the target loci. A set of candidate target loci can be selected as described in Examples 16 or 20 based on the particular polymorphisms or mutations of interest. In some embodiments, one or more of the following type of target loci are included: SNPs, short indels, long indels, exons, and combinations thereof. In some embodiments for target loci that are short indels, the PCR primer or primer pair targets a sequence of adjacent base pairs; and the indel is completely covered by one sequencing read. In some embodiments for target loci that are large indels, two primer pairs are used to target a pair of breakpoints at the boundaries of the indel. In this case, the two primer pairs are designed such that when the deletion is present there is a PCR product and the two primer pairs are selected together for inclusion in the same pool (the four primers are treated by the algorithm as a single assay rather than two assays). In some embodiments for target loci that are exons, a set of primers pairs are designed to tile the full exon.

For each candidate locus, one or more PCR primer pairs are designed using the Primer3 program (available at the worldwide web at primer3.sourceforge.net; libprimer3 release 2.2.3, which is hereby incorporated by reference in its entirety). If there are no feasible designs for PCR primers for a particular target locus, then that target locus is eliminated from further consideration. In some embodiments, each target base is covered by at least two independent PCR assays (such as two independent primer pairs that will amplify the target base) and preferably by four assays, although not all of the available assays for a target must be used. In some embodiments, no targets are omitted. Desirably, the algorithm produces as few pools as possible but may produce more than one pool. In some embodiments, two different primer pairs that are in close proximity in the genome (such as within 2 kbases or 1 kbase) and whose forward primers are on the same strand are not be assigned to the same pool. This constraint avoids primer interference in the extension-and-ligation amplification method In some embodiments in which the PCR will be performed using a polymerase with low 5'→3' exonuclease and/or low strand displacement activity, different primer pairs that are in close proximity in the genome and whose forward primers are on the same strand can be assigned to the same pool since the with low 5'→3' exonuclease and/or low strand displacement activity of the polymerase will reduce or prevent primer interference and allow nearby or adjacent amplicons to be produced.

Step 1

Build an interaction graph. Each node represents one assay (such as one primer pair). Each edge represents a conflict between two assays. There are three types. Interaction edges represent a potential primer dimer and have a score indicating the interaction strength. Proximity edges represent physical proximity of the primer binding sites which may result in interference. Target edges represent redundant designs associated with the same target (a special case of a proximity edge).

Step 2

Select an initial value for the maximum interaction score (e.g., 95% of the maximum score).

Step 3

Compute a score such as a utility score for each assay as follows using steps 3A and 3B.

Step 3A

Calculate a score for each assay based on one or more of its intrinsic characteristics. For example, favor assays with amplicons close to the optimal length (such as 300 bp); favor assays with a shorter distance from the beginning of the amplicon to the target; and/or penalize assays with primers overlapping known SNPs. Any other parameter, such as the parameters disclosed herein can also be included.

Step 3B

Multiply the score for each assay by a factor that varies from 0 to 1 according to the current coverage of the assay's target bases. This factor gives lower weight to targets that are already covered by assays. At the beginning of the algorithm this factor is 1 for all assays because none have been covered. Calculate the factor as follows. For each base in the target, compute a coverage score as $1/(2^c)$ where c is the number of previously-selected assays (in other pools) that cover that base. For instance, if three assays cover the base then the coverage score is $1/(2^3)=0.125$. The factor for the target is the maximum value of the coverage score for all bases in the target. For instance, if the target contains 10 bases, 3 bases are covered by 1 target, and 7 bases are covered by 3 targets, then the factor is MAX $(1/(2^1), 1/(2^3))=0.5$. The score in step 3A is then multiplied by this factor.

Step 4

Use a single iteration of the algorithm in Example 16 to design a pool given the current maximum interaction score: Construct a new graph with the assays that have not been assigned to a pool yet and with the edges that have weights exceeding the maximum interaction score. Remove nodes (assays) according to the algorithm in Example 16 until there are no edges left. The assay utility scores come from step 3 in this Example rather than the calculation used for Example 16.

Step 5

Save the assays selected in step 4 as a new pool and remove them from consideration. Then repeat steps 3 and 4 with the remaining assays, and iterate until all targets have sufficient coverage.

Step 6

If desired, evaluate the result. If the total number of pools meets the design goal then reduce the maximum interaction score; otherwise increase the maximum interaction score. Then go back to step 3. Iterate, using a binary search strategy to find the lowest maximum interaction score that produces the desired number of pools.

Step 7

Output the pools from the final iteration. After the selection process, the primers remaining in the pools may be used in any of the methods of the invention.

Example 22

The following Example illustrates an exemplary method for designing and selecting primers that can be used in any of the multiplexed PCR methods of the invention. In some embodiments, the primers are divided into different pools (e.g., 2, 3, 4, 5, 6, or more different pools) such that each pool is used to amplify target loci in a different reaction volume. Any of the embodiments listed in Example 21 can be used for this Example as well.

This method uses a graph coloring algorithm.

Step 1

Select 2, 3 or 4 of the best assays (such as primer pairs) for each target locus from all of the available assays.

Step 2

Select an initial maximum interaction score.

Step 3

Build an interaction graph containing only edges that exceed the maximum interaction score.

Step 4

Color the graph such that no adjacent nodes have the same color (this is a standard problem with many heuristic solutions). Each color represents a different pool.

Step 5

Go back to step 3 and iterate, refining the maximum interaction score until the desired number of pools is achieved. In some embodiments, after the primers are selected in step 1, the algorithm assumes all assays must be included in a pool.

After the primers are divided into different pools, the pools may be used in any of the methods of the invention.

Example 23

This example illustrates there exemplary methods for calculating the limit of detection for any of the methods of the invention. These methods were used to calculate the limit of detection for single nucleotide variants (SNVs) in a tumor biopsy (FIG. 38) and a plasma sample (FIG. 39).

The first method (denoted "LOD-mr5" in FIGS. 38 and 39) calculates the limit of detection based on a minimum of 5 reads being chosen as the minimum number of times a SNV is observed in the sequencing data to have sufficient confidence the SNV is actually present. The limit of detection is based on whether the observed the depth of read (DOR) is above this minimum of 5. The thin lines (LOD-z5.0) in FIGS. 38 and 39 indicate SNVs for which the limit of detection is limited by the DOR. In these cases, not enough reads were measured to reach the error limit of the assay. If desired, the limit of detection can be improved (resulting in a lower numerical value) for these SNVs by increasing the DOR.

The second method (denoted "LOD-zs5.0" in FIGS. 38 and 39) calculates the limit of detection based on the z-score. The Z-score is the number of standard deviations an observed error percentage is away from the background mean error. If desired, outliers can be removed and the z-score can be recalculated and this process can be repeated. The final weighted mean and the standard deviation of the error rate are used to calculate the z-score. The mean is weighted by the DOR since the accuracy is higher when the DOR is higher.

For the exemplary z-score calculation used for this example, the background mean error and standard deviation were calculated from all the other samples of the same sequencing run weighted by their depth of read, for each genomic loci and substitution type. Samples were not considered in the background distribution if they were 5 standard deviations away from the background mean. The dashed lines in FIGS. 38 and 39 indicate SNVs for which the limit of detection is limited by the error rate. For these SNV's enough reads were taken to reach the 5 read minimum, and the limit of detection was limited by the error rate. If desired, the limit of detection can be improved by optimizing the assay to reduce the error rate.

The third method (denoted "LOD-zs5.0-mr5" in FIGS. 38 and 39) calculates the limit of detection based on the maximum value of the above two metrics.

Figure 38:
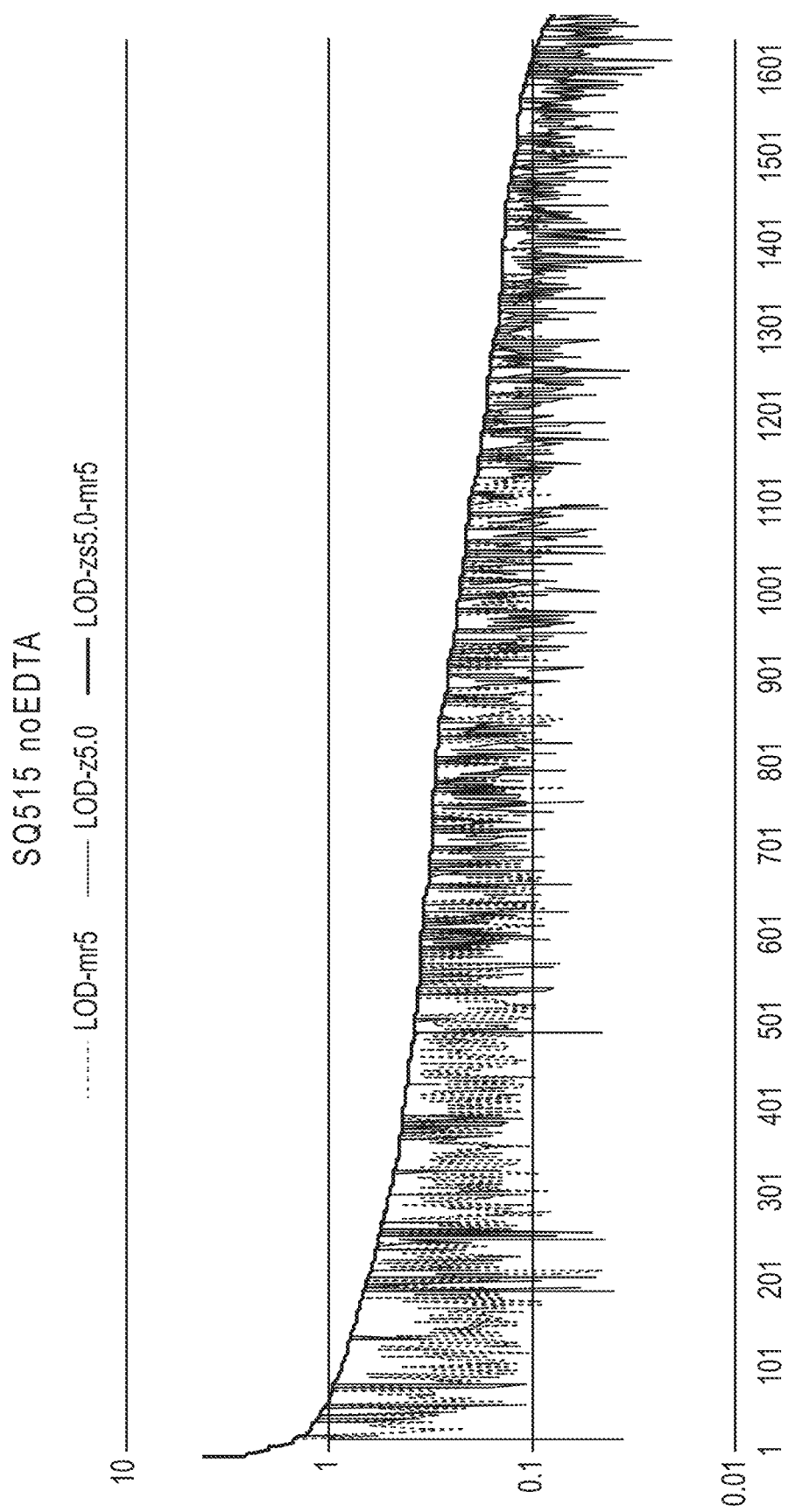
FIG. 38 is a graph showing the limit of detection for single nucleotide variants in a tumor biopsy using three different methods described in Example 23.
Figure 39:
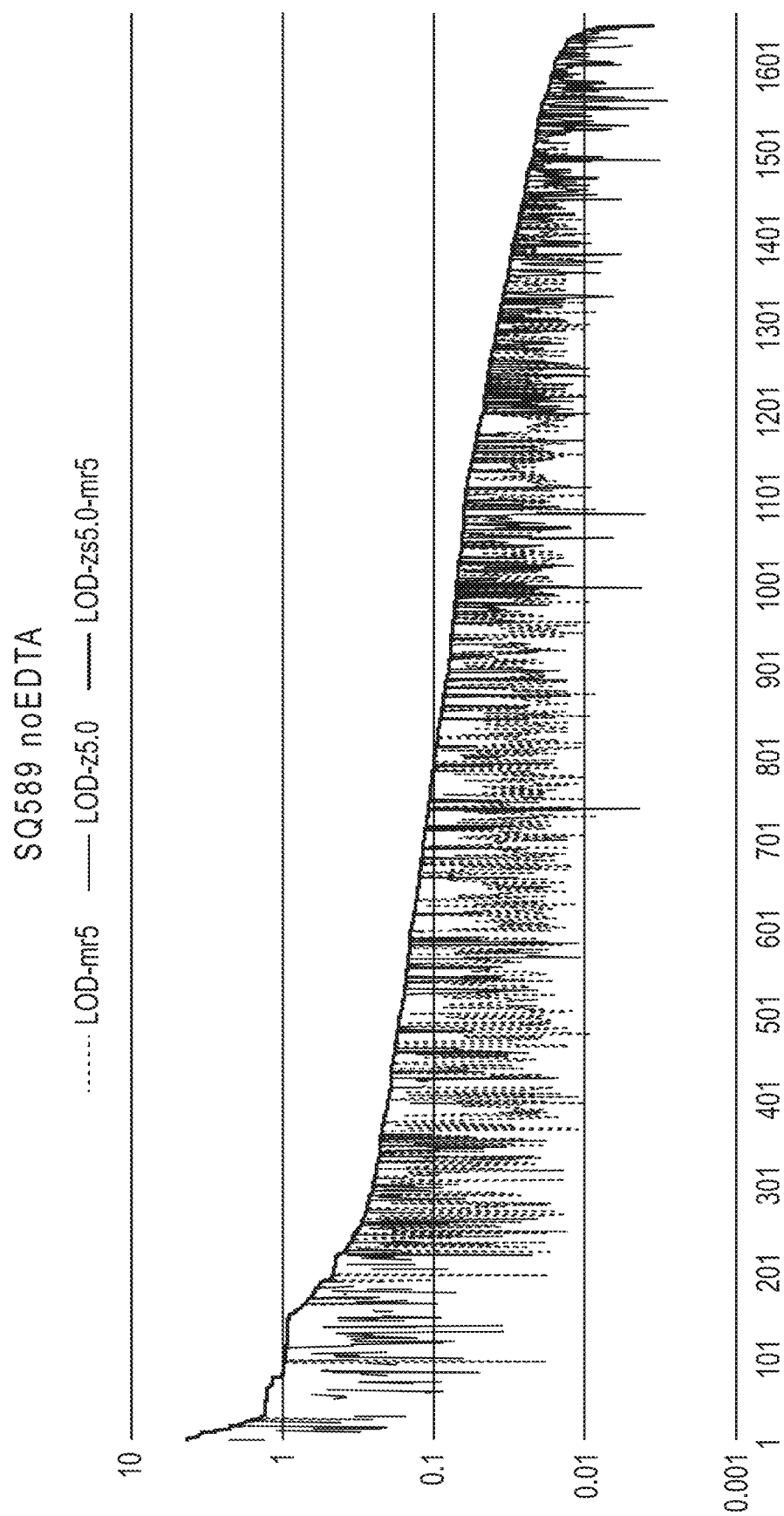
FIG. 39 is a graph showing the limit of detection for single nucleotide variants in a plasma sample using three different methods described in Example 23.

For the analysis of a tumor sample shown in FIG. 38, the mean limit of detection was 0.36%, and the median limit of detection was 0.28%. The number of DOR limited (thin lines) SNVs was 934. The number of error rate limited (dashed lines) SNVs was 738.

For the analysis of cDNA in a plasma sample shown in FIG. 39, the mean limit of detection was 0.24%, and the median limit of detection was 0.09%. The number of DOR limited (thin lines) SNVs was 732. The number of error rate limited (dashed lines) SNVs was 921.

Example 24

This example illustrates the detection of CNVs and SNVs from the same single cell. The following primer libraries were used a library of ~28,000 primers for detecting CNVs, a library of ~3,000 primers for detecting CNVs, and library of primers for detecting SNVs. For analysis of a single cell, cells were serial diluted until there were 3 or 4 cells per droplet. An individual cell was pipetted and placed into a PCR tube. The cell was lysed using Protease K, salt, and DTT using the following thermocycling conditions: 56° C. for 20 minutes, 95° C. for 10 minutes, and then a 4° C. hold. For analysis of genomic DNA, DNA from the same cell line as the analyzed single cell was either purchased or obtained by growing the cells and extracting the DNA.

For amplification with the library of ~28,000 primers, the following PCR conditions were used a 40 uL reaction volume, 7.5 nM of each primer, and 2× master mix (MM). In some embodiments QIAGEN Multiplex PCR Kit is used for the master mix (QIAGEN catalog No. 206143; see, e.g., information available at the world wide web at qiagen.com/products/catalog/assay-technologies/end-point-pcr-and-rt-pcr-reagents/qiagen-multiplex-pcr-kit, is which is hereby incorporated by reference in its entirety). The kit includes 2× QIAGEN Multiplex PCR Master Mix (providing a final concentration of 3 mM $MgCl_2$, 3×0.85 ml), 5× Q-Solution (1×2.0 ml), and RNase-Free Water (2×1.7 ml). The QIAGEN Multiplex PCR Master Mix (MM) contains a combination of KCl and $(NH_4)_2SO_4$ as well as the PCR additive, Factor MP, which increases the local concentration of primers at the template. Factor MP stabilizes specifically bound primers, allowing efficient primer extension by, e.g., HotStarTaq DNA Polymerase. HotStarTaq DNA Polymerase is a modified form of Taq DNA polymerase and has no polymerase activity at ambient temperatures. The following thermocycling conditions were used for the first round of PCR: 95° C. for 10 minutes; 25 cycles of 96° C. for 30 seconds, 65° C. for 29 minutes, and 72° C. for 30 seconds; and then 72° C. for 2 minutes, and a 4° C. hold. For the second round of PCR a 10 ul reaction volume, 1×MM, and 5 nM of each primer was used. The following thermocycling conditions were used: 95° C. for 15 minutes; 25 cycles of 94° C. for 30 seconds, 65° C. for 1 minute, 60° C. for 5 minutes, 65° C. for 5 minutes, and 72° C. for 30 seconds; and then 72° C. for 2 minutes, and a 4° C. hold.

For the library of ~3,000 primers, exemplary reaction conditions include a 10 ul reaction volume, 2×MM, 70 mM TMAC, and 2 nM primer of each primer. For the library of primers for detecting SNVs, exemplary reaction conditions include a 10 ul reaction volume, 2× MM, 4 mM EDTA, and 7.5 nM primer of each primer. Exemplary thermocycling conditions include 95° C. for 15 minutes, 20 cycles of 94° C. for 30 seconds, 65° C. for 15 minutes, and 72° C. for 30 seconds; and then 72° C. for 2 minutes, and a 4° C. hold.

The amplified products were barcoded. One run of sequencing was performed with an approximately equal number of reads per sample.

Figure 40A:
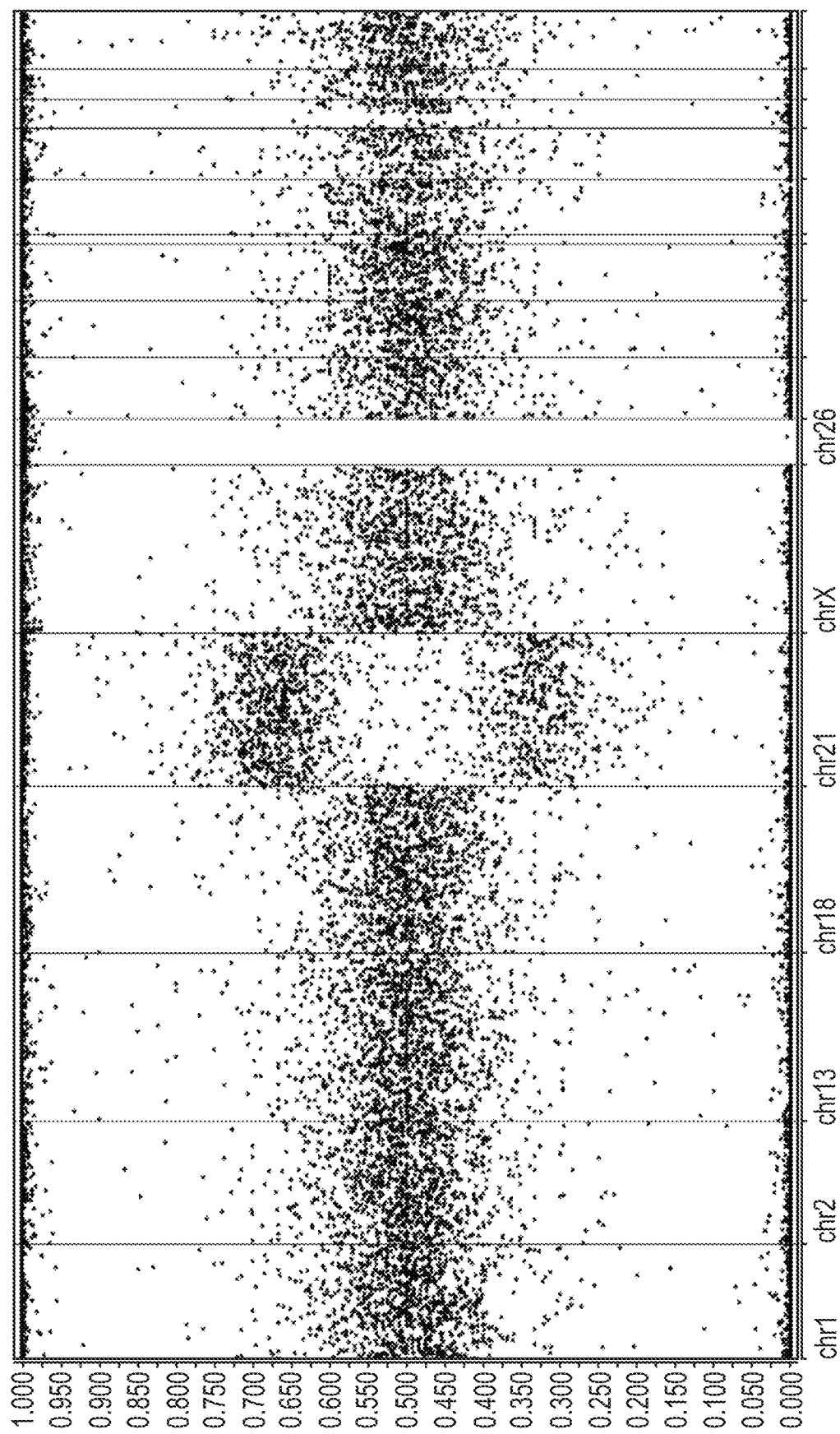
FIGS. 40A and 40B are graphs of the analysis of genomic DNA (FIG. 40A) or DNA from a single cell (FIG. 40B) using a library of approximately 28,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 40B:
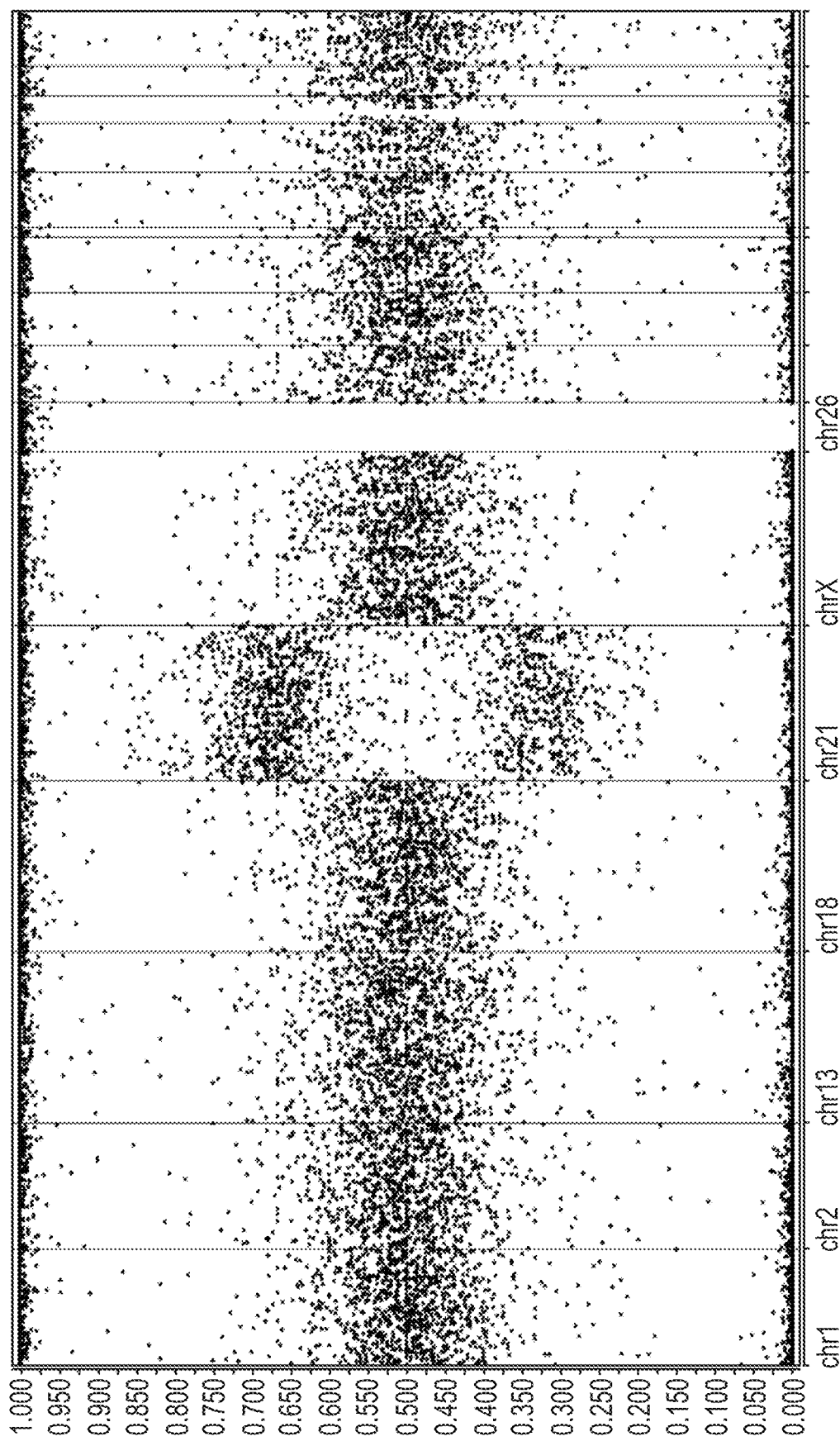

FIGS. 40A and 40B show results from analysis of genomic DNA (FIG. 40A) or DNA from a single cell (FIG. 40B) using a library of approximately 28,000 primers designed to detect CNVs. Approximately 4 million reads were measured per sample. The presence of two central bands instead of one central band indicates the presence of a CNV. For three samples of DNA from a single cell, the percent of mapped reads was 89.9%, 94.0%, and 93.4%, respectively. For two samples of genomic DNA the percent of mapped reads was 99.1% for each sample.

Figure 41A:
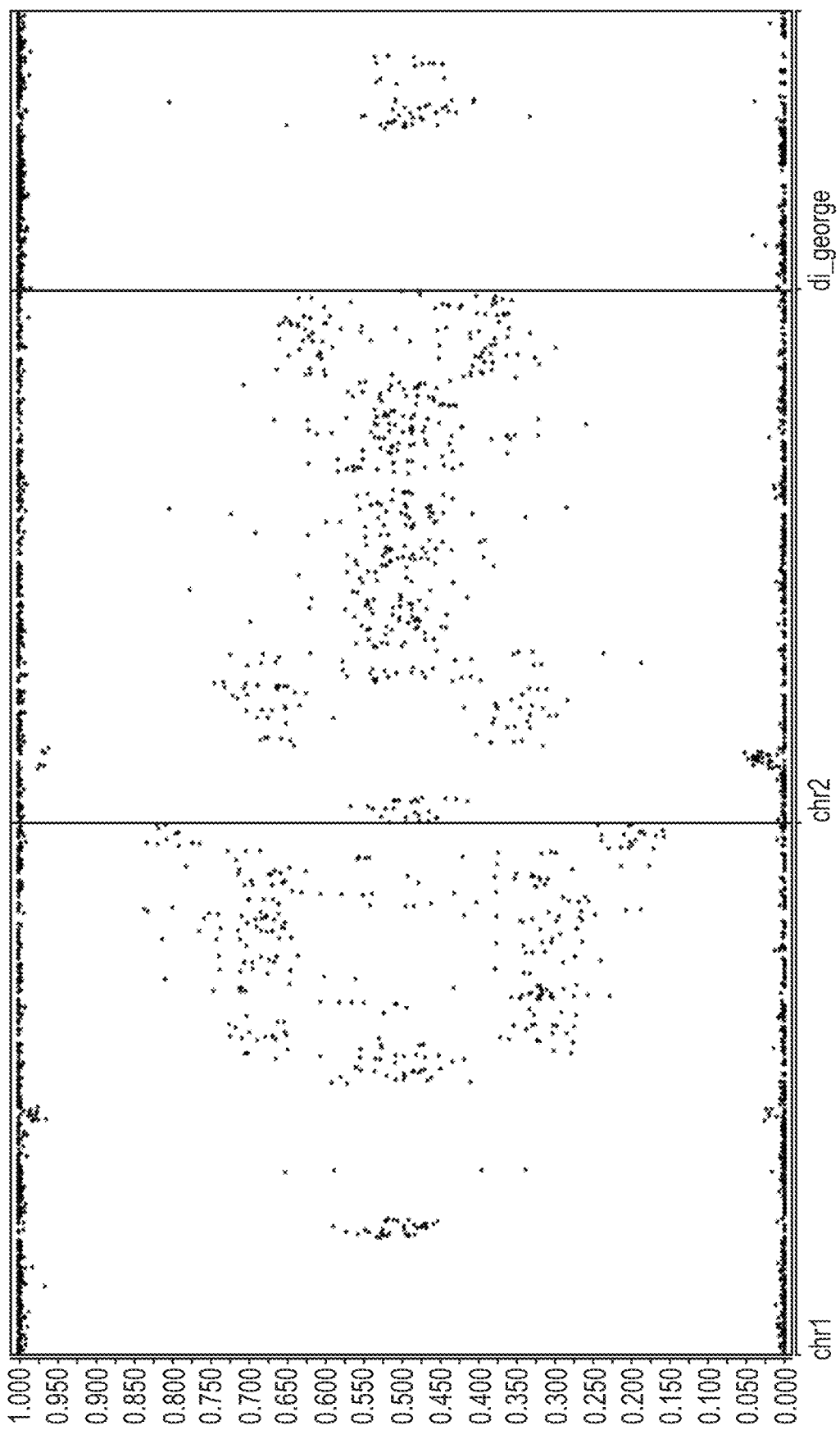
FIGS. 41A and 41B are graphs of the analysis of genomic DNA (FIG. 41A) or DNA from a single cell (FIG. 41B) using a library of approximately 3,000 primers designed to detect CNVs. The presence of two central bands instead of one central band indicates the presence of a CNV. The x-axis represents the linear position of the SNPs, and the y-axis indicates the fraction of A allele reads out of the total reads.
Figure 41B:
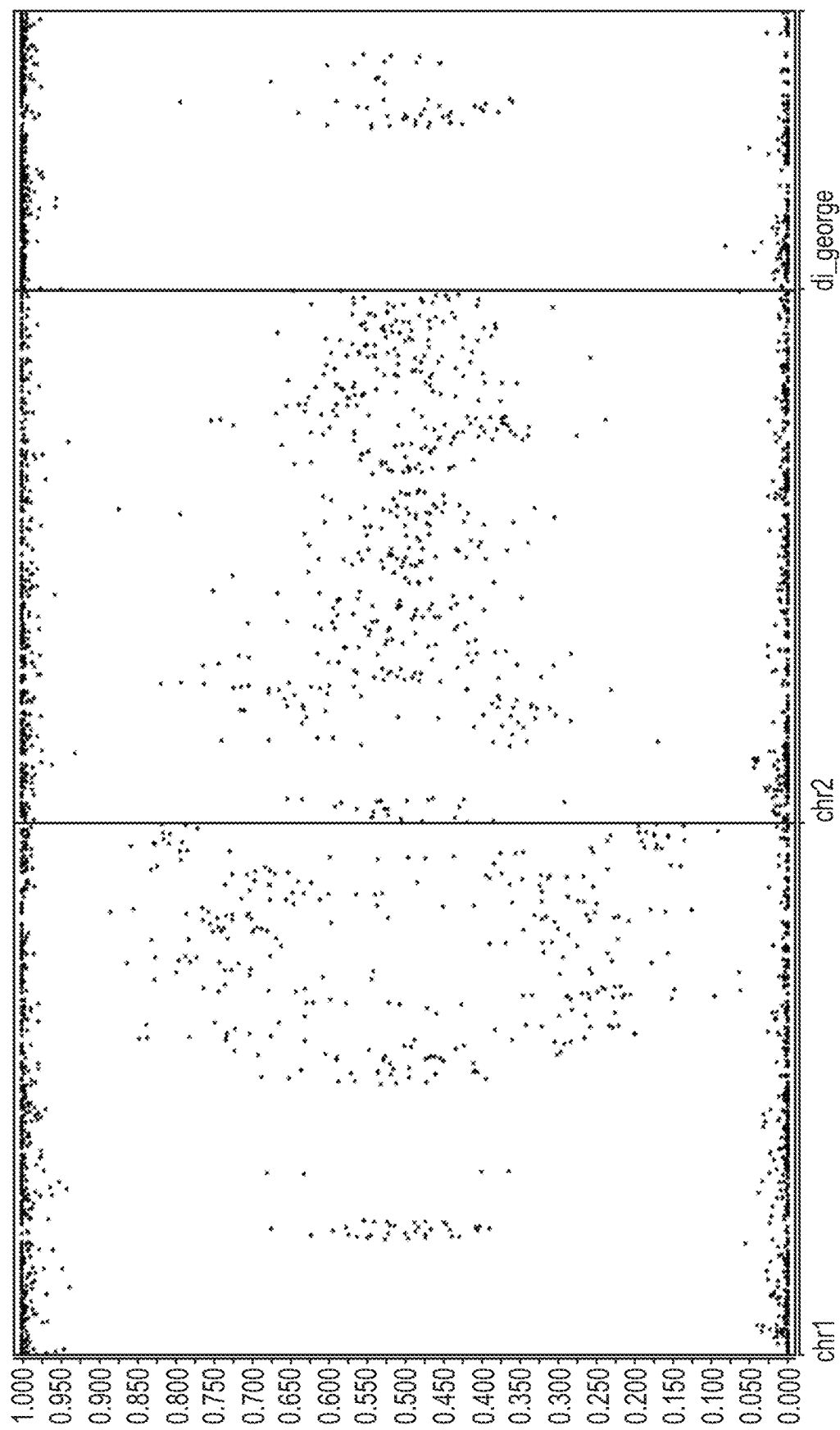
Figure 42:
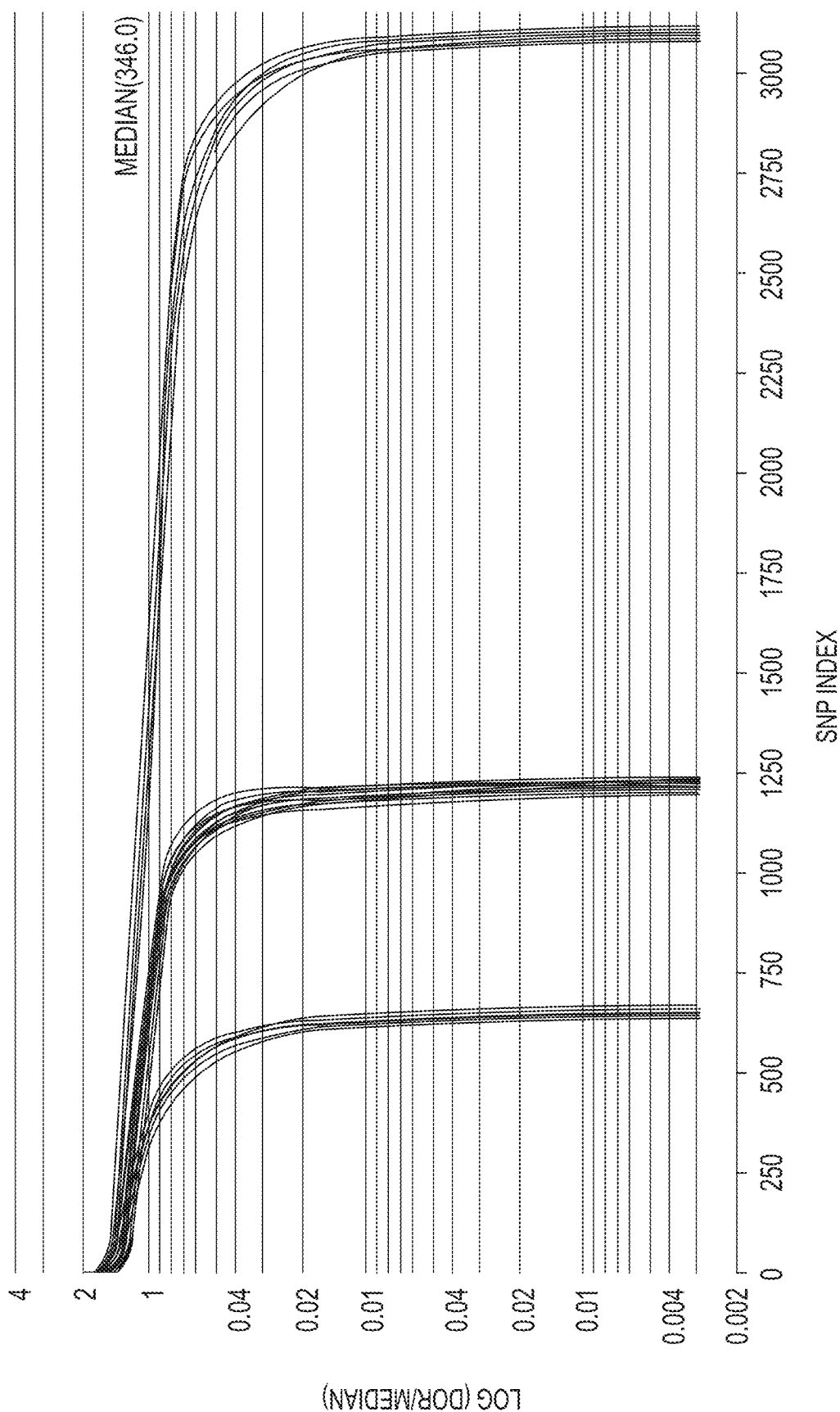
FIG. 42 is a graph illustrating the uniformity in depth of read (DOR) for these ~3,000 loci.

FIGS. 41A and 41B show results from analysis of genomic DNA (FIG. 41A) or DNA from a single cell (FIG. 41B) using a library of approximately 3,000 primers designed to detect CNVs. Approximately 1.2 million reads were measured per sample. The presence of two central bands instead of one central band indicates the presence of a CNV. For three samples of DNA from a single cell, the percent of mapped reads was 98.2%, 98.2%, and 97.9%, respectively. For two samples of genomic DNA the percent of mapped reads was 98.8% for each sample. FIG. 42 illustrates the uniformity in DOR for these ~3,000 loci.

Figures 43, 44:
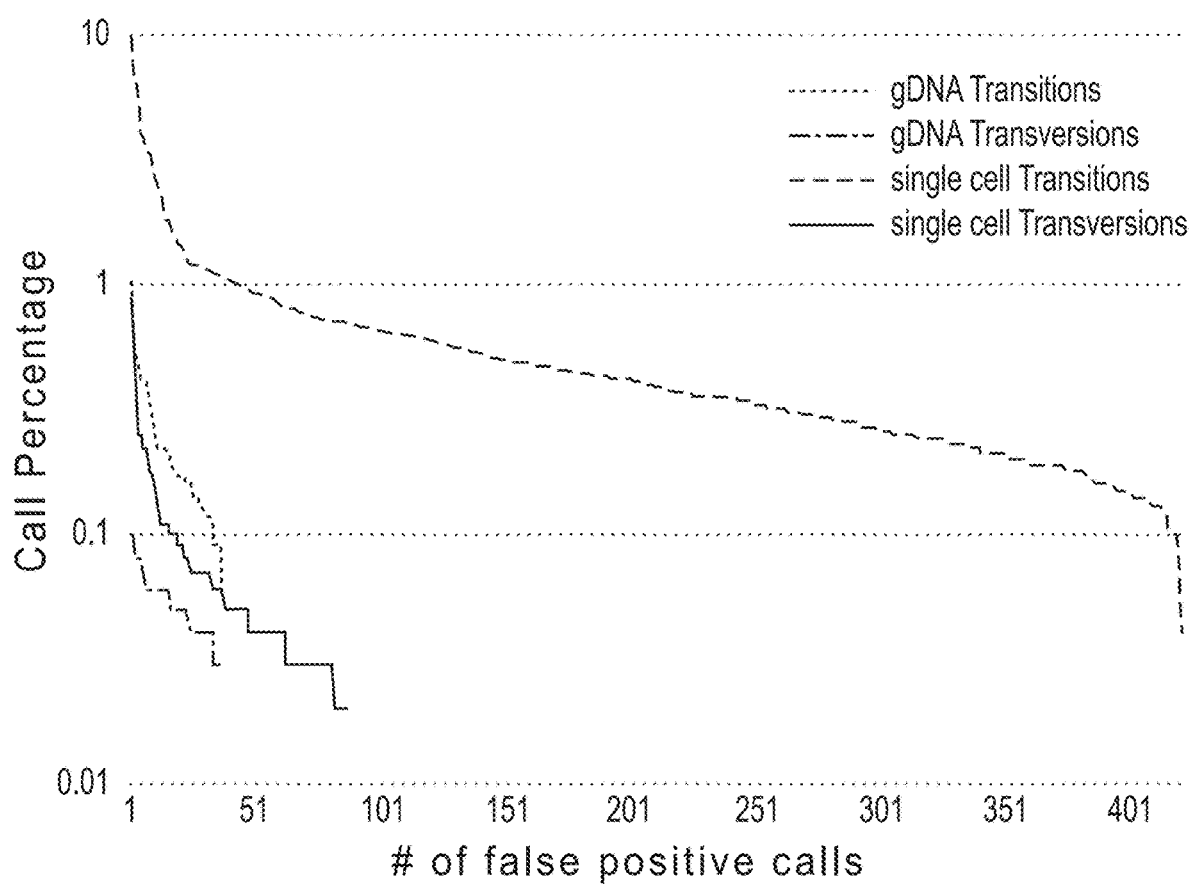
FIG. 43 is a table comparing error call metrics for genomic DNA and DNA from a single cell.
FIG. 44 is a graph of error rates for transition mutations and transversion mutations.

For calling SNVs, the call percent for true positive mutations was similar for DNA from a single cell and genomic DNA. A graph of call percent for true positive mutations for single cells on the y-axis versus that for genomic DNA on the x-axis yielded a curve fit of $y=1.0076x-0.3088$ with $R^2=0.9834$. FIG. 43 shows similar error call metrics for genomic DNA and DNA from a single cell. FIG. 44 shows that the error rate for detecting transition mutations was greater than for detecting transversion mutations, indicating it may be desirable to select transversion mutations for detection rather than transition mutations when possible. In some embodiments, at least 50, 60, 70, 80, 90, 95, 96, 98, 99, or 100% of the SNVs tested for are transversion mutations rather than transition mutations.

Example 25

The following is an example of multiplex PCR conditions in which the annealing temperature is significantly higher than the average or maximum melting ($T_m$) of the primers in the library. A 3,168-plex reaction was performed with 3,168 primer pairs to 3,168 different target loci. For the PCR amplification a 20 ul total volume was used with 2 nM of each primer (3,168 pairs of forward and reverse primers), 70 mM TMAC (tetra-methyl ammonium chloride), and 7 ul library DNA or genomic DNA. The following thermocycling conditions were used: 95° C. for 10 minutes and then 25 cycles of 96° C. for 30 seconds, 65° C. for 20 minutes (this annealing temperature is higher than the $T_m$ of the primers, listed above), and 72° C. for 30 seconds. Then, 72° C. for 2 minutes and a 4° C. hold were used.

The minimum $T_m$ (the lowest numerical value for the $T_m$ for any of the primers) for this primer library is 54.0° C. The maximum $T_m$ (the highest numerical value for the $T_m$ for any of the primers) for this primer library is 60.36° C. The average $T_m$ (average value of the $T_m$ values of the primers) for this primer library is 55.25° C. These $T_m$ values were calculated using the following exemplary method for calculating $T_m$ values. This method is used by the Primer3 program (the worldwide web at primer3.sourceforge.net, which is hereby incorporated by reference in its entirety) to calculate $T_m$ values. In some embodiments, one or more of the following conditions are assumed for this calculation: temperature: of 60.0° C., primer concentration of 100 nM, and/or salt concentration of 100 mM. In some embodiments, other conditions are assumed for this calculation, such as the conditions that will be used for multiplex PCR with the library.

$$Tm = deltaH/(deltaS + R*\ln(C/4))$$

Below is documentation from the Primer3 program for its Tm calculations; PRIMER_TM_FORMULA (int; default 0) specifies details of melting temperature calculation. This is new in version 1.1.0, and added by Maido Remm and Triinu Koressaar (the world wide web at primer3.ut.ee/primer3web_help.htm#PRIMER_TM_FORMULA, which is hereby incorporated by reference in its entirety). A value of 0 directs primer3 to a backward compatible calculation (in other words, the only calculation available in previous version of primer3). This backward compatible calculation uses the table of thermodynamic parameters in the paper (Breslauer K J et al. (1986) "Predicting DNA duplex stability from the base sequence" Proc Natl Acad Sci 83:4746-50, dx.doi.org/10.1073/pnas.83.11.3746, which is hereby incorporated by reference in its entirety), and the method in the paper (Rychlik W, Spencer W J and Rhoads R E (1990) "Optimization of the annealing temperature for DNA amplification in vitro", Nucleic Acids Res 18:6409-12, dx.doi.org/10.1093/nar/18.21.6409, which is hereby incorporated by reference in its entirety).

A value of 1 (which is recommended) directs primer3 to use the table of thermodynamic values and the method for melting temperature calculation suggested in the following paper (SantaLucia J R (1998) "A unified view of polymer, dumbbell and oligonucleotide DNA nearest-neighbor thermodynamics", Proc Natl Acad Sci 95:1460-65, dx.doi.org/10.1073/pnas.95.4.1460, which is hereby incorporated by reference in its entirety). The tag PRIMER_SALT_CORRECTIONS can be used to specify the salt correction method for melting temperature calculation.

The following is an example of calculating the melting temperature of an oligo with PRIMER_TM_FORMULA=1 and PRIMER_SALT_CORRECTIONS=1 recommended values for primer=CGTGACGTGACGGACT.

Using default salt and DNA concentrations gives $$Tm = deltaH/(deltaS + R*\ln(C/4))$$

where R is the gas constant (1.987 cal/K mol) and C is the DNA concentration.

$$deltaH(\text{predicted}) = dH(CG) + dH(GT) + dH(TG) +$$

$$\ldots + dH(CT) + dH(\text{init.w.term.}GC) + dH(\text{init.w.term.}AT)$$

$$= -10.6 + (-8.4) + (-8.5) + \ldots + (-7.8) + 0.1 + 2.3$$

$$= -128.8 \text{ kcal/mol}$$

where 'init.w.term GC' and 'init.w.term AT' are two initiation parameters for duplex formation: 'initiation with terminal GC' and 'initiation with terminal AT.'

$$deltaS(predicted) = dS(CG) + dS(GT) + dS(TG) +$$

$$\ldots + dS(CT) + dS(\text{init.w.term.}GC) + dS(\text{init.w.term.}AT)$$

$$= -27.2 + (-22.4) + (-22.7) + .;.+(-21.0) + (-2.8) + 4.1$$

$$= -345.2 \text{ cal/k}*\text{mol}$$

$deltaS(\text{salt corrected}) =$ $deltaS(\text{predicted}) + 0.368*15(NN \text{ pairs})*\ln(0.05 \text{ M monovalent cations})$ $$= -361.736$$

$$Tm = -128.800/(-361.736 + 1.987*\ln((5*10^{\wedge}(-8))/4)) = 323.704 \text{ K}$$

$$Tm(C) = 323.704 - 273.15 = 50.554 \text{ C}$$

Additional Applications

Because this method utilizes targeted amplification, it is uniquely poised to detect submicroscopic anomalies, such as microdeletions and microduplications. Although non-targeted methods like MPSS have been shown to detect the DiGeorge microdeletion syndrome, this required a sufficiently high level of genomic coverage so as to make the approach unfeasible. This is because non-targeted amplification will be several orders of magnitude less efficient on submicroscopic regions, as very small fraction of the sequencing reads will be informative. Additionally, the fact that the currently available methods have trouble accurately identifying ploidy state for the sex chromosomes suggests that they will also encounter variable amplification problems on smaller chromosomal segments.

Similarly, SNP based methods can detect UPD disorders, which are copy number-neutral anomalies that will not be detected by either the current noninvasive methods that rely on counting or the traditional invasive methods like amniocentesis and CVS that rely on cytogenetic karyotyping and/or fluorescence in situ hybridization. This is because SNP-based methods are uniquely able to distinguish individual haplotypes, whereas the clinically available MPSS-based and targeted methods amplify non-polymorphic loci and are thus unable to determine, for example, whether the chromosomes-of-interest originate from the same parent. This means that these microdeletion/microduplication and UPD syndromes, including Prader-Willi, Angelman, and Beckwith-Wiedemann syndromes, are generally not diagnosed prenatally, and are often initially misdiagnosed postnatally. This significantly delays therapeutic intervention. Additionally, because this method targets SNPs, this method will also facilitate parental haplotype reconstruction, allowing for detection of fetal inheritance of individual disease-linked loci (Kitzman J O, Snyder M W, Ventura M, et al. Noninvasive whole-genome sequencing of a human fetus. Sci Transl Med 2012; 4: 137ra76, which is hereby incorporated by reference in its entirety).

The results presented here confirm the expanded scope of this method for identifying prenatal aneuploidy. Specifically, by amplifying and sequencing 19,488 SNPs, this method is able to determine copy number at chromosomes 13, 18, 21, X, and Y, and is uniquely expected to detect other chromosomal abnormalities, such as triploidy and UPD, that are not detected by any other clinically available non-invasive method. The increased clinical coverage and powerful sample-specific calculated accuracies suggest that this method may offer a viable adjunct to invasive testing for detecting fetal chromosomal aneuploidies.

Example 26

This example describes an exemplary method for detection of copy number variations in breast cancer samples using SNP-targeted massively multiplexed PCR. Evaluation of CNV in tumor tissues typically involves SNP microarray or aCGH. These methods have high whole-genome resolution, but require large amounts of input material, have high fixed costs, and do not work well on formaldehyde fixed-paraffin embedded (FFPE) samples. For this example, 28,000-plex SNP-targeted PCR with next generation sequencing (NGS) was used to target 1p, 1q, 2p, 2q, 4p16, 5p15, 7q11, 15q, 17p, 22q11, 22q13 and chromosomes 13, 18, 21 and X for detection of CNVs in breast cancer samples. Accuracy was validated on 96 samples with aneuploidies or microdeletions. Single-molecule sensitivity was established by analyzing single cells. Of 17 breast cancer samples (15 fresh frozen and 2 FFPE tumor tissues, 5 pairs of matched tumor and normal cell lines) analyzed, 16 (including both FFPEs) were observed with full or partial CNVs in one to 15 targets (average: 7.8); evidence of tumor heterogeneity was observed. The three tissues with one CNV all had a 1q duplication, the most frequent cytogenetic abnormality in breast carcinoma. The most frequent regions with CNVs were 1q, 7p, and 22q1. Only one tumor tissue (with 9 CNVs) had a region with LOH; this LOH was also detected in adjacent putatively normal tissue that lacked the other 8 CNVs. By contrast, 5 or more regions with LOH and a high total CNV incidence (average: 12.8) was detected in cell lines. Thus, massively multiplexed PCR offers an economical high-throughput approach to investigate CNVs in a targeted manner, and is applicable to difficult-to-analyze samples, such as FFPE tissues.

Example 27

This example further validates a massively multiplexed PCR methodology for chromosomal aneuploidy and CNV determination disclosed herein, sometimes referred to as CoNVERGe (Copy Number Variant Events Revealed Genotypically), in cancer diagnostics, and further illustrates the development and use of "PlasmArt" standards for PCR of ctDNA samples. PlasmArt standards include polynucleotides having sequence identity to regions of the genome known to exhibit CNV and a size distribution that reflects that of cfDNA fragments naturally found in plasma.

Sample Collection

Human breast cancer cell lines (HCC38, HCC1143, HCC1395, HCC1937, HCC1954, and HCC2218) and matched normal cell lines (HCC38BL, HCC1143BL, HCC1395BL, HCC1937BL, HCC1954BL, and HCC2218BL) were obtained from the American Type Culture Collection (ATCC). Trisomy 21 B-lymphocyte (AG16777) and paired father/child DiGeorge Syndrome (DGS) cell lines (GM10383 and GM10382, respectively) were from the Coriell Cell Repository (Camden, NJ). GM10382 cells only have the paternal 22q11.2 region.

We procured tumour tissues from 16 breast cancer patients, including 11 fresh frozen (FF) samples from Geneticist (Glendale, CA) and five formalin-fixed paraffin-embedded (FFPE) samples from North Shore-LIJ (Manhasset, NY). We acquired matched buffy coat samples for eight patients and matched plasma samples for nine patients. FF tumour tissues and matched buffy coat and plasma samples from five ovarian cancer patients were from North Shore-LIJ. For eight breast tumour FF samples, tissue subsections were resected for analysis. Institutional review board approvals from Northshore/LIJ IRB and Kharkiv National Medical University Ethics Committee were obtained for sample collection and informed consent was obtained from all subjects.

Blood samples were collected into EDTA tubes. Circulating cell free DNA (containing ctDNA) was isolated from 1 mL plasma using the QIAamp Circulating Nucleic Acid Kit (Qiagen, Valencia, CA). Genomic DNA (gDNA) from FF tumor tissues, blood, and buccal samples was extracted using the DNeasy Blood and Tissue Kit (Qiagen).

To make the PlasmArt standards according to one exemplary method, first, $9 \times 10^6$ cells were lysed with hypotonic lysis buffer (20 mM Tris-Cl (pH 7.5), 10 mM NaCl, and 3 mM $MgCl_2$) for 15 min on ice. Then, 10% IGEPAL CA-630 (Sigma, St. Louis, MO) was added to a final concentration of 0.5%. After centrifugation at 3,000 g for 10 min at 4° C., pelleted nuclei were resuspended in 1× micrococcal nuclease (MNase) Buffer (New England BioLabs, Ipswich, MA) before adding 1000 U of MNase (New England BioLabs), and then incubated for 5 min at 37° C. Reactions were stopped by adding EDTA to a final concentration of 15 mM. Undigested chromatin was removed by centrifugation at 2,000 g for 1 min. Fragmented DNA was purified with the DNA Clean & Concentrator™-500 kit (Zymo Research, Irvine, CA). Mononucleosomal DNA produced by MNase digestion was also purified and size-selected using AMPure XP magnetic beads (Beckman Coulter, Brea, CA). DNA fragments were sized and quantified with a Bioanalyzer DNA 1000 chip(Agilent, Santa Clara, CA).

To model ctDNA at different concentrations, different fractions of PlasmArts from HCC1954 and HCC2218 cancer cells were mixed with those from the corresponding matched normal cell line (HCC1954BL and HCC2218BL, respectively). Three samples at each concentration were analyzed. Similarly, to model allelic imbalances in plasma DNA in a focal 3.5 Mb region, we generated PlasmArts from DNA mixtures containing different ratios of DNA from a child with a maternal 22q11.2 deletion and DNA from the father. Samples containing only the father's DNA were used as negative controls. Eight samples at each concentration were analyzed.

Massively Multiplexed PCR and DNA Sequencing

Massively multiplex PCR and DNA sequencing methods below were used to determine allele counts at a plurality of polymorphic loci with 3-6 million (M) reads/sample for cell lines, 1.5-7 M reads/sample for tumour tissues, 18 M reads/sample for FFPE-LCM samples, 6-7 M reads/sample for germline controls, and 18-25 M reads/sample for plasma. For two representative exemplary runs using the 3,168 SNP primer pair pool, an average of 20 million reads were used to obtain allele counts for plasma DNA libraries and 6 million reads were used to obtain allele counts for genomic DNA libraries from fresh-frozen human tumors. The percent of mapped reads (i.e. mapped to the human genome) on these two exemplary runs were 98% and 95%, respectively. The fraction of sequencing reads at a given locus with a particular allele (allele fraction) was the fractional abundance of the allele in a sample. These counts provided observed allele frequencies that were used by the data analysis methods provided immediately below in this Example to determine the ploidy state of a chromosome or chromosome segment of interest and/or to determine the average allelic imbalance of the sample.

Libraries were generated from the samples above. Adapters were ligated to DNA fragments and the fragments were amplified using the following protocol: 95° C., 2 min; 15×[95° C., 20 sec, 55° C., 20 sec, 68° C., 20 sec], 68° C. 2 min, 4° C. hold.

Multiplexed PCR allows simultaneous amplification of many targets in a single reaction. In this study, we targeted 3,168 SNPs, which were distributed across five chromosome arms as follows: 646 on 1p, 602 on 1q, 541 on 2p, 707 on 2q, and 672 on the 22q11.2 focal region. These genomic regions were selected for convenience from SNP panels available in our laboratory. Target SNPs had at least 10% population minor allele frequency (1000 Genomes Project data; Apr. 30, 2012 release) to ensure that a sufficient fraction would be heterozygous in any given patient. For each SNP, multiple primers were designed to have a maximum amplicon length of 75 bp and a melting temperature between 54.0-60.5° C. To minimize the likelihood of primer dimer product formation, primer interaction scores for all possible combinations of primers were calculated, and primers with high scores were eliminated. The 3,186 SNP primer pair pool all had $\Delta G$ values greater than $-4$ Kcal/mol. Candidate PCR assays were ranked and 3,168 assays were selected on the basis of target SNP minor-allele frequency, observed heterozygosity rate (from dbSNP), presence in HapMap, and amplicon length.

For PCR amplifications, 3,168 SNPs were amplified in a multiplex PCR reaction using one primer pair for each SNP, during 25 cycles, and sequencing barcodes were added in 12 additional cycles. Prior to sequencing, the barcoded products were pooled, purified with the QIAquick PCR Purification Kit (Qiagen), and quantified using the Qubit™ dsDNA BR Assay Kit (Life Technologies). Amplicons were sequenced using an Illumina HiSeq 2500 sequencer with 1.5-7 M reads/sample for tumor tissue DNA and 18-25 M reads/sample for plasma cfDNA.

For the 3,168 SNP multiplex PCR reaction, approximately 7 ul (approx. 1200 ng) of library DNA, such as DNA from a DNA library generated from plasma of a target individual, was used. The master mix included the following: 2× (twice manufacturer's recommended concentration) Qiagen master mix, 70 mM TMAC (tetramethylammonium chloride, Sigma), 2 nM each primer, and 7 ul nucleic acid library (~1200 ng total library input) (20 ul total volume). The cycling conditions for the 3,168 SNP multiplex PCR reaction were as follows: 95° C., 15 min; 25×[96° C., 30 sec; 65° C., 20 min; 72° C., 30 sec]; 72° C., 2 min; 4° C. hold.

For the barcoding reaction, a 1× master mix was prepared that included the following: 1 uM forward primer (containing Illumina sequencing tag), 1 uM reverse primer (containing Illumina sequencing tag as well as internally-designed sequencing barcode), 1 ul of mmPCR product, diluted 1:2,000, and 1× Qiagen master mix. Barcoding cycling conditions were as follows: 95° C., 10 min; 12×[95° C., 30 sec; 70° C., 10 sec, 60° C., 30 sec; 65° C., 15 sec, 72° C., 15 sec]; 72°° C., 2 min; 4° C. hold.

Data Analysis of Tumor Tissue Genomic DNA

For tumor tissue samples, CNVs were delineated by transitions between allele frequency distributions. Regions with at least 100 SNPs that had an allele ratio statistically different from 0.50 were considered to be of interest. More specifically, the analysis focused on regions with average allele ratios of ≤0.45 or ≥0.55 for loci that are heterozygous in the germline. A segmentation algorithm was used to exhaustively search DNA sequences in five chromosome arms as follows: 646 on 1p, 602 on 1q, 541 on 2p, 707 on 2q, and 672 on the 22q11.2 for such regions, and iteratively selected them starting from the longest one until a region of 100 SNPs was reached. Once a ≥100 SNP region was determined to contain a CNV, it was further segmented by average allelic ratios with a minimum segment size of 50 SNPs if needed.

Fresh frozen tissue samples from three patients with breast cancer were also analyzed using Illumina CytoSNP-12 microarrays as previously described (Levy, B. et al. Genomic imbalance in products of conception: single-nucleotide polymorphism chromosomal microarray analysis. Obstetrics and gynecology 124, 202-209 (2014)).

Data Analysis of Circulating Tumor DNA

CNVs were identified by a maximum likelihood algorithm that searched for plasma CNVs in regions where the tumor sample from the same individual also had CNVs, using haplotype information deduced from the tumor sample. This algorithm modeled expected allelic frequencies across a set of average allelic imbalances at 0.025% intervals for three sets of hypotheses: (1) all cells are normal (no allelic imbalance), (2) some/all cells have a homolog 1 deletion or homolog 2 amplification, or (3) some/all cells have a homolog 2 deletion or homolog 1 amplification. For at least some of the analysis, modeling was performed up to 15% average allelic imbalance, although for the vast majority of samples AAI was less than or equal to 5%. The likelihood of each hypothesis was determined at each SNP using a Bayesian classifier based on a beta binomial model of expected and observed allele frequencies at all heterozygous SNPs, and then the joint likelihood across multiple SNPs was calculated taking linkage of the SNP loci into consideration. The maximum likelihood hypothesis from the comparison of expected to observed allele frequencies was then selected.

This algorithm also calculates the confidence of each CNV call by comparing the likelihoods of different hypotheses. A confidence threshold of 99.9% was used in plasma samples to minimize false positive results.

For dimorphic SNPs that have alleles arbitrarily designated 'A' and 'B', the allele ratio of the A allele is $n_A/(n_A+n_B)$, where $n_A$ and $n_B$ are the number of sequencing reads for alleles A and B, respectively. Allelic imbalance is the difference between the allele ratios of A and B for loci that are heterozygous in the germline. This definition is analogous to that for SNVs, where the proportion of abnormal DNA is typically measured using mutant allele frequency, or $n_m/(n_m+n_r)$, where $n_m$ and $n_r$ are the number of sequencing reads for the mutant allele and the reference allele, respectively.

Allele frequency data was corrected for errors before it was used to generate individual probabilities. Errors that were corrected included allele amplification bias, ambient contamination, genotype contamination, and sequencing error. Ambient contamination refers to the contamination error across all SNPs in addition to sequencing errors, and genotype contamination refers to the additional contamination at some SNPs due to contamination from another sample. Ambient contamination and genotype contamination were determined on the same run as the on-test sample analysis by analyzing homozygous alleles in the sample. The ploidy status of a chromosomal segment was estimated using heterozygous loci for a test individual.

Best hypothesis was defined to be the one with the highest likelihood across all polymorphic loci. Likelihood at each locus was calculated using a beta binomial model of observed allele frequencies at each of the polymorphic loci, and the likelihood across a set of polymorphic loci was computed using the phase information deduced from the corresponding tumor sample.

A linear regression model was used to compare either expected AAI or tumor input DNA percentage and observed AAI determined by the CNV detection algorithm. $P<0.05$ was considered statistically significant. SigmaPlot 12.5 (Systat Software, San Jose, CA) and Matlab 7.12.0 R2011.a (MathWorks, Natick, MA) were used.

Accordingly, to evaluate the sensitivity and reproducibility of CoNVERGe, especially when the proportion of abnormal DNA for a CNV, or average allelic imbalance (AAI), is low, we used it to detect CNVs in DNA mixtures comprised of a previously characterized abnormal sample titrated into a matched normal sample. The mixtures consisted of artificial cfDNA, termed "PlasmArt", with fragment size distribution approximating natural cfDNA (see above). In the first pair, a son's tumor DNA sample having a 3 Mb Focal CNV deletion of the 22q11.2 region was titrated into a matched normal sample from the father at between 0-1.5% total cfDNA. CoNVERGe reproducibly identified CNVs corresponding to the known abnormality with estimated AAI of >0.35% in mixtures of ≥0.5%+/−0.2% AAI, failed to detect the CNV in 6/8 replicates at 0.25% abnormal DNA, and reported a value of ≤0.05% for all eight negative control samples. The AAI values estimated by CoNVERGe showed high linearity ($R2=0.940$) and reproducibility (error variance=0.087). The assay was sensitive to different levels of amplification within the same sample. Based on these data a conservative detection threshold of 0.45% AAI could be used for subsequent analyses.

Two additional PlasmArt titrations, prepared from pairs of matched tumor and normal cell line samples and having CNVs on chromosome 1 or chromosome 2, were also evaluated. Among negative controls, all values were <0.45%, and high linearity ($R2=0.952$ for HCC1954 1p, $R2=0.993$ for HCC1954 1q, $R2=0.977$ for HCC2218 2p, $R2=0.967$ for HCC2218 2q) and reproducibility (error variance=0.190 for HCC1954 1p, 0.029 for HCC1954 1q, 0.250 for HCC2218 2p, and 0.350 for HCC2218 2q) were observed between the known input DNA amount and that calculated by CoNVERGe. The difference in the slopes of the regressions for regions 1p and 1q of one sample pair correlates with the relative difference in copy number observed in the B-allelic frequencies (BAFs) of regions 1p and 1q of the same sample, demonstrating the relative precision of the AAI estimate calculated by CoNVERGe.

CoNVERGe has application to a variety of sample sources including FFPE, Fresh Frozen, Single Cell, Germline control and cfDNA. We applied CoNVERGe to six human breast cancer cell lines and matched normal cell lines to assess whether it can detect somatic CNVs. Arm-level and focal CNVs were present in all six tumour cell lines, but were absent from their matched normal cell lines, with the exception of chromosome 2 in HCC1143 in which the normal cell line exhibits a deviation from the 1:1 homolog ratio. To validate these results on a different platform, we performed CytoSNP-12 microarray analyses, which produced consistent results for all samples. Moreover, the maximum homolog ratios for CNVs identified by CoNVERGe and CytoSNP-12 microarrays exhibited a strong linear correlation ($R2=0.987$, $P<0.001$).

We next applied CoNVERGe to fresh-frozen (FF) and formalin-fixed, paraffin-embedded (FFPE) breast tumour tissue samples. In both sample types, several arm-level and focal CNVs were present; however, no CNVs were detected in DNA from matched buffy coat samples. CoNVERGe results were highly correlated with those from microarray analyses of the same samples ($R2=0.909$, $P<0.001$ for CytoSNP-12 on FF; $R2=0.992$, $P<0.001$ for OncoScan on FFPE). CoNVERGe also produces consistent results on small quantities of DNA extracted from laser capture microdissection (LCM) samples, for which microarray methods are not suitable.

Detection of CNVs in Single Cells with CoNVERGe

To test the limits of the applicability of this mmPCR approach, we isolated single cells from the six aforementioned cancer cell lines and from a B-lymphocyte cell line that had no CNVs in the target regions. The CNV profiles from these single-cell experiments were consistent between three replicates and with those from genomic DNA (gDNA) extracted from a bulk sample of about 20,000 cells. On the basis of the number of SNPs with no sequencing reads, the average assay drop-out rate for bulk samples was 0.48% (range: 0.41-0.60%), which is attributable to either synthesis or assay design failure. For single cells, the additional average assay drop-out rate observed was 0.39% (range: 0.19-0.67%). For single cell assays that did not fail (i.e. no assay drop-out occurred), the average single ADO rate calculated using heterozygous SNPs only was 0.05% (range: 0.00-0.43%). Additionally, the percentage of SNPs with high confidence genotypes (i.e. SNP genotypes determined with at least 98% confidence) was similar for both single cell and bulk samples and the genotype in the single cell samples matched those in the bulk sample (average 99.52%, range: 92.63-100.00%).

In single cells, allele frequencies are expected to directly reflect chromosome copy numbers, unlike in tumour samples where this may be confounded by TH and non-tumour cell contamination. BAFs of 1/n and (n−1)/n indicate n chromosome copies in a region. Chromosome copy numbers are indicated on the allele frequency plots for both single cells and matched gDNA samples.

Application of CoNVERGe to Plasma Samples

To investigate the ability of CoNVERGe to detect CNVs in real plasma samples, we applied our approach to cfDNA paired with a matched tumour biopsy from each of two stage II breast cancer patients and five late-stage ovarian cancer. In all seven patients, CNVs were detected in both FF tumour tissues and in the corresponding plasma samples. A total of 32 CNVs, at a level of ≥0.45% AAI, were detected in the seven plasma samples (range: 0.48-12.99% AAI) over the five regions assayed, which represent about 20% of the genome. Note that the presence of CNVs in plasma cannot be confirmed due to the lack of alternative orthogonal methods.

Although AAI estimates may appear correlated with BAFs in tumour, direct proportionality should not necessarily be expected due to tumour heterogeneity. For example, in sample BC5, regions that have BAFs compatible with N=11 were detecting; combining this with the AAI calculation from the plasma sample leads to estimates for c of 2.33% and 2.67% for the two regions. Estimating c using the other regions in the sample give values between 4.46% and 9.53%, which clearly demonstrates the presence of tumor heterogeneity.

Further CNV Analyses of Tumor Tissue Samples

We applied our mmPCR-NGS method described herein to plasma samples from four stage II breast cancer patients (BC1-BC4), and analyzed the concordance between CNVs detected in plasma and those detected in multiple tumor samples from each corresponding patient. Thus, we analyzed 4-6 tissue subsections from a tumor from each of four patients with breast cancer using mmPCR-NGS. All subsections for each patient had a CNV detected in at least one of the five targeted genomic regions (1p, 1q, 2p, 2q, and 22q11.2). A CNV was identified in at least one tumor subsection in 18/20 (90%) genomic regions. Among these 18 CNV-positive regions, 11 (61%) had a CNV detected in that particular region in all subsections.

Interestingly, different patterns of AAIs across these five chromosomal regions were observed among different tumor subsections. In patient BC1, for instance, a similar pattern of CNVs was observed for regions 2p, 2q, and 22q11.2 in all four subsections, suggesting that these CNVs are clonal mutations. In contrast, only two of the four subsections had CNVs observed in the 1p region, and three of the four subsections had CNVs observed in the 1q region, suggesting that those CNVs were subclonal mutations. Similar patterns of possible clonal and subclonal CNVs were observed in patients BC3 and BC4, whereas BC2 appeared to be more homogenous.

In addition, even when a CNV was detected in all subsections for a particular patient, such as in the 1q region for patient BC3, the AAI often varied between subsections. Overall AAI patterns also differed between patients. Taken together, these findings suggest that mmPCR-NGS can be used to elucidate both intra- and inter-tumor clonal heterogeneity.

Concordance of CNVs in Tumors and Plasma cfDNA

To quantify the amount of overlap between CNVs detected in plasma cfDNA and those detected in tumor tissue gDNA, we used mmPCR-NGS to interrogate CNVs in tumor tissue samples and matching plasma samples from patients BC1-BC4. Seven of the 18 (39%) CNV-positive genomic regions identified in tumor subsections were also detected in the plasma (0.77%-5.80% AAI). Considering only the 11 clonal CNVs-those that were detected in all tumor subsections—a CNV was detected in four (36%) of the patient-matched plasma samples (estimated AAI: 0.77%-5.80%).

Among the seven subclonal CNVs-those that were not observed in all subsections-we detected a CNV in 3/7 (43%) of the regions (estimated AAI: 1.24%-3.36%) in the corresponding cfDNA. Of note, in these three regions (BC1, chromosome 1p; BC1, chromosome 1q; and BC4, chromosome 2p), a CNV was detected in 10/14 (71%) of the matched tumor subsections. In contrast, in the other four genomic regions that did not have a CNV detected in the corresponding plasma samples (BC3, chromosomal regions 1p, 2p, 2q, and 22q11.2), we only detected a CNV in 7/24 (29%) of the tissue subsections. These data suggest that the more prevalent a subclonal CNV is within a tumor, the more likely it is to be observed in cfDNA.

In the 150 genomic regions assayed in 30 negative controls, there were no CNVs with AAIs >0.45% and confidence >99.9%, which suggests that mmPCR-NGS has a low false-positive rate.

These data demonstrate that CNVs can be detected in plasma in a substantial fraction of samples, and suggest that the more prevalent a CNV is within a tumour, the more likely it is to be observed in cfDNA. Furthermore, CoNVERGe detected CNVs from a liquid biopsy that may have otherwise gone unobserved in a traditional tumour biopsy.

Example 28

This example provides details regarding certain exemplary sample preparation methods used for analysis of different types of samples. The sample preparation methods disclosed in this example, were used in other Examples provided herein, to generate nucleic acid templates spanning a plurality of SNP sites for next generation sequencing reactions. From these NGS reactions, allele counts were generated at a plurality of polymorphic loci. These counts were then used by the analytical methods provided herein, to determine the ploidy state of a chromosome or chromosome segment of interest and/or to determine the average allelic imbalance of a sample.

Single Cell CNV Protocol for 28,000-Plex PCR

Multiplexed PCR allows simultaneous amplification of many targets in a single reaction. Target SNPs were identified in each genomic region with 10% minimum population minor allele frequency (1000 Genomes Project data; Apr. 30, 2012 release). For each SNP, multiple primers, semi-nested, were designed to have an amplicon length of a maximum length of 75 bp and a melting temperature between 54 60.5° C. Primer interaction scores for all possible combinations of primers were calculated; primers with high scores were eliminated to reduce the likelihood of primer dimer product formation. Candidate PCR assays were ranked and selected on the basis of target SNP minor allele frequency, observed heterozygosity rate (from dbSNP), presence in HapMap, and amplicon length.

In certain experiments, single cell samples were prepared and amplified using a mmPCR 28,000-plex protocol. The samples were prepared in the following way: For analysis of a single cell, cells were serial diluted until there were 3 or 4 cells per droplet. An individual cell was pipetted and placed into a PCR tube. The cell was lysed using Protease K, salt, and DTT using the following conditions: 56° C. for 20 minutes, 95° C. for 10 minutes, and then a 4° C. hold. For analysis of genomic DNA, DNA from the same cell line as the analyzed single cell was either purchased or obtained by growing the cells and extracting the DNA. The DNA was amplified in a 40 uL reaction volume containing Qiagen mp-PCR master mix (2×MM final conc), 7.5 nM primer conc. for 28K primer pairs having hemi-nested Rev primers under the following conditions: 95 C 10 min, 25×[96 C 30 sec, 65 C 29 min, 72 C 30 sec], 72 C 2 min, 4 C hold. The amplification product was diluted 1:200 in water and 2 ul added to STAR 2 (10 ul reaction volume) 1×MM, 5 nM primer conc. and PCR was performed using hemi-nested inner Fwd primer and tag specific Rev primer: 95 C 15 min, 25×[94 C 30 sec, 65 C 1 min, 60 C 5 min, 65 C 5 min, 72 C 30 sec], 72 C 2 min, 4 C hold.

Full sequence tags and barcodes were attached to the amplification products and amplified for 9 cycles using adaptor specific primers. Prior to sequencing, the barcoded library product were pooled, purified with the QIAquick PCR Purification Kit (Qiagen), and quantified using the Qubit☐dsDNA BR Assay Kit (Life Technologies). Amplicons were sequenced using an Illumina HiSeq 2500 sequencer.

Extraction of DNA from a Blood/Plasma Sample

Blood samples were collected into EDTA tubes. The whole blood sample was centrifuged and separated into three layers: the upper layer, 55% of the blood sample, was plasma and contains cell-free DNA (cfDNA); the buffy coat middle layer contained leucocytes having DNA, <1% of total; and the bottom layer, 45% of the collected blood sample, contained erythrocytes, no DNA was present in this fraction as erythrocytes are enucleated. Circulating tumor DNA was isolated from at least 1 mL plasma using the QIAamp Circulating Nucleic Acid Kit, Qia-Amp(Qiagen, Valencia, CA), according to the manufacture's protocol. In certain experiments genomic DNA(gDNA) from FF tumor tissues, blood, and buccal samples was extracted using the DNeasy Blood and Tissue Kit (Qiagen).

Plasma CNV Protocol for 3,168-plex for Chromosomes 1p, 1q, 2p, 2q, and 22q11

Plasma DNA libraries were prepared and amplified using a mmPCR 3,168-plex protocol. The samples were prepared in the following way: Up to 20 mL of blood was centrifuged to isolate the buffy coat and the plasma. Plasma extraction of cfDNA and library preparation was performed. DNA was eluted in 50 uL TE buffer. The input for mmPCR was 6.7 uL of amplified and purified Natera plasma library at an input amount of approximately 1200 ng. The plasma DNA was amplified in a 20 uL reaction volume containing Qiagen mp-PCR master mix (2×MM final conc), 2 nM tagged primer conc. (total 12.7 uM) in 3,168-plex primer pools and PCR amplified: 95 C 10 min, 25× [96 C 30 sec, 65 C 20 min, 72 C 30 sec], 72 C 2 min, 4 C hold. The amplification product was diluted 1:2,000 in water and 1 ul added to the Barcoding-PCR in a 10 uL reaction volume. The barcodes were attached to the amplification products via PCR amplification for 12 cycles using tag specific primers. Products of multiple samples were pooled and then purified with QIAquick PCR Purification Kit (Qiagen) and eluted in 50 ul DNA suspension buffer. Samples were sequenced by NGS as described for the Single Cell CNV Protocol for 28,000-plex PCR.

Breast Cancer Feasibility SNV Panel from Plasma cfDNA from breast cancer patient blood samples was prepared and amplified using 336 primer pairs that were distributed into four 84-plex pools. Natera plasma libraries were prepared as described for Plasma CNV Protocol for 3,168-plex for Chromosomes 1p, 1q, 2p, 2q, and 22q11. DNA was eluted in 50 uL TE buffer. The input for mPCR was 2.5 uL of amplified and purified Natera plasma library at an input amount of approximately 600 ng. SNPs were selected from the 1000 Genomes map for Humans, Group 19 and dbSNP to pick targets, but only SNPs from the 1000 Genomes were used to screen for minor allele frequencies. The plasma DNA was amplified in four parallel reactions of 84-plex primer pools, a 10 uL reaction volume containing Qiagen mp-PCR master mix (2×MM final conc.), 4 mM EDTA, 7.5 nM primer concentration (total 1.26 uM) and PCR amplified: 95 C 15 min, 25× [94 C 30 sec, 65 C 15 min, 72 C 30 sec], 72 C 2 min, 4 C hold. The amplification product of the 4 subpools were each diluted 1:200 in water and 1 ul added to the Barcoding-PCR reaction in a 10 uL reaction volume containing Q5 HS HF master mix (1χfinal), and 1 uM each barcoding primer and each of the pools were amplified in the following reaction: 98 C 1 min, 25× [98 C 10 sec, 70 C 10 sec, 60 C 30 sec, 65 C 15 sec, 72 C 15 sec], 72 C 2 min, 4 C hold. Libraries were purified with QIAquick PCR Purification Kit (Qiagen) and eluted in 50 ul DNA suspension buffer. Samples were sequenced by paired end sequencing.

Example 29

This example demonstrates that by using low primer concentrations such that primer amount is the limiting reactant in multiplex PCR in a workflow that is followed by next generation sequencing, uniformity of density of reads, and therefore limits of detection, across a pool of amplification reactions is improved. Some experiments were carried out for plasma CNV using the 3,168-plex panel according to Example 28 above except that the total reaction volume was 10 uL instead of 20 uL. Furthermore, PCR was carried out for 15, 20, or 25 cycles. Other experiments were carried out using the four 84-plex pools on breast cancer samples according to the protocol of Example 28 except that primer concentrations were 2 nM and PCR amplification was carried out for 15, 20, or 25 cycles.

Not to be limited by theory, it is believed that primer limited multiplex PCR provides improved depth of read uniformity for multiplex PCR before multi-read sequencing, such as high throughput or massively parallel sequencing, such as sequencing on an Illumina HiSeq or MiSeq system or an Ion Torrent PGM or Proton system, based on the following considerations: If some of the amplifications in a multiplex PCR have lower efficiencies than others, then with normal multiplex PCR we will end up with a wide range of depth of read ("DOR") values. However, if the amount of primer is limited, and the multiplex PCR is cycled more times than what it takes to exhaust the primers, then the more efficient amplifications will stop doubling (because they have no more primers to use) and the less efficient ones will continue to double; this will result in a more similar amount of amplification product for all of the amplification products. This will translate into a much more uniform distribution of the DOR.

The following calculations are used to determine the number of cycles that would exact a given amount of primer and starting nucleic acid template:

assume a given starting DNA input level: 100 k copies of each target ($10^5$; this is easily achieved with using amplified library)

assume we use 2 nM of each primer as an exemplary concentration, although other concentrations such as, for example, 0.2, 0.5, 1, 1.5, 2, 2.5, 5, or 10 nM could work too.

calculate the number of primer molecules for each primer: $2*10^{-9}$ (molar concentration, 2 nM)$\times 10*10^{-6}$ (reaction volume, 10 ul)$\times 6*10^{23}$ (number of molecules per mole, Avogadro's number)=$12*10^9$ calculate the amplification fold needed to consume all primers: $12*10^9$ (number of primer molecules)/$10^5$ (number of copies of each target)=$12*10^4$ calculate the number of cycles needed to achieve this amplification fold, assuming 100% efficiency at each cycle: $\log 2 (12*10^4)$=17 cycles. (this is log 2 because at each cycle, the number of copies doubles).

So for these conditions (100 k copies input, 2 nM primers, 10 ul reaction volume, assuming 100% PCR efficiency at each cycle), the primers would be consumed after 17 PCR cycles.

However, the key assumption is that some of the products DO NOT have 100% efficiency, so without measuring their efficiencies (which is only practicable for a small number of them anyway), it would take more than 17 cycles to consume them.

For each of four 84-plex SNV PCR primer pools we observed improved DOR efficiency with increasing cycles from 15 to 20 to 25. Similar results were obtained for experiments using the 3,168-plex panel. The limit of detection decreased (i.e. SNV sensitivity increased) with increasing depth of read. Furthermore, the sensitivity was consistently better when detecting transversion mutations than transition mutations. It is likely that additional increases in DOR efficiency can be obtained with additional cycles when using primer-limiting multiplex PCR before multi-read sequencing.

Accordingly, in one aspect provided herein is a method of amplifying a plurality of target loci in a nucleic acid sample that includes (i) contacting the nucleic acid sample with a library of primers and other primer extension reaction components to provide a reaction mixture, wherein the relative amount of each primer in the reaction mixture compared to the other primer extension reaction components creates a reaction wherein the primers are present at a limiting concentration, and wherein the primers hybridize to a plurality of different target loci; and (ii) subjecting the reaction mixture to primer extension reaction conditions for sufficient number of cycles to consume or exhaust the primers in the library of primers, to produce amplified products that include target amplicons. For example, the plurality of different target loci can include at least 2, 3, 5, 10, 25, 50, 100, 200, 250, 500, 1,000; 2,000; 5,000; 7,500; 10,000; 20,000; 25,000; 30,000; 40,000; 50,000; 75,000; or 100,000 different target loci, and at most, 50, 100, 200, 250, 500, 1,000; 2,000; 5,000; 7,500; 10,000; 20,000; 25,000; 30,000; 40,000; 50,000; 75,000; 100,000, 200,000, 250,000, 500, 000, and 1,000,000 different target loci to produce a reaction mixture.

The method in illustrative embodiments, includes determining an amount of primer that will be a rate limiting amount. This calculation typically includes estimating and/or determining the number of target molecules and involves analyzing and/or determining the number of amplification cycles performed. For example, in illustrative embodiments, the concentration of each primer is less than 100, 75, 50, 25, 10, 5, 2, 1, 0.5, 0.25, 0.2 or 0.1 nM. In various embodiments, the GC content of the primers is between 30 to 80%, such as between 40 to 70% or 50 to 60%, inclusive. In some embodiments, the range of GC content (e.g., the maximum GC content minus minimum GC content, such as 80%-60%=a range of 20%) of the primers is less than 30, 20, 10, or 5%. In some embodiments, the melting temperature ($T_m$) of the primers is between 40 to 80° C., such as 50 to 70° C., 55 to 65° C., or 57 to 60.5° C., inclusive. In some embodiments, the range of melting temperatures of the primers is less than 20, 15, 10, 5, 3, or 1° C. In some embodiments, the length of the primers is between 15 to 100 nucleotides, such as between 15 to 75 nucleotides, 15 to 40 nucleotides, 17 to 35 nucleotides, 18 to 30 nucleotides, 20 to 65 nucleotides, inclusive. In some embodiments, the primers include a tag that is not target specific, such as a tag that forms an internal loop structure. In some embodiments, the tag is between two DNA binding regions. In various embodiments, the primers include a 5' region that is specific for a target locus, an internal region that is not specific for the target locus and forms a loop structure, and a 3' region that is specific for the target locus. In various embodiments, the length of the 3' region is at least 7 nucleotides. In some embodiments, the length of the 3' region is between 7 and 20 nucleotides, such as between 7 to 15 nucleotides, or 7 to 10 nucleotides, inclusive. In various embodiments, the test primers include a 5' region that is not specific for a target locus (such as a tag or a universal primer binding site) followed by a region that is specific for a target locus, an internal region that is not specific for the target locus and forms a loop structure, and a 3' region that is specific for the target locus. In some embodiments, the range of the length of the primers is less than 50, 40, 30, 20, 10, or 5 nucleotides. In some embodiments, the length of the target amplicons is between 50 and 100 nucleotides, such as between 60 and 80 nucleotides, or 60 to 75 nucleotides, inclusive. In some embodiments, the range of the length of the target amplicons is less than 100, 75, 50, 25, 15, 10, or 5 nucleotides.

In various embodiments of any of the aspects of the invention, the primer extension reaction conditions are polymerase chain reaction conditions (PCR). In various embodiments, the length of the annealing step is greater than 3, 5, 8, 10, or 15 minutes but less than 240, 120, 60, or 30 minutes. In various embodiments, the length of the extension step is greater than 3, 5, 8, 10, or 15 minutes but less than 240, 120, 60 or 30 minutes.

All patents, patent applications, and published references cited herein are hereby incorporated by reference in their entirety. While the methods of the present disclosure have been described in connection with the specific embodiments thereof, it will be understood that it is capable of further modification. Furthermore, this application is intended to cover any variations, uses, or adaptations of the methods of the present disclosure, including such departures from the present disclosure as come within known or customary practice in the art to which the methods of the present disclosure pertain, and as fall within the scope of the appended claims. For example, any of the methods disclosed herein for DNA can be readily adapted for RNA by including a reverse transcription step to convert the RNA into DNA.

Examples that use polymorphic loci for illustration can be readily adapted for the amplification of nonpolymorphic loci if desired. Any of the methods disclosed herein can be used with a low level of multiplexing if desired (such as with less than 1,000, 750, 500, 250, 100, 75, 50, 25, or 10 different primers or different primer pairs to different target loci).

SEQUENCE LISTING (44624 sequences)

SEQ ID NO: 1 - DNA, 22 bp, synthetic construct
  misc_feature 1..22: note = Synthetic Construct
  source 1..22: mol_type = other DNA
ggcacaacatttgggagacaaa

SEQ ID NO: 2 - DNA, 26 bp, synthetic construct
  misc_feature 1..26: note = Synthetic Construct
  source 1..26: mol_type = other DNA
cctggaacctgaaagcttgcaaaaag

SEQ ID NO: 3 - DNA, 20 bp, synthetic construct
  misc_feature 1..20: note = Synthetic Construct
  source 1..20: mol_type = other DNA
acagggtgctctcctcttga

SEQ ID NO: 4 - DNA, 25 bp, synthetic construct
  misc_feature 1..25: note = Synthetic Construct
  source 1..25: mol_type = other DNA
ggaagcaaacaggtagagcctggta

SEQ ID NO: 5 - DNA, 23 bp, synthetic construct
  misc_feature 1..23: note = Synthetic Construct
  source 1..23: mol_type = other DNA
ctacaacaacagagctccaggat

SEQ ID NO: 6 - DNA, 23 bp, synthetic construct
  misc_feature 1..23: note = Synthetic Construct
  source 1..23: mol_type = other DNA
tgtccttggtcgtatgtgagaga

SEQ ID NO: 7 - DNA, 20 bp, synthetic construct
  misc_feature 1..20: note = Synthetic Construct
  source 1..20: mol_type = other DNA
gcaggaactggcttgccttt

SEQ ID NO: 8 - DNA, 23 bp, synthetic construct
  misc_feature 1..23: note = Synthetic Construct
  source 1..23: mol_type = other DNA
aggtttcggctttagttgtgtga

SEQ ID NO: 9 - DNA, 21 bp, synthetic construct
  misc_feature 1..21: note = Synthetic Construct
  source 1..21: mol_type = other DNA
tgtctgcttctgccggcattc

SEQ ID NO: 10 - DNA, 25 bp, synthetic construct
  misc_feature 1..25: note = Synthetic Construct
  source 1..25: mol_type = other DNA
gtccctcacacctttctaccagaag

SEQ ID NO: 11 - DNA, 25 bp, synthetic construct
  misc_feature 1..25: note = Synthetic Construct
  source 1..25: mol_type = other DNA
ggctgcaggagtagaggtctaaatg

SEQ ID NO: 12 - DNA, 25 bp, synthetic construct
  misc_feature 1..25: note = Synthetic Construct
  source 1..25: mol_type = other DNA
ggcaagaagaaaactggagccaaga

SEQ ID NO: 13 - DNA, 24 bp, synthetic construct
  misc_feature 1..24: note = Synthetic Construct
  source 1..24: mol_type = other DNA
gagcctgagttcttgatcactaca

SEQ ID NO: 14 - DNA, 21 bp, synthetic construct
  misc_feature 1..21: note = Synthetic Construct
  source 1..21: mol_type = other DNA
cctggaaaaagccccggtaga

SEQ ID NO: 15 - DNA, 21 bp, synthetic construct
  misc_feature 1..21: note = Synthetic Construct
  source 1..21: mol_type = other DNA
gcaatggtcccagtgagagtt

SEQ ID NO: 16 - DNA, 20 bp, synthetic construct
  misc_feature 1..20: note = Synthetic Construct
  source 1..20: mol_type = other DNA
gccctttggaacctgaccaa

SEQ ID NO: 17 - DNA, 24 bp, synthetic construct
  misc_feature 1..24: note = Synthetic Construct
  source 1..24: mol_type = other DNA
ggccttgatttgacccttcttttc

SEQ ID NO: 18 - DNA, 22 bp, synthetic construct
  misc_feature 1..22: note = Synthetic Construct
  source 1..22: mol_type = other DNA
ccacccgcttctgaaacacatc

SEQ ID NO: 19 - DNA, 18 bp, synthetic construct
  misc_feature 1..18: note = Synthetic Construct
  source 1..18: mol_type = other DNA
tggcgctaaagcccaaca

SEQ ID NO: 20 - DNA, 24 bp, synthetic construct
  misc_feature 1..24: note = Synthetic Construct
  source 1..24: mol_type = other DNA
ccttccccgcttctggatatgaaa

SEQ ID NO: 21 - DNA, 23 bp, synthetic construct
  misc_feature 1..23: note = Synthetic Construct
  source 1..23: mol_type = other DNA
gtcagcgtttacggctattgagt

SEQ ID NO: 22 - DNA, 20 bp, synthetic construct
  misc_feature 1..20: note = Synthetic Construct
  source 1..20: mol_type = other DNA
gcatctccagtgccctctgt

SEQ ID NO: 23 - DNA, 24 bp, synthetic construct
  misc_feature 1..24: note = Synthetic Construct
  source 1..24: mol_type = other DNA
catcttcctagacatgcacacaac

SEQ ID NO: 24 - DNA, 21 bp, synthetic construct
  misc_feature 1..21: note = Synthetic Construct
  source 1..21: mol_type = other DNA
gtcccaagtcaactgccatct

SEQ ID NO: 25 - DNA, 20 bp, synthetic construct
  misc_feature 1..20: note = Synthetic Construct
  source 1..20: mol_type = other DNA
gcgtcagcacagctaacaca

SEQ ID NO: 26 - DNA, 23 bp, synthetic construct
  misc_feature 1..23: note = Synthetic Construct
  source 1..23: mol_type = other DNA
tcacaatgggagggaacattcaa

SEQ ID NO: 27 - DNA, 27 bp, synthetic construct
  misc_feature 1..27: note = Synthetic Construct
  source 1..27: mol_type = other DNA
ggtaaaggctggttgtaaagtccacat

SEQ ID NO: 28 - DNA, 24 bp, synthetic construct
  misc_feature 1..24: note = Synthetic Construct
  source 1..24: mol_type = other DNA
ccgactcaatggggaactcctact

SEQ ID NO: 29 - DNA, 22 bp, synthetic construct
  misc_feature 1..22: note = Synthetic Construct
  source 1..22: mol_type = other DNA
tccttacaccttggggcgtcta

SEQ ID NO: 30 - DNA, 26 bp, synthetic construct
  misc_feature 1..26: note = Synthetic Construct
  source 1..26: mol_type = other DNA
gggcatttctaagacacttggacagt

SEQ ID NO: 31 - DNA, 25 bp, synthetic construct
  misc_feature 1..25: note = Synthetic Construct
  source 1..25: mol_type = other DNA
cactgtatctcaaagggcaaaacaa

SEQ ID NO: 32 - DNA, 23 bp, synthetic construct
  misc_feature 1..23: note = Synthetic Construct
  source 1..23: mol_type = other DNA
acttgtctctgcagacagtttca

SEQ ID NO: 33 - DNA, 20 bp, synthetic construct
  misc_feature 1..20: note = Synthetic Construct
  source 1..20: mol_type = other DNA
ggcctcttggtgcctctgtt

SEQ ID NO: 34 - DNA, 29 bp, synthetic construct
  misc_feature 1..29: note = Synthetic Construct
  source 1..29: mol_type = other DNA
gctagagaaacaagacaacatccaagttc

SEQ ID NO: 35 - DNA, 22 bp, synthetic construct
  misc_feature 1..22: note = Synthetic Construct
  source 1..22: mol_type = other DNA
gcgggcatagagagaaggaaat

SEQ ID NO: 36 - DNA, 23 bp, synthetic construct
  misc_feature 1..23: note = Synthetic Construct
  source 1..23: mol_type = other DNA
ggcttcagtccttcacctctttc

SEQ ID NO: 37 - DNA, 20 bp, synthetic construct
  misc_feature 1..20: note = Synthetic Construct
  source 1..20: mol_type = other DNA
tcagagtcctaggccagcat

SEQ ID NO: 38 - DNA, 24 bp, synthetic construct
  misc_feature 1..24: note = Synthetic Construct
  source 1..24: mol_type = other DNA
ggttcctcatggaagactggtttg

SEQ ID NO: 39 - DNA, 26 bp, synthetic construct
  misc_feature 1..26: note = Synthetic Construct
  source 1..26: mol_type = other DNA
gttgagaagggagtaagatcagacaa

SEQ ID NO: 40 - DNA, 23 bp, synthetic construct
  misc_feature 1..23: note = Synthetic Construct
  source 1..23: mol_type = other DNA
ctcccgcctctaaatgaatggat

SEQ ID NO: 41 - DNA, 23 bp, synthetic construct
  misc_feature 1..23: note = Synthetic Construct
  source 1..23: mol_type = other DNA
cattccctcccctaccctggaaa

SEQ ID NO: 42 - DNA, 22 bp, synthetic construct
  misc_feature 1..22: note = Synthetic Construct
  source 1..22: mol_type = other DNA
gagactcaatcctggcacttgt

SEQ ID NO: 43 - DNA, 22 bp, synthetic construct
  misc_feature 1..22: note = Synthetic Construct
  source 1..22: mol_type = other DNA
cccggctgccatttaagaccat

SEQ ID NO: 44 - DNA, 23 bp, synthetic construct
  misc_feature 1..23: note = Synthetic Construct
  source 1..23: mol_type = other DNA
gatgagggctgagtatggtcaag

SEQ ID NO: 45 - DNA, 22 bp, synthetic construct
  misc_feature 1..22: note = Synthetic Construct
  source 1..22: mol_type = other DNA
ccctttcctgaaccccttcatt

SEQ ID NO: 46 - DNA, 22 bp, synthetic construct
  misc_feature 1..22: note = Synthetic Construct
  source 1..22: mol_type = other DNA
ggggcaccaaagaaaagacaag

SEQ ID NO: 47 - DNA, 26 bp, synthetic construct
  misc_feature 1..26: note = Synthetic Construct
  source 1..26: mol_type = other DNA
catcagtaccccacataggtttaact

SEQ ID NO: 48 - DNA, 26 bp, synthetic construct
  misc_feature 1..26: note = Synthetic Construct
  source 1..26: mol_type = other DNA
ggagctcagtatgagtagaggggaaa

SEQ ID NO: 49 - DNA, 20 bp, synthetic construct
  misc_feature 1..20: note = Synthetic Construct
  source 1..20: mol_type = other DNA
ttgtgcacgacgctggaatg

SEQ ID NO: 50 - DNA, 22 bp, synthetic construct
  misc_feature 1..22: note = Synthetic Construct
  source 1..22: mol_type = other DNA
tcgctaggccattcctcctgtt

SEQ ID NO: 51 - DNA, 26 bp, synthetic construct
  misc_feature 1..26: note = Synthetic Construct
  source 1..26: mol_type = other DNA
cacgacacccttagataatgttggat

SEQ ID NO: 52 - DNA, 19 bp, synthetic construct
  misc_feature 1..19: note = Synthetic Construct
  source 1..19: mol_type = other DNA
tggcacaagcccaggtcat

SEQ ID NO: 53 - DNA, 24 bp, synthetic construct
  misc_feature 1..24: note = Synthetic Construct
  source 1..24: mol_type = other DNA
gcctcctctgcatctctgaaccaa

SEQ ID NO: 54 - DNA, 20 bp, synthetic construct
  misc_feature 1..20: note = Synthetic Construct
  source 1..20: mol_type = other DNA
tgcagcgatcccttcacctt

SEQ ID NO: 55 - DNA, 22 bp, synthetic construct
  misc_feature 1..22: note = Synthetic Construct
  source 1..22: mol_type = other DNA
tggtagtcaggcctagtgactt

SEQ ID NO: 56 - DNA, 24 bp, synthetic construct
  misc_feature 1..24: note = Synthetic Construct
  source 1..24: mol_type = other DNA
gaggtcttccaaaggctattcaga

SEQ ID NO: 57 - DNA, 23 bp, synthetic construct
  misc_feature 1..23: note = Synthetic Construct
  source 1..23: mol_type = other DNA
cctgagcctgtcacactatttct

SEQ ID NO: 58 - DNA, 20 bp, synthetic construct
  misc_feature 1..20: note = Synthetic Construct
  source 1..20: mol_type = other DNA
gagagcaacaggcgttgaga

SEQ ID NO: 59 - DNA, 23 bp, synthetic construct
  misc_feature 1..23: note = Synthetic Construct
  source 1..23: mol_type = other DNA
agccctacaaggtcaagttttca

SEQ ID NO: 60 - DNA, 21 bp, synthetic construct
  misc_feature 1..21: note = Synthetic Construct
  source 1..21: mol_type = other DNA
ggaggcacttcactcctccta

SEQ ID NO: 61 - DNA, 23 bp, synthetic construct
  misc_feature 1..23: note = Synthetic Construct
  source 1..23: mol_type = other DNA
gttggggtcaactttccctgaag

SEQ ID NO: 62 - DNA, 22 bp, synthetic construct
  misc_feature 1..22: note = Synthetic Construct
  source 1..22: mol_type = other DNA
gaggtttggctccatcatcaga

SEQ ID NO: 63 - DNA, 25 bp, synthetic construct
  misc_feature 1..25: note = Synthetic Construct
  source 1..25: mol_type = other DNA
gaggctcatgtctcttcagccttag

SEQ ID NO: 64 - DNA, 22 bp, synthetic construct
  misc_feature 1..22: note = Synthetic Construct
  source 1..22: mol_type = other DNA
gttgcttcccgttatcctcact

SEQ ID NO: 65 - DNA, 24 bp, synthetic construct
  misc_feature 1..24: note = Synthetic Construct
  source 1..24: mol_type = other DNA
gggcctgttcttgttgatagtgtt

SEQ ID NO: 66 - DNA, 26 bp, synthetic construct
  misc_feature 1..26: note = Synthetic Construct
  source 1..26: mol_type = other DNA
gtttgctgttactgaatcccgaatct

SEQ ID NO: 67 - DNA, 26 bp, synthetic construct
  misc_feature 1..26: note = Synthetic Construct
  source 1..26: mol_type = other DNA
gcacatgtaaaaatcctccctactgt

SEQ ID NO: 68 - DNA, 25 bp, synthetic construct
  misc_feature 1..25: note = Synthetic Construct
  source 1..25: mol_type = other DNA
cctctggtaatagcacccaggatac

SEQ ID NO: 69 - DNA, 25 bp, synthetic construct
  misc_feature 1..25: note = Synthetic Construct
  source 1..25: mol_type = other DNA
ctgaggtccagaatccagatgttct

SEQ ID NO: 70 - DNA, 21 bp, synthetic construct
  misc_feature 1..21: note = Synthetic Construct
  source 1..21: mol_type = other DNA
ggacaacaggatcggggatga

SEQ ID NO: 71 - DNA, 22 bp, synthetic construct
  misc_feature 1..22: note = Synthetic Construct
  source 1..22: mol_type = other DNA
ccatgtgtaggaagccctgtga

SEQ ID NO: 72 - DNA, 22 bp, synthetic construct
  misc_feature 1..22: note = Synthetic Construct
  source 1..22: mol_type = other DNA
gcgacctcacttttccagtcat

SEQ ID NO: 73 - DNA, 25 bp, synthetic construct
  misc_feature 1..25: note = Synthetic Construct
  source 1..25: mol_type = other DNA
gtgctattgtggctctgtaggttga

SEQ ID NO: 74 - DNA, 21 bp, synthetic construct
  misc_feature 1..21: note = Synthetic Construct
  source 1..21: mol_type = other DNA
gtttcagcctgagaggcaaga

SEQ ID NO: 75 - DNA, 23 bp, synthetic construct
  misc_feature 1..23: note = Synthetic Construct
  source 1..23: mol_type = other DNA
gagatgaagcgtgtgacccaagt

SEQ ID NO: 76 - DNA, 22 bp, synthetic construct
  misc_feature 1..22: note = Synthetic Construct
  source 1..22: mol_type = other DNA
tgcctcatctctgcccctcttt

SEQ ID NO: 77 - DNA, 22 bp, synthetic construct
  misc_feature 1..22: note = Synthetic Construct
  source 1..22: mol_type = other DNA
tctcagtgcgtttggaaggaaa

SEQ ID NO: 78 - DNA, 22 bp, synthetic construct
  misc_feature 1..22: note = Synthetic Construct
  source 1..22: mol_type = other DNA
aggtttccctggacacacattc

SEQ ID NO: 79 - DNA, 23 bp, synthetic construct
  misc_feature 1..23: note = Synthetic Construct
  source 1..23: mol_type = other DNA
aggagacagggacagtttcaatg

SEQ ID NO: 80 - DNA, 22 bp, synthetic construct
  misc_feature 1..22: note = Synthetic Construct
  source 1..22: mol_type = other DNA
tgggttggaaacacgtccttta

SEQ ID NO: 81 - DNA, 20 bp, synthetic construct
  misc_feature 1..20: note = Synthetic Construct
  source 1..20: mol_type = other DNA
gcccttagcaacagctgcat

SEQ ID NO: 82 - DNA, 21 bp, synthetic construct
  misc_feature 1..21: note = Synthetic Construct
  source 1..21: mol_type = other DNA
gcagacacgcctctggcaaat

SEQ ID NO: 83 - DNA, 21 bp, synthetic construct
  misc_feature 1..21: note = Synthetic Construct
  source 1..21: mol_type = other DNA
gccaaaagtgacagcaacaca

SEQ ID NO: 84 - DNA, 26 bp, synthetic construct
  misc_feature 1..26: note = Synthetic Construct
  source 1..26: mol_type = other DNA
gcacacatccaatccttcagtaaatc

SEQ ID NO: 85 - DNA, 22 bp, synthetic construct
  misc_feature 1..22: note = Synthetic Construct
  source 1..22: mol_type = other DNA
tcctcatccaagctccttctct

SEQ ID NO: 86 - DNA, 24 bp, synthetic construct
  misc_feature 1..24: note = Synthetic Construct
  source 1..24: mol_type = other DNA
ggcactttccacccagaacttaac

SEQ ID NO: 87 - DNA, 20 bp, synthetic construct
  misc_feature 1..20: note = Synthetic Construct
  source 1..20: mol_type = other DNA
aagcccacgttgtgctcttg

SEQ ID NO: 88 - DNA, 26 bp, synthetic construct
  misc_feature 1..26: note = Synthetic Construct
  source 1..26: mol_type = other DNA
ctcagtagggtgaaaaggatggaagt

SEQ ID NO: 89 - DNA, 24 bp, synthetic construct
  misc_feature 1..24: note = Synthetic Construct
  source 1..24: mol_type = other DNA
gctggatctacagaaaccagcaaa

SEQ ID NO: 90 - DNA, 19 bp, synthetic construct
  misc_feature 1..19: note = Synthetic Construct
  source 1..19: mol_type = other DNA
tggctgcagatgcttgtca

SEQ ID NO: 91 - DNA, 22 bp, synthetic construct
  misc_feature 1..22: note = Synthetic Construct
  source 1..22: mol_type = other DNA
gcctctcagcctcacgttctta

SEQ ID NO: 92 - DNA, 20 bp, synthetic construct
  misc_feature 1..20: note = Synthetic Construct
  source 1..20: mol_type = other DNA
tccttgactcacgcctctga

SEQ ID NO: 93 - DNA, 22 bp, synthetic construct
  misc_feature 1..22: note = Synthetic Construct
  source 1..22: mol_type = other DNA
ggaggacatggtgtttgaggat

SEQ ID NO: 94 - DNA, 24 bp, synthetic construct
  misc_feature 1..24: note = Synthetic Construct
  source 1..24: mol_type = other DNA
ctacagttagagtcacacgtcaca

SEQ ID NO: 95 - DNA, 20 bp, synthetic construct
  misc_feature 1..20: note = Synthetic Construct
  source 1..20: mol_type = other DNA
catgcggagggacttagcaa

SEQ ID NO: 96 - DNA, 23 bp, synthetic construct
  misc_feature 1..23: note = Synthetic Construct
  source 1..23: mol_type = other DNA
gctttccagagtagaggcgtttc

SEQ ID NO: 97 - DNA, 24 bp, synthetic construct
  misc_feature 1..24: note = Synthetic Construct
  source 1..24: mol_type = other DNA
tgatggtgcagaattgctacgata

SEQ ID NO: 98 - DNA, 21 bp, synthetic construct
  misc_feature 1..21: note = Synthetic Construct
  source 1..21: mol_type = other DNA
gctgaaatggacccacagaga

SEQ ID NO: 99 - DNA, 20 bp, synthetic construct
  misc_feature 1..20: note = Synthetic Construct
  source 1..20: mol_type = other DNA
tgctccaacgatggctcttc

SEQ ID NO: 100 - DNA, 23 bp, synthetic construct
  misc_feature 1..23: note = Synthetic Construct
  source 1..23: mol_type = other DNA
aggtgaaagcgatgtctgcttag

SEQ ID NO: 101 - DNA, 21 bp, synthetic construct
  misc_feature 1..21: note = Synthetic Construct
  source 1..21: mol_type = other DNA
gccctgacctcaccattggaa

SEQ ID NO: 102 - DNA, 19 bp, synthetic construct
  misc_feature 1..19: note = Synthetic Construct
  source 1..19: mol_type = other DNA
tggggcaattgcgggtatt

SEQ ID NO: 103 - DNA, 25 bp, synthetic construct
  misc_feature 1..25: note = Synthetic Construct
  source 1..25: mol_type = other DNA
gcattacaggagagtgaagatggat

SEQ ID NO: 104 - DNA, 23 bp, synthetic construct
  misc_feature 1..23: note = Synthetic Construct
  source 1..23: mol_type = other DNA
ggaggagaaaggtggtacacttg

SEQ ID NO: 105 - DNA, 24 bp, synthetic construct
  misc_feature 1..24: note = Synthetic Construct
  source 1..24: mol_type = other DNA
ggagacaatacaggttgggtggtt

SEQ ID NO: 106 - DNA, 24 bp, synthetic construct
  misc_feature 1..24: note = Synthetic Construct
  source 1..24: mol_type = other DNA
gcggatcttccttacctagtctga

SEQ ID NO: 107 - DNA, 25 bp, synthetic construct
  misc_feature 1..25: note = Synthetic Construct
  source 1..25: mol_type = other DNA
ggatactgtgtaggaaggcaataca

SEQ ID NO: 108 - DNA, 22 bp, synthetic construct
  misc_feature 1..22: note = Synthetic Construct
  source 1..22: mol_type = other DNA
caactccaaccccagccttttg

SEQ ID NO: 109 - DNA, 24 bp, synthetic construct
  misc_feature 1..24: note = Synthetic Construct
  source 1..24: mol_type = other DNA
caggccaagaatgacatacgactt

SEQ ID NO: 110 - DNA, 22 bp, synthetic construct
  misc_feature 1..22: note = Synthetic Construct
  source 1..22: mol_type = other DNA
ggcgaaaatgagcactgtggaa

SEQ ID NO: 111 - DNA, 23 bp, synthetic construct
  misc_feature 1..23: note = Synthetic Construct
  source 1..23: mol_type = other DNA
ggaaggcagtacaagagcttact

SEQ ID NO: 112 - DNA, 25 bp, synthetic construct
  misc_feature 1..25: note = Synthetic Construct
  source 1..25: mol_type = other DNA
ggcgattcctgacatttgattgcat

SEQ ID NO: 113 - DNA, 21 bp, synthetic construct
  misc_feature 1..21: note = Synthetic Construct
  source 1..21: mol_type = other DNA
ggggtttgtttgggtcagaga

SEQ ID NO: 114 - DNA, 25 bp, synthetic construct
  misc_feature 1..25: note = Synthetic Construct
  source 1..25: mol_type = other DNA
ctgcaatattggccatttctcttca

SEQ ID NO: 115 - DNA, 20 bp, synthetic construct
  misc_feature 1..20: note = Synthetic Construct
  source 1..20: mol_type = other DNA
agtgtgcacgcctggttgaa

SEQ ID NO: 116 - DNA, 22 bp, synthetic construct
  misc_feature 1..22: note = Synthetic Construct
  source 1..22: mol_type = other DNA
ccccagctccttcacaaagact

SEQ ID NO: 117 - DNA, 22 bp, synthetic construct
  misc_feature 1..22: note = Synthetic Construct
  source 1..22: mol_type = other DNA
tggagctgaggaggaaagaaca

SEQ ID NO: 118 - DNA, 27 bp, synthetic construct
  misc_feature 1..27: note = Synthetic Construct
  source 1..27: mol_type = other DNA
tgggtcataaagtgactctgtaacatc

SEQ ID NO: 119 - DNA, 24 bp, synthetic construct
  misc_feature 1..24: note = Synthetic Construct
  source 1..24: mol_type = other DNA
gctgtgaatgttacatggcaggat

SEQ ID NO: 120 - DNA, 22 bp, synthetic construct
  misc_feature 1..22: note = Synthetic Construct
  source 1..22: mol_type = other DNA
cgtcccttaccggagcaacttt

SEQ ID NO: 121 - DNA, 24 bp, synthetic construct
  misc_feature 1..24: note = Synthetic Construct
  source 1..24: mol_type = other DNA
agtgagctagaggctaggacttac

SEQ ID NO: 122 - DNA, 22 bp, synthetic construct
  misc_feature 1..22: note = Synthetic Construct
  source 1..22: mol_type = other DNA
tcctttcctctcatcgcctttg

SEQ ID NO: 123 - DNA, 22 bp, synthetic construct
  misc_feature 1..22: note = Synthetic Construct
  source 1..22: mol_type = other DNA
gggcacagaagggtgttccaaa

SEQ ID NO: 124 - DNA, 21 bp, synthetic construct
  misc_feature 1..21: note = Synthetic Construct
  source 1..21: mol_type = other DNA
ggccctcattgcagtcagcat

SEQ ID NO: 125 - DNA, 24 bp, synthetic construct
  misc_feature 1..24: note = Synthetic Construct
  source 1..24: mol_type = other DNA
tcctgagatgggaaagagtgaaga

SEQ ID NO: 126 - DNA, 25 bp, synthetic construct
  misc_feature 1..25: note = Synthetic Construct
  source 1..25: mol_type = other DNA
gaaactgcacaaacttcctctccta

SEQ ID NO: 127 - DNA, 22 bp, synthetic construct
  misc_feature 1..22: note = Synthetic Construct
  source 1..22: mol_type = other DNA
cgcctgtggttgttgatgaaag

SEQ ID NO: 128 - DNA, 22 bp, synthetic construct
  misc_feature 1..22: note = Synthetic Construct
  source 1..22: mol_type = other DNA
tccccaagagcacagactcaac

SEQ ID NO: 129 - DNA, 22 bp, synthetic construct
  misc_feature 1..22: note = Synthetic Construct
  source 1..22: mol_type = other DNA
cctcttcgcagaccttgaggat

SEQ ID NO: 130 - DNA, 24 bp, synthetic construct
  misc_feature 1..24: note = Synthetic Construct
  source 1..24: mol_type = other DNA
tccacactctaccatttgctgaat

SEQ ID NO: 131 - DNA, 25 bp, synthetic construct
  misc_feature 1..25: note = Synthetic Construct
  source 1..25: mol_type = other DNA
tgaattgtgcagtgaggctatatct

SEQ ID NO: 132 - DNA, 26 bp, synthetic construct
  misc_feature 1..26: note = Synthetic Construct
  source 1..26: mol_type = other DNA
tgtgagtaggatctaggcatgttagt

SEQ ID NO: 133 - DNA, 24 bp, synthetic construct
  misc_feature 1..24: note = Synthetic Construct
  source 1..24: mol_type = other DNA
ggtcacacagagttaatggagaca

SEQ ID NO: 134 - DNA, 21 bp, synthetic construct
  misc_feature 1..21: note = Synthetic Construct
  source 1..21: mol_type = other DNA
ggacccaagaggctgagaaag

SEQ ID NO: 135 - DNA, 22 bp, synthetic construct
  misc_feature 1..22: note = Synthetic Construct
  source 1..22: mol_type = other DNA
ctcgtgggtgtgatggaacaga

SEQ ID NO: 136 - DNA, 20 bp, synthetic construct
  misc_feature 1..20: note = Synthetic Construct
  source 1..20: mol_type = other DNA
tgttgagcgtggaccagtga

SEQ ID NO: 137 - DNA, 21 bp, synthetic construct
  misc_feature 1..21: note = Synthetic Construct
  source 1..21: mol_type = other DNA
ggctgaggctgtagccttgat

SEQ ID NO: 138 - DNA, 24 bp, synthetic construct
  misc_feature 1..24: note = Synthetic Construct
  source 1..24: mol_type = other DNA
gatgggctcaagtcagaggttaag

SEQ ID NO: 139 - DNA, 22 bp, synthetic construct
  misc_feature 1..22: note = Synthetic Construct
  source 1..22: mol_type = other DNA
gacagctgcttctcggctacaa

SEQ ID NO: 140 - DNA, 19 bp, synthetic construct
  misc_feature 1..19: note = Synthetic Construct
  source 1..19: mol_type = other DNA
atcgcacgtactgccatgt

SEQ ID NO: 141 - DNA, 23 bp, synthetic construct
  misc_feature 1..23: note = Synthetic Construct
  source 1..23: mol_type = other DNA
ccagaccatgcatccatccacat

SEQ ID NO: 142 - DNA, 25 bp, synthetic construct
  misc_feature 1..25: note = Synthetic Construct
  source 1..25: mol_type = other DNA
gcaaagaaccatcagggtagacatc

SEQ ID NO: 143 - DNA, 22 bp, synthetic construct
  misc_feature 1..22: note = Synthetic Construct
  source 1..22: mol_type = other DNA
aagggaggccttccactgtcat

SEQ ID NO: 144 - DNA, 22 bp, synthetic construct
  misc_feature 1..22: note = Synthetic Construct
  source 1..22: mol_type = other DNA
aagaggccattgccatagttca

SEQ ID NO: 145 - DNA, 19 bp, synthetic construct
  misc_feature 1..19: note = Synthetic Construct
  source 1..19: mol_type = other DNA
tggggttcaaccggacagt

SEQ ID NO: 146 - DNA, 21 bp, synthetic construct
  misc_feature 1..21: note = Synthetic Construct
  source 1..21: mol_type = other DNA
cgtgccttaagcccaggtatt

SEQ ID NO: 147 - DNA, 22 bp, synthetic construct
  misc_feature 1..22: note = Synthetic Construct
  source 1..22: mol_type = other DNA
ggtctcaggaatccacctccaa

SEQ ID NO: 148 - DNA, 23 bp, synthetic construct
  misc_feature 1..23: note = Synthetic Construct
  source 1..23: mol_type = other DNA
acacagggaacgctctgtaaatg

SEQ ID NO: 149 - DNA, 24 bp, synthetic construct
  misc_feature 1..24: note = Synthetic Construct
  source 1..24: mol_type = other DNA
cctgtccctctttggttgaaggtt

SEQ ID NO: 150 - DNA, 28 bp, synthetic construct
  misc_feature 1..28: note = Synthetic Construct
  source 1..28: mol_type = other DNA
caggcattatctacatgtctgcttgtct

SEQ ID NO: 151 - DNA, 22 bp, synthetic construct
  misc_feature 1..22: note = Synthetic Construct
  source 1..22: mol_type = other DNA
cgtccaagcctcagctgtgtaa

SEQ ID NO: 152 - DNA, 24 bp, synthetic construct
  misc_feature 1..24: note = Synthetic Construct
  source 1..24: mol_type = other DNA
ctagccaaaagccattctggtagt

SEQ ID NO: 153 - DNA, 24 bp, synthetic construct
  misc_feature 1..24: note = Synthetic Construct
  source 1..24: mol_type = other DNA
tgttatctgccttctcccaacaaa

SEQ ID NO: 154 - DNA, 26 bp, synthetic construct
  misc_feature 1..26: note = Synthetic Construct
  source 1..26: mol_type = other DNA
cctcactgccaaatctgatacagaca

SEQ ID NO: 155 - DNA, 29 bp, synthetic construct
  misc_feature 1..29: note = Synthetic Construct
  source 1..29: mol_type = other DNA
cgagaattacacccatctgatcctctttc

SEQ ID NO: 156 - DNA, 22 bp, synthetic construct
  misc_feature 1..22: note = Synthetic Construct
  source 1..22: mol_type = other DNA
ggcaagggctaagacgtttgaa

SEQ ID NO: 157 - DNA, 26 bp, synthetic construct
  misc_feature 1..26: note = Synthetic Construct
  source 1..26: mol_type = other DNA
tcctaactcctacctcatacctcaac

SEQ ID NO: 158 - DNA, 21 bp, synthetic construct
  misc_feature 1..21: note = Synthetic Construct
  source 1..21: mol_type = other DNA
ccgggactagggtggaagtca

SEQ ID NO: 159 - DNA, 22 bp, synthetic construct
  misc_feature 1..22: note = Synthetic Construct
  source 1..22: mol_type = other DNA
tgctacacactagctcctcaca

SEQ ID NO: 160 - DNA, 22 bp, synthetic construct
  misc_feature 1..22: note = Synthetic Construct
  source 1..22: mol_type = other DNA
gcacagacatccagaactgctt

SEQ ID NO: 161 - DNA, 22 bp, synthetic construct
  misc_feature 1..22: note = Synthetic Construct
  source 1..22: mol_type = other DNA
gtgtgcccacagagacttggaa

SEQ ID NO: 162 - DNA, 24 bp, synthetic construct
  misc_feature 1..24: note = Synthetic Construct
  source 1..24: mol_type = other DNA
aagccgcctaataatggaaaccta

SEQ ID NO: 163 - DNA, 24 bp, synthetic construct
  misc_feature 1..24: note = Synthetic Construct
  source 1..24: mol_type = other DNA
atgttctgtagtcgttaggcttgt

SEQ ID NO: 164 - DNA, 23 bp, synthetic construct
  misc_feature 1..23: note = Synthetic Construct
  source 1..23: mol_type = other DNA
tgaaagaggcaggaaaaggttgt

SEQ ID NO: 165 - DNA, 22 bp, synthetic construct
  misc_feature 1..22: note = Synthetic Construct
  source 1..22: mol_type = other DNA
agccagataccgtgagccaaga

SEQ ID NO: 166 - DNA, 27 bp, synthetic construct
  misc_feature 1..27: note = Synthetic Construct
  source 1..27: mol_type = other DNA
cagaagtgggattcaaatccacagaga

SEQ ID NO: 167 - DNA, 22 bp, synthetic construct
  misc_feature 1..22: note = Synthetic Construct
  source 1..22: mol_type = other DNA
ggcccaaagtgctttgagaaca

SEQ ID NO: 168 - DNA, 23 bp, synthetic construct
  misc_feature 1..23: note = Synthetic Construct
  source 1..23: mol_type = other DNA
gtcacggaagaactggtggatca

SEQ ID NO: 169 - DNA, 22 bp, synthetic construct
  misc_feature 1..22: note = Synthetic Construct
  source 1..22: mol_type = other DNA
gcttaataggcgccaaccattt

SEQ ID NO: 170 - DNA, 24 bp, synthetic construct
  misc_feature 1..24: note = Synthetic Construct
  source 1..24: mol_type = other DNA
cagcttccctgtggaattgtcttc

SEQ ID NO: 171 - DNA, 21 bp, synthetic construct
  misc_feature 1..21: note = Synthetic Construct
  source 1..21: mol_type = other DNA
tgaaggctcaccagccagaga

SEQ ID NO: 172 - DNA, 22 bp, synthetic construct
  misc_feature 1..22: note = Synthetic Construct
  source 1..22: mol_type = other DNA
gctgcctcctagagccactaca

SEQ ID NO: 173 - DNA, 20 bp, synthetic construct
  misc_feature 1..20: note = Synthetic Construct
  source 1..20: mol_type = other DNA
tttacgggcctcccaagtca

SEQ ID NO: 174 - DNA, 25 bp, synthetic construct
  misc_feature 1..25: note = Synthetic Construct
  source 1..25: mol_type = other DNA
cgtcagccgataatagctgttgctt

SEQ ID NO: 175 - DNA, 23 bp, synthetic construct
  misc_feature 1..23: note = Synthetic Construct
  source 1..23: mol_type = other DNA
tcttccctaccctgagcctgatg

SEQ ID NO: 176 - DNA, 23 bp, synthetic construct
  misc_feature 1..23: note = Synthetic Construct
  source 1..23: mol_type = other DNA
gccatgtttcacctgctgcttac

SEQ ID NO: 177 - DNA, 23 bp, synthetic construct
  misc_feature 1..23: note = Synthetic Construct
  source 1..23: mol_type = other DNA
cagggctttgtgacctagacaga

SEQ ID NO: 178 - DNA, 19 bp, synthetic construct
  misc_feature 1..19: note = Synthetic Construct
  source 1..19: mol_type = other DNA
tcttgcgcgacaggagaga

SEQ ID NO: 179 - DNA, 22 bp, synthetic construct
  misc_feature 1..22: note = Synthetic Construct
  source 1..22: mol_type = other DNA
ccttccctccttcgtgtcttct

SEQ ID NO: 180 - DNA, 24 bp, synthetic construct
  misc_feature 1..24: note = Synthetic Construct
  source 1..24: mol_type = other DNA
gcacttgaggtaggattggaggaa

SEQ ID NO: 181 - DNA, 21 bp, synthetic construct
  misc_feature 1..21: note = Synthetic Construct
  source 1..21: mol_type = other DNA
gttgtcttggttgccgtgttc

SEQ ID NO: 182 - DNA, 21 bp, synthetic construct
  misc_feature 1..21: note = Synthetic Construct
  source 1..21: mol_type = other DNA
tgcttctgtctggctgagaag

SEQ ID NO: 183 - DNA, 24 bp, synthetic construct
  misc_feature 1..24: note = Synthetic Construct
  source 1..24: mol_type = other DNA
ctccttcgtgtatatgagcagctt

SEQ ID NO: 184 - DNA, 25 bp, synthetic construct
  misc_feature 1..25: note = Synthetic Construct
  source 1..25: mol_type = other DNA
gcccttttccttaaaagcaggaaga

SEQ ID NO: 185 - DNA, 22 bp, synthetic construct
  misc_feature 1..22: note = Synthetic Construct
  source 1..22: mol_type = other DNA
gcgcaggaagagcagtttgatg

SEQ ID NO: 186 - DNA, 23 bp, synthetic construct
  misc_feature 1..23: note = Synthetic Construct
  source 1..23: mol_type = other DNA
ggttccccagattggctcaaaag

SEQ ID NO: 187 - DNA, 19 bp, synthetic construct
  misc_feature 1..19: note = Synthetic Construct
  source 1..19: mol_type = other DNA
atccgccagccgcccaata

SEQ ID NO: 188 - DNA, 25 bp, synthetic construct
  misc_feature 1..25: note = Synthetic Construct
  source 1..25: mol_type = other DNA
ccaagtctcaggtgtgaggagttac

SEQ ID NO: 189 - DNA, 24 bp, synthetic construct
  misc_feature 1..24: note = Synthetic Construct
  source 1..24: mol_type = other DNA
cacactgggttttctggtttcagt

SEQ ID NO: 190 - DNA, 22 bp, synthetic construct
  misc_feature 1..22: note = Synthetic Construct
  source 1..22: mol_type = other DNA
cagggcaactcaacggcaaaag

SEQ ID NO: 191 - DNA, 22 bp, synthetic construct
  misc_feature 1..22: note = Synthetic Construct
  source 1..22: mol_type = other DNA
agctggtcactgtgggagaaga

SEQ ID NO: 192 - DNA, 20 bp, synthetic construct
  misc_feature 1..20: note = Synthetic Construct
  source 1..20: mol_type = other DNA
aggctcagctctggggattg

SEQ ID NO: 193 - DNA, 22 bp, synthetic construct
  misc_feature 1..22: note = Synthetic Construct
  source 1..22: mol_type = other DNA
ggctggctccatcgtttgagat

SEQ ID NO: 194 - DNA, 25 bp, synthetic construct
  misc_feature 1..25: note = Synthetic Construct
  source 1..25: mol_type = other DNA
cagggaagctttgacagaagagata

SEQ ID NO: 195 - DNA, 25 bp, synthetic construct
  misc_feature 1..25: note = Synthetic Construct
  source 1..25: mol_type = other DNA
aggatacaggttggaaagcaagatt

SEQ ID NO: 196 - DNA, 24 bp, synthetic construct
  misc_feature 1..24: note = Synthetic Construct
  source 1..24: mol_type = other DNA
gtgcggctgtcatcaacattcaac

SEQ ID NO: 197 - DNA, 22 bp, synthetic construct
  misc_feature 1..22: note = Synthetic Construct
  source 1..22: mol_type = other DNA
ggaacgggagtcaggtcaaaca

SEQ ID NO: 198 - DNA, 22 bp, synthetic construct
  misc_feature 1..22: note = Synthetic Construct
  source 1..22: mol_type = other DNA
tccctctgtcagtctgggtcta

SEQ ID NO: 199 - DNA, 18 bp, synthetic construct
  misc_feature 1..18: note = Synthetic Construct
  source 1..18: mol_type = other DNA
acgcgcagtccacaaaca

SEQ ID NO: 200 - DNA, 22 bp, synthetic construct
  misc_feature 1..22: note = Synthetic Construct
  source 1..22: mol_type = other DNA
tgcatattgtccaaggctgctt

SEQ ID NO: 201 - DNA, 20 bp, synthetic construct
  misc_feature 1..20: note = Synthetic Construct
  source 1..20: mol_type = other DNA
gccctctgcatctagccaat

SEQ ID NO: 202 - DNA, 22 bp, synthetic construct
  misc_feature 1..22: note = Synthetic Construct
  source 1..22: mol_type = other DNA
tggtccatccaaatcaggcaat

SEQ ID NO: 203 - DNA, 27 bp, synthetic construct
  misc_feature 1..27: note = Synthetic Construct
  source 1..27: mol_type = other DNA
gccgctcctctttctgttccttaaaaa

SEQ ID NO: 204 - DNA, 23 bp, synthetic construct
  misc_feature 1..23: note = Synthetic Construct
  source 1..23: mol_type = other DNA
gcaaaccaggcttttcttgcata

SEQ ID NO: 205 - DNA, 23 bp, synthetic construct
  misc_feature 1..23: note = Synthetic Construct
  source 1..23: mol_type = other DNA
ccatctggctatgtgacggatgt

SEQ ID NO: 206 - DNA, 26 bp, synthetic construct
  misc_feature 1..26: note = Synthetic Construct
  source 1..26: mol_type = other DNA
cagtaaaggaagctttgcaggtttgt

SEQ ID NO: 207 - DNA, 23 bp, synthetic construct
  misc_feature 1..23: note = Synthetic Construct
  source 1..23: mol_type = other DNA
ttaaatactcccatgcccggaaa

SEQ ID NO: 208 - DNA, 23 bp, synthetic construct
  misc_feature 1..23: note = Synthetic Construct
  source 1..23: mol_type = other DNA
ggttgtggagacaaggcttccta

SEQ ID NO: 209 - DNA, 23 bp, synthetic construct
  misc_feature 1..23: note = Synthetic Construct
  source 1..23: mol_type = other DNA
gctgtctctccctaggtcaggtt

SEQ ID NO: 210 - DNA, 24 bp, synthetic construct
  misc_feature 1..24: note = Synthetic Construct
  source 1..24: mol_type = other DNA
atgtgttcctgagagtccctttac

SEQ ID NO: 211 - DNA, 22 bp, synthetic construct
  misc_feature 1..22: note = Synthetic Construct
  source 1..22: mol_type = other DNA
gggacatagcacaggactggat

SEQ ID NO: 212 - DNA, 26 bp, synthetic construct
  misc_feature 1..26: note = Synthetic Construct
  source 1..26: mol_type = other DNA
cagctctacaaattgttgccatcttc

SEQ ID NO: 213 - DNA, 21 bp, synthetic construct
  misc_feature 1..21: note = Synthetic Construct
  source 1..21: mol_type = other DNA
ggctctggaagttgccagtca

SEQ ID NO: 214 - DNA, 24 bp, synthetic construct
  misc_feature 1..24: note = Synthetic Construct
  source 1..24: mol_type = other DNA
ccaagatttggaagagctgaggat

SEQ ID NO: 215 - DNA, 22 bp, synthetic construct
  misc_feature 1..22: note = Synthetic Construct
  source 1..22: mol_type = other DNA
ggctgaagctgtaatccacaca

SEQ ID NO: 216 - DNA, 22 bp, synthetic construct
  misc_feature 1..22: note = Synthetic Construct
  source 1..22: mol_type = other DNA
caaccaggatcgccctagaaaa

SEQ ID NO: 217 - DNA, 22 bp, synthetic construct
  misc_feature 1..22: note = Synthetic Construct
  source 1..22: mol_type = other DNA
aacccagctacggagaggatga

SEQ ID NO: 218 - DNA, 25 bp, synthetic construct
  misc_feature 1..25: note = Synthetic Construct
  source 1..25: mol_type = other DNA
acccagcttaatggttccaaatagt

SEQ ID NO: 219 - DNA, 23 bp, synthetic construct
  misc_feature 1..23: note = Synthetic Construct
  source 1..23: mol_type = other DNA
tgctctgctttcttccagtttca

SEQ ID NO: 220 - DNA, 25 bp, synthetic construct
  misc_feature 1..25: note = Synthetic Construct
  source 1..25: mol_type = other DNA
ccttccaaaagggagggatgttttc

SEQ ID NO: 221 - DNA, 25 bp, synthetic construct
  misc_feature 1..25: note = Synthetic Construct
  source 1..25: mol_type = other DNA
gcattgaaacacctggtttacttca

SEQ ID NO: 222 - DNA, 23 bp, synthetic construct
  misc_feature 1..23: note = Synthetic Construct
  source 1..23: mol_type = other DNA
tgcttgacagctctgttgattgt

SEQ ID NO: 223 - DNA, 25 bp, synthetic construct
  misc_feature 1..25: note = Synthetic Construct
  source 1..25: mol_type = other DNA
gccagctagaaccctatacccagaa

SEQ ID NO: 224 - DNA, 24 bp, synthetic construct
  misc_feature 1..24: note = Synthetic Construct
  source 1..24: mol_type = other DNA
gtgaaatgtcttgcccttgtcatc

SEQ ID NO: 225 - DNA, 20 bp, synthetic construct
  misc_feature 1..20: note = Synthetic Construct
  source 1..20: mol_type = other DNA
caccagctacccaagctcaa

SEQ ID NO: 226 - DNA, 22 bp, synthetic construct
  misc_feature 1..22: note = Synthetic Construct
  source 1..22: mol_type = other DNA
gatgactggaccgcatgtctct

SEQ ID NO: 227 - DNA, 22 bp, synthetic construct
  misc_feature 1..22: note = Synthetic Construct
  source 1..22: mol_type = other DNA
ctcgttcctgctgtgcttgtag

SEQ ID NO: 228 - DNA, 22 bp, synthetic construct
  misc_feature 1..22: note = Synthetic Construct
  source 1..22: mol_type = other DNA
tgcctttggtccctcacacaag

SEQ ID NO: 229 - DNA, 22 bp, synthetic construct
  misc_feature 1..22: note = Synthetic Construct
  source 1..22: mol_type = other DNA
gagaaccacggagagaggaagt

SEQ ID NO: 230 - DNA, 26 bp, synthetic construct
  misc_feature 1..26: note = Synthetic Construct
  source 1..26: mol_type = other DNA
cccacagttagtacatggcagagttt

SEQ ID NO: 231 - DNA, 22 bp, synthetic construct
  misc_feature 1..22: note = Synthetic Construct
  source 1..22: mol_type = other DNA
cctgggagccatgtctgaaact

SEQ ID NO: 232 - DNA, 22 bp, synthetic construct
  misc_feature 1..22: note = Synthetic Construct
  source 1..22: mol_type = other DNA
gggcaccttcacattgctgaga

SEQ ID NO: 233 - DNA, 24 bp, synthetic construct
  misc_feature 1..24: note = Synthetic Construct
  source 1..24: mol_type = other DNA
ggaccctggtctttagttccgatt

SEQ ID NO: 234 - DNA, 22 bp, synthetic construct
  misc_feature 1..22: note = Synthetic Construct
  source 1..22: mol_type = other DNA
agcaccaagggctgaaggaaag

SEQ ID NO: 235 - DNA, 23 bp, synthetic construct
  misc_feature 1..23: note = Synthetic Construct
  source 1..23: mol_type = other DNA
gcaacacagatccactgaagaca

SEQ ID NO: 236 - DNA, 24 bp, synthetic construct
  misc_feature 1..24: note = Synthetic Construct
  source 1..24: mol_type = other DNA
ggctctccataaccagatgctgta

SEQ ID NO: 237 - DNA, 20 bp, synthetic construct
  misc_feature 1..20: note = Synthetic Construct
  source 1..20: mol_type = other DNA
ttccactggcccactgtact

SEQ ID NO: 238 - DNA, 21 bp, synthetic construct
  misc_feature 1..21: note = Synthetic Construct
  source 1..21: mol_type = other DNA
gcccatcagtctcccctgcta

SEQ ID NO: 239 - DNA, 19 bp, synthetic construct
  misc_feature 1..19: note = Synthetic Construct
  source 1..19: mol_type = other DNA
ccagtcatccggggcactt

SEQ ID NO: 240 - DNA, 25 bp, synthetic construct
  misc_feature 1..25: note = Synthetic Construct
  source 1..25: mol_type = other DNA
gtggaatccaatcactcagccttca

SEQ ID NO: 241 - DNA, 24 bp, synthetic construct
  misc_feature 1..24: note = Synthetic Construct
  source 1..24: mol_type = other DNA
cgcccactgctatctctaccattc

SEQ ID NO: 242 - DNA, 21 bp, synthetic construct
  misc_feature 1..21: note = Synthetic Construct
  source 1..21: mol_type = other DNA
agtgcctggccatctgctgta

SEQ ID NO: 243 - DNA, 23 bp, synthetic construct
  misc_feature 1..23: note = Synthetic Construct
  source 1..23: mol_type = other DNA
gtgttcatccatcagggccaatg

SEQ ID NO: 244 - DNA, 21 bp, synthetic construct
  misc_feature 1..21: note = Synthetic Construct
  source 1..21: mol_type = other DNA
gctaaccttggcactgtggat

SEQ ID NO: 245 - DNA, 22 bp, synthetic construct
  misc_feature 1..22: note = Synthetic Construct
  source 1..22: mol_type = other DNA
gctgtcatccatggtccagaca

SEQ ID NO: 246 - DNA, 23 bp, synthetic construct
  misc_feature 1..23: note = Synthetic Construct
  source 1..23: mol_type = other DNA
ccatggaagagggagatggaagt

SEQ ID NO: 247 - DNA, 19 bp, synthetic construct
  misc_feature 1..19: note = Synthetic Construct
  source 1..19: mol_type = other DNA
ccacctcttgggccctttg

SEQ ID NO: 248 - DNA, 27 bp, synthetic construct
  misc_feature 1..27: note = Synthetic Construct
  source 1..27: mol_type = other DNA
cacagaatatgggctgagaatccaaga

SEQ ID NO: 249 - DNA, 20 bp, synthetic construct
  misc_feature 1..20: note = Synthetic Construct
  source 1..20: mol_type = other DNA
gagtccccaccagcaagaag

SEQ ID NO: 250 - DNA, 22 bp, synthetic construct
  misc_feature 1..22: note = Synthetic Construct
  source 1..22: mol_type = other DNA
gtgatgtggctactgcttcact

SEQ ID NO: 251 - DNA, 20 bp, synthetic construct
  misc_feature 1..20: note = Synthetic Construct
  source 1..20: mol_type = other DNA
gcttccctcttccagtgctt

SEQ ID NO: 252 - DNA, 23 bp, synthetic construct
  misc_feature 1..23: note = Synthetic Construct
  source 1..23: mol_type = other DNA
ctgcactgtgattctggcatagt

SEQ ID NO: 253 - DNA, 22 bp, synthetic construct
  misc_feature 1..22: note = Synthetic Construct
  source 1..22: mol_type = other DNA
cccctccactaacggtgcatta

SEQ ID NO: 254 - DNA, 26 bp, synthetic construct
  misc_feature 1..26: note = Synthetic Construct
  source 1..26: mol_type = other DNA
cagggatgaaagacagagagcatttg

SEQ ID NO: 255 - DNA, 22 bp, synthetic construct
  misc_feature 1..22: note = Synthetic Construct
  source 1..22: mol_type = other DNA
cccctcgaggctgttttagtga

SEQ ID NO: 256 - DNA, 20 bp, synthetic construct
  misc_feature 1..20: note = Synthetic Construct
  source 1..20: mol_type = other DNA
ccagtgtcagggccgagtag

SEQ ID NO: 257 - DNA, 20 bp, synthetic construct
  misc_feature 1..20: note = Synthetic Construct
  source 1..20: mol_type = other DNA
tgctgctttacgcccagtga

SEQ ID NO: 258 - DNA, 20 bp, synthetic construct
  misc_feature 1..20: note = Synthetic Construct
  source 1..20: mol_type = other DNA
gaccaatggggtgtcagctt

SEQ ID NO: 259 - DNA, 21 bp, synthetic construct
  misc_feature 1..21: note = Synthetic Construct
  source 1..21: mol_type = other DNA
aggctatgggaggtgggaaca

SEQ ID NO: 260 - DNA, 25 bp, synthetic construct
  misc_feature 1..25: note = Synthetic Construct
  source 1..25: mol_type = other DNA
ctgtgtatgtgggtctgaagctcaa

SEQ ID NO: 261 - DNA, 20 bp, synthetic construct
  misc_feature 1..20: note = Synthetic Construct
  source 1..20: mol_type = other DNA
ggggctcagatcccttggtt

SEQ ID NO: 262 - DNA, 22 bp, synthetic construct
  misc_feature 1..22: note = Synthetic Construct
  source 1..22: mol_type = other DNA
agcatccgtggaggcttttaat

SEQ ID NO: 263 - DNA, 24 bp, synthetic construct
  misc_feature 1..24: note = Synthetic Construct
  source 1..24: mol_type = other DNA
acgatttctgaagcagtcttggta

SEQ ID NO: 264 - DNA, 21 bp, synthetic construct
  misc_feature 1..21: note = Synthetic Construct
  source 1..21: mol_type = other DNA
gggcattagctggccttcaca

SEQ ID NO: 265 - DNA, 21 bp, synthetic construct
  misc_feature 1..21: note = Synthetic Construct
  source 1..21: mol_type = other DNA
tcccacttacaggcccgttct

SEQ ID NO: 266 - DNA, 23 bp, synthetic construct
  misc_feature 1..23: note = Synthetic Construct
  source 1..23: mol_type = other DNA
tttcagaagtgctggaaccaaga

SEQ ID NO: 267 - DNA, 22 bp, synthetic construct
  misc_feature 1..22: note = Synthetic Construct
  source 1..22: mol_type = other DNA
catgaaagcactggggttctct

SEQ ID NO: 268 - DNA, 25 bp, synthetic construct
  misc_feature 1..25: note = Synthetic Construct
  source 1..25: mol_type = other DNA
cgagagaggaagacactggagtgaa

SEQ ID NO: 269 - DNA, 27 bp, synthetic construct
  misc_feature 1..27: note = Synthetic Construct
  source 1..27: mol_type = other DNA
ccttcctccacactaagtgactggaaa

SEQ ID NO: 270 - DNA, 19 bp, synthetic construct
  misc_feature 1..19: note = Synthetic Construct
  source 1..19: mol_type = other DNA
cagcccatcctgggcatct

SEQ ID NO: 271 - DNA, 20 bp, synthetic construct
  misc_feature 1..20: note = Synthetic Construct
  source 1..20: mol_type = other DNA
aggctggcaaatgggctcaa

SEQ ID NO: 272 - DNA, 18 bp, synthetic construct
  misc_feature 1..18: note = Synthetic Construct
  source 1..18: mol_type = other DNA
gctgagcccagcagtgtt

SEQ ID NO: 273 - DNA, 24 bp, synthetic construct
  misc_feature 1..24: note = Synthetic Construct
  source 1..24: mol_type = other DNA
cctggctgggctacatcttacctt

SEQ ID NO: 274 - DNA, 22 bp, synthetic construct
  misc_feature 1..22: note = Synthetic Construct
  source 1..22: mol_type = other DNA
gcatggggacctgagactttct

SEQ ID NO: 275 - DNA, 21 bp, synthetic construct
  misc_feature 1..21: note = Synthetic Construct
  source 1..21: mol_type = other DNA
gggccgatgagcaagtcagtt

SEQ ID NO: 276 - DNA, 24 bp, synthetic construct
  misc_feature 1..24: note = Synthetic Construct
  source 1..24: mol_type = other DNA
cctccccgaaaggaaacagagcat

SEQ ID NO: 277 - DNA, 22 bp, synthetic construct
  misc_feature 1..22: note = Synthetic Construct
  source 1..22: mol_type = other DNA
tggatggtgagaagagccaatg

SEQ ID NO: 278 - DNA, 20 bp, synthetic construct
  misc_feature 1..20: note = Synthetic Construct
  source 1..20: mol_type = other DNA
gcctggtcaccatccgcttt

SEQ ID NO: 279 - DNA, 22 bp, synthetic construct
  misc_feature 1..22: note = Synthetic Construct
  source 1..22: mol_type = other DNA
gacactcacaggctcagagaac

SEQ ID NO: 280 - DNA, 20 bp, synthetic construct
  misc_feature 1..20: note = Synthetic Construct
  source 1..20: mol_type = other DNA
tgagcactcctgggtcaaga

SEQ ID NO: 281 - DNA, 21 bp, synthetic construct
  misc_feature 1..21: note = Synthetic Construct
  source 1..21: mol_type = other DNA
cttggctcgattggtccaaca

SEQ ID NO: 282 - DNA, 20 bp, synthetic construct
  misc_feature 1..20: note = Synthetic Construct
  source 1..20: mol_type = other DNA
ccagagcagccaggtcttca

SEQ ID NO: 283 - DNA, 20 bp, synthetic construct
  misc_feature 1..20: note = Synthetic Construct
  source 1..20: mol_type = other DNA
tctcctcgcccaagatcaga

SEQ ID NO: 284 - DNA, 24 bp, synthetic construct
  misc_feature 1..24: note = Synthetic Construct
  source 1..24: mol_type = other DNA
cctcagcccaggactcacttttag

SEQ ID NO: 285 - DNA, 19 bp, synthetic construct
  misc_feature 1..19: note = Synthetic Construct
  source 1..19: mol_type = other DNA
tccatgacgggcagctgta

SEQ ID NO: 286 - DNA, 22 bp, synthetic construct
  misc_feature 1..22: note = Synthetic Construct
  source 1..22: mol_type = other DNA
caccctgggatcaagtccaagt

SEQ ID NO: 287 - DNA, 20 bp, synthetic construct
  misc_feature 1..20: note = Synthetic Construct
  source 1..20: mol_type = other DNA
tgcatgctgggacacagaga

SEQ ID NO: 288 - DNA, 20 bp, synthetic construct
  misc_feature 1..20: note = Synthetic Construct
  source 1..20: mol_type = other DNA
aggggctgctggggcttgta

SEQ ID NO: 289 - DNA, 22 bp, synthetic construct
  misc_feature 1..22: note = Synthetic Construct
  source 1..22: mol_type = other DNA
gcgctgcctagtgacattggtt

SEQ ID NO: 290 - DNA, 22 bp, synthetic construct
  misc_feature 1..22: note = Synthetic Construct
  source 1..22: mol_type = other DNA
tggtggtggtccccagtaatgt

SEQ ID NO: 291 - DNA, 21 bp, synthetic construct
  misc_feature 1..21: note = Synthetic Construct
  source 1..21: mol_type = other DNA
ccctggtgggttttgagtgaa

SEQ ID NO: 292 - DNA, 21 bp, synthetic construct
  misc_feature 1..21: note = Synthetic Construct
  source 1..21: mol_type = other DNA
cccacttagagccccaggaaa

SEQ ID NO: 293 - DNA, 20 bp, synthetic construct
  misc_feature 1..20: note = Synthetic Construct
  source 1..20: mol_type = other DNA
cgatcggctttgcaggcttt

SEQ ID NO: 294 - DNA, 22 bp, synthetic construct
  misc_feature 1..22: note = Synthetic Construct
  source 1..22: mol_type = other DNA
aaccagatcgtgtctccctagt

SEQ ID NO: 295 - DNA, 21 bp, synthetic construct
  misc_feature 1..21: note = Synthetic Construct
  source 1..21: mol_type = other DNA
ccaacagcgtgaggcttctga

SEQ ID NO: 296 - DNA, 23 bp, synthetic construct
  misc_feature 1..23: note = Synthetic Construct
  source 1..23: mol_type = other DNA
gcctggaacacactgtactctga

SEQ ID NO: 297 - DNA, 18 bp, synthetic construct
  misc_feature 1..18: note = Synthetic Construct
  source 1..18: mol_type = other DNA
tcctgcccgtctgctcaa

SEQ ID NO: 298 - DNA, 24 bp, synthetic construct
  misc_feature 1..24: note = Synthetic Construct
  source 1..24: mol_type = other DNA
tgaaaccagaagctttcacctcat

SEQ ID NO: 299 - DNA, 22 bp, synthetic construct
  misc_feature 1..22: note = Synthetic Construct
  source 1..22: mol_type = other DNA
agtcagggtgtctcttccatga

SEQ ID NO: 300 - DNA, 24 bp, synthetic construct
  misc_feature 1..24: note = Synthetic Construct
  source 1..24: mol_type = other DNA
gagcaaaagagctgttccagagaa

SEQ ID NO: 301 - DNA, 24 bp, synthetic construct
  misc_feature 1..24: note = Synthetic Construct
  source 1..24: mol_type = other DNA
ccttctacacaggatgggatgagt

SEQ ID NO: 302 - DNA, 21 bp, synthetic construct
  misc_feature 1..21: note = Synthetic Construct
  source 1..21: mol_type = other DNA
tgaagggttcccctccaaagt

SEQ ID NO: 303 - DNA, 23 bp, synthetic construct
  misc_feature 1..23: note = Synthetic Construct
  source 1..23: mol_type = other DNA
gcctacatgtctatcccctgaag

SEQ ID NO: 304 - DNA, 21 bp, synthetic construct
  misc_feature 1..21: note = Synthetic Construct
  source 1..21: mol_type = other DNA
gctggaaaccatggcggagtt

SEQ ID NO: 305 - DNA, 20 bp, synthetic construct
  misc_feature 1..20: note = Synthetic Construct
  source 1..20: mol_type = other DNA
gggccagtacccaggaggaa

SEQ ID NO: 306 - DNA, 21 bp, synthetic construct
  misc_feature 1..21: note = Synthetic Construct
  source 1..21: mol_type = other DNA
cacagggatgagcaccaccat

SEQ ID NO: 307 - DNA, 23 bp, synthetic construct
  misc_feature 1..23: note = Synthetic Construct
  source 1..23: mol_type = other DNA
tggcagagttgtcaggatttcaa

SEQ ID NO: 308 - DNA, 20 bp, synthetic construct
  misc_feature 1..20: note = Synthetic Construct
  source 1..20: mol_type = other DNA
aggcgagtgtcccaagacaa

SEQ ID NO: 309 - DNA, 24 bp, synthetic construct
  misc_feature 1..24: note = Synthetic Construct
  source 1..24: mol_type = other DNA
gtgaaccagggacatctggacaag

SEQ ID NO: 310 - DNA, 21 bp, synthetic construct
  misc_feature 1..21: note = Synthetic Construct
  source 1..21: mol_type = other DNA
tcaggcacaggccaggtatag

SEQ ID NO: 311 - DNA, 21 bp, synthetic construct
  misc_feature 1..21: note = Synthetic Construct
  source 1..21: mol_type = other DNA
ccggacgcagacggaattact

SEQ ID NO: 312 - DNA, 20 bp, synthetic construct
  misc_feature 1..20: note = Synthetic Construct
  source 1..20: mol_type = other DNA
ggcagtttggggagctgtgt

SEQ ID NO: 313 - DNA, 20 bp, synthetic construct
  misc_feature 1..20: note = Synthetic Construct
  source 1..20: mol_type = other DNA
ctgacatttgcgggctgttg

SEQ ID NO: 314 - DNA, 22 bp, synthetic construct
  misc_feature 1..22: note = Synthetic Construct
  source 1..22: mol_type = other DNA
cttcatgggacccaagcctatg

SEQ ID NO: 315 - DNA, 20 bp, synthetic construct
  misc_feature 1..20: note = Synthetic Construct
  source 1..20: mol_type = other DNA
ctggctggacccttcctgat

SEQ ID NO: 316 - DNA, 18 bp, synthetic construct
  misc_feature 1..18: note = Synthetic Construct
  source 1..18: mol_type = other DNA
ggcccttggctgtgtgaa

SEQ ID NO: 317 - DNA, 22 bp, synthetic construct
  misc_feature 1..22: note = Synthetic Construct
  source 1..22: mol_type = other DNA
ttcctcgtggaccctactgtgt

SEQ ID NO: 318 - DNA, 22 bp, synthetic construct
  misc_feature 1..22: note = Synthetic Construct
  source 1..22: mol_type = other DNA
cgttggctcctaaagtcagcta

SEQ ID NO: 319 - DNA, 22 bp, synthetic construct
  misc_feature 1..22: note = Synthetic Construct
  source 1..22: mol_type = other DNA
gtgtaagggcggctctaactga

SEQ ID NO: 320 - DNA, 20 bp, synthetic construct
  misc_feature 1..20: note = Synthetic Construct
  source 1..20: mol_type = other DNA
atcagaggagggcggaccaa

SEQ ID NO: 321 - DNA, 23 bp, synthetic construct
  misc_feature 1..23: note = Synthetic Construct
  source 1..23: mol_type = other DNA
ggagaccatgggaacccttcaac

SEQ ID NO: 322 - DNA, 22 bp, synthetic construct
  misc_feature 1..22: note = Synthetic Construct
  source 1..22: mol_type = other DNA
ggtcctgtcgttgaggtagtca

SEQ ID NO: 323 - DNA, 20 bp, synthetic construct
  misc_feature 1..20: note = Synthetic Construct
  source 1..20: mol_type = other DNA
gggctagcaaacacccaagt

SEQ ID NO: 324 - DNA, 22 bp, synthetic construct
  misc_feature 1..22: note = Synthetic Construct
  source 1..22: mol_type = other DNA
gccaaatgaacctggccctgta

SEQ ID NO: 325 - DNA, 21 bp, synthetic construct
  misc_feature 1..21: note = Synthetic Construct
  source 1..21: mol_type = other DNA
gccacaaaggcccactacaga

SEQ ID NO: 326 - DNA, 22 bp, synthetic construct
  misc_feature 1..22: note = Synthetic Construct
  source 1..22: mol_type = other DNA
gtcttccaggtcagcaatccaa

SEQ ID NO: 327 - DNA, 23 bp, synthetic construct
  misc_feature 1..23: note = Synthetic Construct
  source 1..23: mol_type = other DNA
catgcccagcaattgtcccttag

SEQ ID NO: 328 - DNA, 22 bp, synthetic construct
  misc_feature 1..22: note = Synthetic Construct
  source 1..22: mol_type = other DNA
gcagtcttggcagagctttact

SEQ ID NO: 329 - DNA, 22 bp, synthetic construct
  misc_feature 1..22: note = Synthetic Construct
  source 1..22: mol_type = other DNA
gaagagtcagtggccttgaaga

SEQ ID NO: 330 - DNA, 25 bp, synthetic construct
  misc_feature 1..25: note = Synthetic Construct
  source 1..25: mol_type = other DNA
gtggtgtatgttgtagtcccagcta

SEQ ID NO: 331 - DNA, 24 bp, synthetic construct
  misc_feature 1..24: note = Synthetic Construct
  source 1..24: mol_type = other DNA
gtggggtagtggtaaagtaagcat

SEQ ID NO: 332 - DNA, 22 bp, synthetic construct
  misc_feature 1..22: note = Synthetic Construct
  source 1..22: mol_type = other DNA
gggtccctgctccatctcattt

SEQ ID NO: 333 - DNA, 20 bp, synthetic construct
  misc_feature 1..20: note = Synthetic Construct
  source 1..20: mol_type = other DNA
agggccctcccgcaattaga

SEQ ID NO: 334 - DNA, 22 bp, synthetic construct
  misc_feature 1..22: note = Synthetic Construct
  source 1..22: mol_type = other DNA
cctgaggtcttggcccacaata

SEQ ID NO: 335 - DNA, 20 bp, synthetic construct
  misc_feature 1..20: note = Synthetic Construct
  source 1..20: mol_type = other DNA
ttcagcgggaaccaccatgt

SEQ ID NO: 336 - DNA, 29 bp, synthetic construct
  misc_feature 1..29: note = Synthetic Construct
  source 1..29: mol_type = other DNA
ctgacttcctagtcttcccttctatgaaa

SEQ ID NO: 337 - DNA, 23 bp, synthetic construct
  misc_feature 1..23: note = Synthetic Construct
  source 1..23: mol_type = other DNA
ggtttacaggttagggcatggat

SEQ ID NO: 338 - DNA, 22 bp, synthetic construct
  misc_feature 1..22: note = Synthetic Construct
  source 1..22: mol_type = other DNA
aggaccggaggactgctctatt

SEQ ID NO: 339 - DNA, 22 bp, synthetic construct
  misc_feature 1..22: note = Synthetic Construct
  source 1..22: mol_type = other DNA
aagggcagcgtatccctctaca

SEQ ID NO: 340 - DNA, 23 bp, synthetic construct
  misc_feature 1..23: note = Synthetic Construct
  source 1..23: mol_type = other DNA
gtggcccagtttttgctcagaga

SEQ ID NO: 341 - DNA, 26 bp, synthetic construct
  misc_feature 1..26: note = Synthetic Construct
  source 1..26: mol_type = other DNA
ggtgcaggatttttctcgacctcttt

SEQ ID NO: 342 - DNA, 22 bp, synthetic construct
  misc_feature 1..22: note = Synthetic Construct
  source 1..22: mol_type = other DNA
tctctgtgtctcctcaccagtt

SEQ ID NO: 343 - DNA, 22 bp, synthetic construct
  misc_feature 1..22: note = Synthetic Construct
  source 1..22: mol_type = other DNA
ccaactggtccctgcattcttg

SEQ ID NO: 344 - DNA, 23 bp, synthetic construct
  misc_feature 1..23: note = Synthetic Construct
  source 1..23: mol_type = other DNA
gtgtgaggatcctgcagcattta

SEQ ID NO: 345 - DNA, 21 bp, synthetic construct
  misc_feature 1..21: note = Synthetic Construct
  source 1..21: mol_type = other DNA
agtccctcagctcagcccata

SEQ ID NO: 346 - DNA, 23 bp, synthetic construct
  misc_feature 1..23: note = Synthetic Construct
  source 1..23: mol_type = other DNA
gccaaggggtaaccctaaaggta

SEQ ID NO: 347 - DNA, 20 bp, synthetic construct
  misc_feature 1..20: note = Synthetic Construct
  source 1..20: mol_type = other DNA
ggttggaaggtgacgctaca

SEQ ID NO: 348 - DNA, 19 bp, synthetic construct
  misc_feature 1..19: note = Synthetic Construct
  source 1..19: mol_type = other DNA
cctgcacttgcccggttct

SEQ ID NO: 349 - DNA, 23 bp, synthetic construct
  misc_feature 1..23: note = Synthetic Construct
  source 1..23: mol_type = other DNA
gctccaagaagtgcatccaggtt

SEQ ID NO: 350 - DNA, 21 bp, synthetic construct
  misc_feature 1..21: note = Synthetic Construct
  source 1..21: mol_type = other DNA
gtgctgggtcacactcaaact

SEQ ID NO: 351 - DNA, 21 bp, synthetic construct
  misc_feature 1..21: note = Synthetic Construct
  source 1..21: mol_type = other DNA
tgtcgtccccactgtggaact

SEQ ID NO: 352 - DNA, 21 bp, synthetic construct
  misc_feature 1..21: note = Synthetic Construct
  source 1..21: mol_type = other DNA
ccccaggcaactcacttcaca

SEQ ID NO: 353 - DNA, 20 bp, synthetic construct
  misc_feature 1..20: note = Synthetic Construct
  source 1..20: mol_type = other DNA
agagtagacgcgccctggaa

SEQ ID NO: 354 - DNA, 21 bp, synthetic construct
  misc_feature 1..21: note = Synthetic Construct
  source 1..21: mol_type = other DNA
gctagcaggacttgggcaaca

SEQ ID NO: 355 - DNA, 23 bp, synthetic construct
  misc_feature 1..23: note = Synthetic Construct
  source 1..23: mol_type = other DNA
ctgaaccagctcggacagagaag

SEQ ID NO: 356 - DNA, 22 bp, synthetic construct
  misc_feature 1..22: note = Synthetic Construct
  source 1..22: mol_type = other DNA
caccacgttgatgcagagtttc

SEQ ID NO: 357 - DNA, 23 bp, synthetic construct
  misc_feature 1..23: note = Synthetic Construct
  source 1..23: mol_type = other DNA
ccaagtgcagaagctggaaaaca

SEQ ID NO: 358 - DNA, 24 bp, synthetic construct
  misc_feature 1..24: note = Synthetic Construct
  source 1..24: mol_type = other DNA
gaccaggccctttgattgttctgt

SEQ ID NO: 359 - DNA, 22 bp, synthetic construct
  misc_feature 1..22: note = Synthetic Construct
  source 1..22: mol_type = other DNA
taagtccccgtgctcacagcat

SEQ ID NO: 360 - DNA, 25 bp, synthetic construct
  misc_feature 1..25: note = Synthetic Construct
  source 1..25: mol_type = other DNA
gctccatcctgtgaatgaagtaagt

SEQ ID NO: 361 - DNA, 24 bp, synthetic construct
  misc_feature 1..24: note = Synthetic Construct
  source 1..24: mol_type = other DNA
gggatccatcaccgttccaaacat

SEQ ID NO: 362 - DNA, 19 bp, synthetic construct
  misc_feature 1..19: note = Synthetic Construct
  source 1..19: mol_type = other DNA
ggagagtccagggcgtctt

SEQ ID NO: 363 - DNA, 22 bp, synthetic construct
  misc_feature 1..22: note = Synthetic Construct
  source 1..22: mol_type = other DNA
cttcacagtgcctgggacattt

SEQ ID NO: 364 - DNA, 23 bp, synthetic construct
  misc_feature 1..23: note = Synthetic Construct
  source 1..23: mol_type = other DNA
tccaggatggggaaggacctaag

SEQ ID NO: 365 - DNA, 24 bp, synthetic construct
  misc_feature 1..24: note = Synthetic Construct
  source 1..24: mol_type = other DNA
ctaagctcaaagtcaagggacaga

SEQ ID NO: 366 - DNA, 25 bp, synthetic construct
  misc_feature 1..25: note = Synthetic Construct
  source 1..25: mol_type = other DNA
gagaagaaagtcgccctgaaaatac

SEQ ID NO: 367 - DNA, 20 bp, synthetic construct
  misc_feature 1..20: note = Synthetic Construct
  source 1..20: mol_type = other DNA
gtgctttcccacagcgaatc

SEQ ID NO: 368 - DNA, 20 bp, synthetic construct
  misc_feature 1..20: note = Synthetic Construct
  source 1..20: mol_type = other DNA
ggtgctgcagagggtggaaa

SEQ ID NO: 369 - DNA, 20 bp, synthetic construct
  misc_feature 1..20: note = Synthetic Construct
  source 1..20: mol_type = other DNA
aactaccctcccacccaaca

SEQ ID NO: 370 - DNA, 28 bp, synthetic construct
  misc_feature 1..28: note = Synthetic Construct
  source 1..28: mol_type = other DNA
gttgggtggacagtctttttcatctttg

SEQ ID NO: 371 - DNA, 23 bp, synthetic construct
  misc_feature 1..23: note = Synthetic Construct
  source 1..23: mol_type = other DNA
gtgctctcccttgaaatgaggat

SEQ ID NO: 372 - DNA, 21 bp, synthetic construct
  misc_feature 1..21: note = Synthetic Construct
  source 1..21: mol_type = other DNA
gatggtggaaaccgaccaact

SEQ ID NO: 373 - DNA, 18 bp, synthetic construct
  misc_feature 1..18: note = Synthetic Construct
  source 1..18: mol_type = other DNA
tgcagggtggcagcatga

SEQ ID NO: 374 - DNA, 24 bp, synthetic construct
  misc_feature 1..24: note = Synthetic Construct
  source 1..24: mol_type = other DNA
gccctctgacttcactgacctact

SEQ ID NO: 375 - DNA, 21 bp, synthetic construct
  misc_feature 1..21: note = Synthetic Construct
  source 1..21: mol_type = other DNA
tggggttgaggtccccttatg

SEQ ID NO: 376 - DNA, 22 bp, synthetic construct
  misc_feature 1..22: note = Synthetic Construct
  source 1..22: mol_type = other DNA
ccccttcatctgccctggtagt

SEQ ID NO: 377 - DNA, 22 bp, synthetic construct
  misc_feature 1..22: note = Synthetic Construct
  source 1..22: mol_type = other DNA
cctctgcaccttggcctacatt

SEQ ID NO: 378 - DNA, 21 bp, synthetic construct
  misc_feature 1..21: note = Synthetic Construct
  source 1..21: mol_type = other DNA
ggcggaaaccaaaccctcaga

SEQ ID NO: 379 - DNA, 20 bp, synthetic construct
  misc_feature 1..20: note = Synthetic Construct
  source 1..20: mol_type = other DNA
gggcccctcccacatacaca

SEQ ID NO: 380 - DNA, 22 bp, synthetic construct
  misc_feature 1..22: note = Synthetic Construct
  source 1..22: mol_type = other DNA
gcccatgctgaggactaacctt

SEQ ID NO: 381 - DNA, 21 bp, synthetic construct
  misc_feature 1..21: note = Synthetic Construct
  source 1..21: mol_type = other DNA
ccctaaggttgggtcgagttg

SEQ ID NO: 382 - DNA, 21 bp, synthetic construct
  misc_feature 1..21: note = Synthetic Construct
  source 1..21: mol_type = other DNA
cagggtcccaacgggtttcta

SEQ ID NO: 383 - DNA, 21 bp, synthetic construct
  misc_feature 1..21: note = Synthetic Construct
  source 1..21: mol_type = other DNA
gccccagcattcacactgcat

SEQ ID NO: 384 - DNA, 21 bp, synthetic construct
  misc_feature 1..21: note = Synthetic Construct
  source 1..21: mol_type = other DNA
gcaagtagctgggccttgtca

SEQ ID NO: 385 - DNA, 22 bp, synthetic construct
  misc_feature 1..22: note = Synthetic Construct
  source 1..22: mol_type = other DNA
gcaccatcaggagatgcagact

SEQ ID NO: 386 - DNA, 25 bp, synthetic construct
  misc_feature 1..25: note = Synthetic Construct
  source 1..25: mol_type = other DNA
ctctgtcagtttctgagtgggatga

SEQ ID NO: 387 - DNA, 21 bp, synthetic construct
  misc_feature 1..21: note = Synthetic Construct
  source 1..21: mol_type = other DNA
gaggcctcactctccccttat

SEQ ID NO: 388 - DNA, 23 bp, synthetic construct
  misc_feature 1..23: note = Synthetic Construct
  source 1..23: mol_type = other DNA
tcatgctgcttgggtaatgttct

SEQ ID NO: 389 - DNA, 19 bp, synthetic construct
  misc_feature 1..19: note = Synthetic Construct
  source 1..19: mol_type = other DNA
ctgggccatcctcctgtct

SEQ ID NO: 390 - DNA, 20 bp, synthetic construct
  misc_feature 1..20: note = Synthetic Construct
  source 1..20: mol_type = other DNA
tggagagtggggaggagctt

SEQ ID NO: 391 - DNA, 21 bp, synthetic construct
  misc_feature 1..21: note = Synthetic Construct
  source 1..21: mol_type = other DNA
ggagcatgccgccttgttact

SEQ ID NO: 392 - DNA, 24 bp, synthetic construct
  misc_feature 1..24: note = Synthetic Construct
  source 1..24: mol_type = other DNA
gtctcttccctgaagtagggttgt

SEQ ID NO: 393 - DNA, 24 bp, synthetic construct
  misc_feature 1..24: note = Synthetic Construct
  source 1..24: mol_type = other DNA
tcactcacatcatcatggttggat

SEQ ID NO: 394 - DNA, 20 bp, synthetic construct
  misc_feature 1..20: note = Synthetic Construct
  source 1..20: mol_type = other DNA
ggagcagcattgccttcgtt

SEQ ID NO: 395 - DNA, 20 bp, synthetic construct
  misc_feature 1..20: note = Synthetic Construct
  source 1..20: mol_type = other DNA
gcctcgcatcacgcagtttt

SEQ ID NO: 396 - DNA, 26 bp, synthetic construct
  misc_feature 1..26: note = Synthetic Construct
  source 1..26: mol_type = other DNA
cccgtttgaagaaatgatagctcgaa

SEQ ID NO: 397 - DNA, 20 bp, synthetic construct
  misc_feature 1..20: note = Synthetic Construct
  source 1..20: mol_type = other DNA
gggtgctgttctggctttga

SEQ ID NO: 398 - DNA, 21 bp, synthetic construct
  misc_feature 1..21: note = Synthetic Construct
  source 1..21: mol_type = other DNA
ggctgtggttgttgacagagt

SEQ ID NO: 399 - DNA, 23 bp, synthetic construct
  misc_feature 1..23: note = Synthetic Construct
  source 1..23: mol_type = other DNA
ccctgtggaacaaagtgggaact

SEQ ID NO: 400 - DNA, 22 bp, synthetic construct
  misc_feature 1..22: note = Synthetic Construct
  source 1..22: mol_type = other DNA
gcaaaggcttgtctgacagtga

SEQ ID NO: 401 - DNA, 24 bp, synthetic construct
  misc_feature 1..24: note = Synthetic Construct
  source 1..24: mol_type = other DNA
caagaggaccttcggaaactttga

SEQ ID NO: 402 - DNA, 20 bp, synthetic construct
  misc_feature 1..20: note = Synthetic Construct
  source 1..20: mol_type = other DNA
aggcacacgcaggtctcatc

SEQ ID NO: 403 - DNA, 25 bp, synthetic construct
  misc_feature 1..25: note = Synthetic Construct
  source 1..25: mol_type = other DNA
gtgtagaggggcaactcctatcttg

SEQ ID NO: 404 - DNA, 27 bp, synthetic construct
  misc_feature 1..27: note = Synthetic Construct
  source 1..27: mol_type = other DNA
cagactacaaaggtgtttgctgtttgt

SEQ ID NO: 405 - DNA, 20 bp, synthetic construct
  misc_feature 1..20: note = Synthetic Construct
  source 1..20: mol_type = other DNA
ctgcgttgtgcctactctgt

SEQ ID NO: 406 - DNA, 20 bp, synthetic construct
  misc_feature 1..20: note = Synthetic Construct
  source 1..20: mol_type = other DNA
ggtgtccccgcacttagcat

SEQ ID NO: 407 - DNA, 23 bp, synthetic construct
  misc_feature 1..23: note = Synthetic Construct
  source 1..23: mol_type = other DNA
gtgaagccagacagcagtaatca

SEQ ID NO: 408 - DNA, 23 bp, synthetic construct
  misc_feature 1..23: note = Synthetic Construct
  source 1..23: mol_type = other DNA
ggagggtgaacaaggcaaagatg

SEQ ID NO: 409 - DNA, 22 bp, synthetic construct
  misc_feature 1..22: note = Synthetic Construct
  source 1..22: mol_type = other DNA
acctgcaggagctagttagaga

SEQ ID NO: 410 - DNA, 21 bp, synthetic construct
  misc_feature 1..21: note = Synthetic Construct
  source 1..21: mol_type = other DNA
gctttcagtccccacttgtga

SEQ ID NO: 411 - DNA, 22 bp, synthetic construct
  misc_feature 1..22: note = Synthetic Construct
  source 1..22: mol_type = other DNA
gtgaggcaggaaggatgagttt

SEQ ID NO: 412 - DNA, 24 bp, synthetic construct
  misc_feature 1..24: note = Synthetic Construct
  source 1..24: mol_type = other DNA
gagctttggagacagtggggtaac

SEQ ID NO: 413 - DNA, 22 bp, synthetic construct
  misc_feature 1..22: note = Synthetic Construct
  source 1..22: mol_type = other DNA
ccagcatcaggtcacaatgaac

SEQ ID NO: 414 - DNA, 20 bp, synthetic construct
  misc_feature 1..20: note = Synthetic Construct
  source 1..20: mol_type = other DNA
actgagggcggcattgctta

SEQ ID NO: 415 - DNA, 20 bp, synthetic construct
  misc_feature 1..20: note = Synthetic Construct
  source 1..20: mol_type = other DNA
gcggcaaggagggtttctaa

SEQ ID NO: 416 - DNA, 25 bp, synthetic construct
  misc_feature 1..25: note = Synthetic Construct
  source 1..25: mol_type = other DNA
tcagagttctgtcctaatggaggaa

SEQ ID NO: 417 - DNA, 26 bp, synthetic construct
  misc_feature 1..26: note = Synthetic Construct
  source 1..26: mol_type = other DNA
cactagtctggaaaaaccagcaccaa

SEQ ID NO: 418 - DNA, 24 bp, synthetic construct
  misc_feature 1..24: note = Synthetic Construct
  source 1..24: mol_type = other DNA
aatcctggaacactcttgcctaaa

SEQ ID NO: 419 - DNA, 26 bp, synthetic construct
  misc_feature 1..26: note = Synthetic Construct
  source 1..26: mol_type = other DNA
gtgtgagctagttccttctgctcttc

SEQ ID NO: 420 - DNA, 22 bp, synthetic construct
  misc_feature 1..22: note = Synthetic Construct
  source 1..22: mol_type = other DNA
caactgcagcgtgctgatttta

SEQ ID NO: 421 - DNA, 21 bp, synthetic construct
  misc_feature 1..21: note = Synthetic Construct
  source 1..21: mol_type = other DNA
aatcggccacagccccagaga

SEQ ID NO: 422 - DNA, 24 bp, synthetic construct
  misc_feature 1..24: note = Synthetic Construct
  source 1..24: mol_type = other DNA
ggatcttctgaacaccacatcctt

SEQ ID NO: 423 - DNA, 22 bp, synthetic construct
  misc_feature 1..22: note = Synthetic Construct
  source 1..22: mol_type = other DNA
atccagttccctgggtgactct

SEQ ID NO: 424 - DNA, 25 bp, synthetic construct
  misc_feature 1..25: note = Synthetic Construct
  source 1..25: mol_type = other DNA
gttttctccaccaacacacctttct

SEQ ID NO: 425 - DNA, 21 bp, synthetic construct
  misc_feature 1..21: note = Synthetic Construct
  source 1..21: mol_type = other DNA
aaggggactcggaggacaaga

SEQ ID NO: 426 - DNA, 22 bp, synthetic construct
  misc_feature 1..22: note = Synthetic Construct
  source 1..22: mol_type = other DNA
gggccaatgtgtcctggtttgt

SEQ ID NO: 427 - DNA, 21 bp, synthetic construct
  misc_feature 1..21: note = Synthetic Construct
  source 1..21: mol_type = other DNA
tgccatggcctttgcctatac

SEQ ID NO: 428 - DNA, 24 bp, synthetic construct
  misc_feature 1..24: note = Synthetic Construct
  source 1..24: mol_type = other DNA
gctctcagggaaatcatccatttg

SEQ ID NO: 429 - DNA, 24 bp, synthetic construct
  misc_feature 1..24: note = Synthetic Construct
  source 1..24: mol_type = other DNA
cctgggatttaccatgtcccataa

SEQ ID NO: 430 - DNA, 21 bp, synthetic construct
  misc_feature 1..21: note = Synthetic Construct
  source 1..21: mol_type = other DNA
cgtgctccactttcctgacaa

SEQ ID NO: 431 - DNA, 22 bp, synthetic construct
  misc_feature 1..22: note = Synthetic Construct
  source 1..22: mol_type = other DNA
cagggatgagccgctgtttcta

SEQ ID NO: 432 - DNA, 21 bp, synthetic construct
  misc_feature 1..21: note = Synthetic Construct
  source 1..21: mol_type = other DNA
agatcttcggggctccagaca

SEQ ID NO: 433 - DNA, 27 bp, synthetic construct
  misc_feature 1..27: note = Synthetic Construct
  source 1..27: mol_type = other DNA
gcatagtccacagtaggaaaaatgcaa

SEQ ID NO: 434 - DNA, 21 bp, synthetic construct
  misc_feature 1..21: note = Synthetic Construct
  source 1..21: mol_type = other DNA
ggcagctgcaacagtatgtct

SEQ ID NO: 435 - DNA, 24 bp, synthetic construct
  misc_feature 1..24: note = Synthetic Construct
  source 1..24: mol_type = other DNA
ggtctgtctgattccagctgatac

SEQ ID NO: 436 - DNA, 27 bp, synthetic construct
  misc_feature 1..27: note = Synthetic Construct
  source 1..27: mol_type = other DNA
ctcagtgggcttagaataaacctgaat

SEQ ID NO: 437 - DNA, 20 bp, synthetic construct
  misc_feature 1..20: note = Synthetic Construct
  source 1..20: mol_type = other DNA
ggaggtttggctgggtcttt

SEQ ID NO: 438 - DNA, 20 bp, synthetic construct
  misc_feature 1..20: note = Synthetic Construct
  source 1..20: mol_type = other DNA
aggcgggtccccaggaaaca

SEQ ID NO: 439 - DNA, 21 bp, synthetic construct
  misc_feature 1..21: note = Synthetic Construct
  source 1..21: mol_type = other DNA
acaaggggcctgactcagctt

SEQ ID NO: 440 - DNA, 21 bp, synthetic construct
  misc_feature 1..21: note = Synthetic Construct
  source 1..21: mol_type = other DNA
cctggtgtgctctgccttgaa

SEQ ID NO: 441 - DNA, 22 bp, synthetic construct
  misc_feature 1..22: note = Synthetic Construct
  source 1..22: mol_type = other DNA
cctcggtggacacttggtcttg

SEQ ID NO: 442 - DNA, 27 bp, synthetic construct
  misc_feature 1..27: note = Synthetic Construct
  source 1..27: mol_type = other DNA
ggagataggaaaagtcatggagggtaa

SEQ ID NO: 443 - DNA, 20 bp, synthetic construct
  misc_feature 1..20: note = Synthetic Construct
  source 1..20: mol_type = other DNA
agtctcatggcaggctgctt

SEQ ID NO: 444 - DNA, 22 bp, synthetic construct
  misc_feature 1..22: note = Synthetic Construct
  source 1..22: mol_type = other DNA
agaacccctgcaccctctttct

SEQ ID NO: 445 - DNA, 26 bp, synthetic construct
  misc_feature 1..26: note = Synthetic Construct
  source 1..26: mol_type = other DNA
ggccttaattgacaccgctaatcttg

SEQ ID NO: 446 - DNA, 22 bp, synthetic construct
  misc_feature 1..22: note = Synthetic Construct
  source 1..22: mol_type = other DNA
ggagaggctaaggggaaacaga

SEQ ID NO: 447 - DNA, 20 bp, synthetic construct
  misc_feature 1..20: note = Synthetic Construct
  source 1..20: mol_type = other DNA
atggtggtggctgtgcgatt

SEQ ID NO: 448 - DNA, 22 bp, synthetic construct
  misc_feature 1..22: note = Synthetic Construct
  source 1..22: mol_type = other DNA
ttgggtcatagggccgagaatg

SEQ ID NO: 449 - DNA, 20 bp, synthetic construct
  misc_feature 1..20: note = Synthetic Construct
  source 1..20: mol_type = other DNA
acacgaaagcggcgtcagaa

SEQ ID NO: 450 - DNA, 22 bp, synthetic construct
  misc_feature 1..22: note = Synthetic Construct
  source 1..22: mol_type = other DNA
tgggcttctgggttctagatgt

SEQ ID NO: 451 - DNA, 25 bp, synthetic construct
  misc_feature 1..25: note = Synthetic Construct
  source 1..25: mol_type = other DNA
ggaaaccatcccatgtctactgtgt

SEQ ID NO: 452 - DNA, 22 bp, synthetic construct
  misc_feature 1..22: note = Synthetic Construct
  source 1..22: mol_type = other DNA
tcccacttactacgctccaaga

SEQ ID NO: 453 - DNA, 21 bp, synthetic construct
  misc_feature 1..21: note = Synthetic Construct
  source 1..21: mol_type = other DNA
tcctgccctagctgtggcttt

SEQ ID NO: 454 - DNA, 20 bp, synthetic construct
  misc_feature 1..20: note = Synthetic Construct
  source 1..20: mol_type = other DNA
ccgcaaatagccccagaact

SEQ ID NO: 455 - DNA, 20 bp, synthetic construct
  misc_feature 1..20: note = Synthetic Construct
  source 1..20: mol_type = other DNA
tttggttagcggggctctct

SEQ ID NO: 456 - DNA, 25 bp, synthetic construct
  misc_feature 1..25: note = Synthetic Construct
  source 1..25: mol_type = other DNA
ccaggataagaatgttggcctcctt

SEQ ID NO: 457 - DNA, 23 bp, synthetic construct
  misc_feature 1..23: note = Synthetic Construct
  source 1..23: mol_type = other DNA
ctgttgcccgtgggattaaaatg

SEQ ID NO: 458 - DNA, 22 bp, synthetic construct
  misc_feature 1..22: note = Synthetic Construct
  source 1..22: mol_type = other DNA
tgtgctacctggagagggtttc

SEQ ID NO: 459 - DNA, 22 bp, synthetic construct
  misc_feature 1..22: note = Synthetic Construct
  source 1..22: mol_type = other DNA
cccttctgcagcatgtgcattt

SEQ ID NO: 460 - DNA, 25 bp, synthetic construct
  misc_feature 1..25: note = Synthetic Construct
  source 1..25: mol_type = other DNA
gctaggaatgggaacattggcatct

SEQ ID NO: 461 - DNA, 24 bp, synthetic construct
  misc_feature 1..24: note = Synthetic Construct
  source 1..24: mol_type = other DNA
gtctttacaagcaggccccatttg

SEQ ID NO: 462 - DNA, 21 bp, synthetic construct
  misc_feature 1..21: note = Synthetic Construct
  source 1..21: mol_type = other DNA
agaccacctgcctaagaccaa

SEQ ID NO: 463 - DNA, 19 bp, synthetic construct
  misc_feature 1..19: note = Synthetic Construct
  source 1..19: mol_type = other DNA
accccatccccaccagctt

SEQ ID NO: 464 - DNA, 22 bp, synthetic construct
  misc_feature 1..22: note = Synthetic Construct
  source 1..22: mol_type = other DNA
gattggctcctgtgctctgagt

SEQ ID NO: 465 - DNA, 22 bp, synthetic construct
  misc_feature 1..22: note = Synthetic Construct
  source 1..22: mol_type = other DNA
cctgcagggaaaacctgcaact

SEQ ID NO: 466 - DNA, 23 bp, synthetic construct
  misc_feature 1..23: note = Synthetic Construct
  source 1..23: mol_type = other DNA
ctttacagcattgcctcctccta

SEQ ID NO: 467 - DNA, 21 bp, synthetic construct
  misc_feature 1..21: note = Synthetic Construct
  source 1..21: mol_type = other DNA
ggccactagtctgggacaaag

SEQ ID NO: 468 - DNA, 26 bp, synthetic construct
  misc_feature 1..26: note = Synthetic Construct
  source 1..26: mol_type = other DNA
gtaatgtcagtgcgtctaggtaaaga

SEQ ID NO: 469 - DNA, 20 bp, synthetic construct
  misc_feature 1..20: note = Synthetic Construct
  source 1..20: mol_type = other DNA
ggagagggaatgctgcgaat

SEQ ID NO: 470 - DNA, 19 bp, synthetic construct
  misc_feature 1..19: note = Synthetic Construct
  source 1..19: mol_type = other DNA
ggaggcacagcaggtctga

SEQ ID NO: 471 - DNA, 23 bp, synthetic construct
  misc_feature 1..23: note = Synthetic Construct
  source 1..23: mol_type = other DNA
ggacaccaacgatgacacaaaat

SEQ ID NO: 472 - DNA, 19 bp, synthetic construct
  misc_feature 1..19: note = Synthetic Construct
  source 1..19: mol_type = other DNA
agggagccggcatcctttg

SEQ ID NO: 473 - DNA, 21 bp, synthetic construct
  misc_feature 1..21: note = Synthetic Construct
  source 1..21: mol_type = other DNA
tgccaagaggcttctcagttc

SEQ ID NO: 474 - DNA, 22 bp, synthetic construct
  misc_feature 1..22: note = Synthetic Construct
  source 1..22: mol_type = other DNA
cctgggcagtaagctagcaatg

SEQ ID NO: 475 - DNA, 20 bp, synthetic construct
  misc_feature 1..20: note = Synthetic Construct
  source 1..20: mol_type = other DNA
tcacccctcacctgcactct

SEQ ID NO: 476 - DNA, 23 bp, synthetic construct
  misc_feature 1..23: note = Synthetic Construct
  source 1..23: mol_type = other DNA
gctgagaatccagagactgtgtt

SEQ ID NO: 477 - DNA, 23 bp, synthetic construct
  misc_feature 1..23: note = Synthetic Construct
  source 1..23: mol_type = other DNA
ccacaccatacaagggatctcaa

SEQ ID NO: 478 - DNA, 25 bp, synthetic construct
  misc_feature 1..25: note = Synthetic Construct
  source 1..25: mol_type = other DNA
agtggatgagaactatcatggcaaa

SEQ ID NO: 479 - DNA, 21 bp, synthetic construct
  misc_feature 1..21: note = Synthetic Construct
  source 1..21: mol_type = other DNA
cttgaggcagttccgacttca

SEQ ID NO: 480 - DNA, 22 bp, synthetic construct
  misc_feature 1..22: note = Synthetic Construct
  source 1..22: mol_type = other DNA
gccaagaacacgtcaggtctca

SEQ ID NO: 481 - DNA, 25 bp, synthetic construct
  misc_feature 1..25: note = Synthetic Construct
  source 1..25: mol_type = other DNA
tttccactctcccttatttctgcaa

SEQ ID NO: 482 - DNA, 24 bp, synthetic construct
  misc_feature 1..24: note = Synthetic Construct
  source 1..24: mol_type = other DNA
ccacagatgcaaagagagcacttc

SEQ ID NO: 483 - DNA, 22 bp, synthetic construct
  misc_feature 1..22: note = Synthetic Construct
  source 1..22: mol_type = other DNA
gggagtgtctgtggtccagaat

SEQ ID NO: 484 - DNA, 21 bp, synthetic construct
  misc_feature 1..21: note = Synthetic Construct
  source 1..21: mol_type = other DNA
ccaaagctgtttgcggctaga

SEQ ID NO: 485 - DNA, 19 bp, synthetic construct
  misc_feature 1..19: note = Synthetic Construct
  source 1..19: mol_type = other DNA
gctgcggaggccagaaagt

SEQ ID NO: 486 - DNA, 23 bp, synthetic construct
  misc_feature 1..23: note = Synthetic Construct
  source 1..23: mol_type = other DNA
ttgtagacaatggggccactaag

SEQ ID NO: 487 - DNA, 23 bp, synthetic construct
  misc_feature 1..23: note = Synthetic Construct
  source 1..23: mol_type = other DNA
tgtgccagtgtgtaccttcattt

SEQ ID NO: 488 - DNA, 26 bp, synthetic construct
  misc_feature 1..26: note = Synthetic Construct
  source 1..26: mol_type = other DNA
gggttcaggccagtagaatgacctat

SEQ ID NO: 489 - DNA, 26 bp, synthetic construct
  misc_feature 1..26: note = Synthetic Construct
  source 1..26: mol_type = other DNA
ttgaggacaatagagaaggtctgttc

SEQ ID NO: 490 - DNA, 25 bp, synthetic construct
  misc_feature 1..25: note = Synthetic Construct
  source 1..25: mol_type = other DNA
gctggatcctaagacaacactgtat

SEQ ID NO: 491 - DNA, 20 bp, synthetic construct
  misc_feature 1..20: note = Synthetic Construct
  source 1..20: mol_type = other DNA
aggctggcatgttggagtca

SEQ ID NO: 492 - DNA, 21 bp, synthetic construct
  misc_feature 1..21: note = Synthetic Construct
  source 1..21: mol_type = other DNA
tgtgagctgttcttgccatgt

SEQ ID NO: 493 - DNA, 22 bp, synthetic construct
  misc_feature 1..22: note = Synthetic Construct
  source 1..22: mol_type = other DNA
gtgttacctggcgcctgaatgt

SEQ ID NO: 494 - DNA, 22 bp, synthetic construct
  misc_feature 1..22: note = Synthetic Construct
  source 1..22: mol_type = other DNA
agctaagttttccaggcgatgt

SEQ ID NO: 495 - DNA, 24 bp, synthetic construct
  misc_feature 1..24: note = Synthetic Construct
  source 1..24: mol_type = other DNA
gtgaaagagccatgataggtctga

SEQ ID NO: 496 - DNA, 19 bp, synthetic construct
  misc_feature 1..19: note = Synthetic Construct
  source 1..19: mol_type = other DNA
gatgcccgcacctgctaga

SEQ ID NO: 497 - DNA, 20 bp, synthetic construct
  misc_feature 1..20: note = Synthetic Construct
  source 1..20: mol_type = other DNA
tcgcccttgtggatccaagt

SEQ ID NO: 498 - DNA, 19 bp, synthetic construct
  misc_feature 1..19: note = Synthetic Construct
  source 1..19: mol_type = other DNA
aggggacgtctcccaggtt

SEQ ID NO: 499 - DNA, 18 bp, synthetic construct
  misc_feature 1..18: note = Synthetic Construct
  source 1..18: mol_type = other DNA
accctgcatcgggtctca

SEQ ID NO: 500 - DNA, 21 bp, synthetic construct
  misc_feature 1..21: note = Synthetic Construct
  source 1..21: mol_type = other DNA
gtcctgttcccgcaaggttga

SEQ ID NO: 501 - DNA, 24 bp, synthetic construct
  misc_feature 1..24: note = Synthetic Construct
  source 1..24: mol_type = other DNA
gtgttgttcctcttcccaaggaat

SEQ ID NO: 502 - DNA, 24 bp, synthetic construct
  misc_feature 1..24: note = Synthetic Construct
  source 1..24: mol_type = other DNA
gtctcagagattccacagcctaca

SEQ ID NO: 503 - DNA, 23 bp, synthetic construct
  misc_feature 1..23: note = Synthetic Construct
  source 1..23: mol_type = other DNA
acagatgccagatgcagaagaaa

SEQ ID NO: 504 - DNA, 24 bp, synthetic construct
  misc_feature 1..24: note = Synthetic Construct
  source 1..24: mol_type = other DNA
ggctctgaggtcatctctgtatca

SEQ ID NO: 505 - DNA, 20 bp, synthetic construct
  misc_feature 1..20: note = Synthetic Construct
  source 1..20: mol_type = other DNA
caagtccctcccagcaacaa

SEQ ID NO: 506 - DNA, 22 bp, synthetic construct
  misc_feature 1..22: note = Synthetic Construct
  source 1..22: mol_type = other DNA
cgcctctgtcctctgtcacttt

SEQ ID NO: 507 - DNA, 20 bp, synthetic construct
  misc_feature 1..20: note = Synthetic Construct
  source 1..20: mol_type = other DNA
ggataccaaccccgccagaa

SEQ ID NO: 508 - DNA, 25 bp, synthetic construct
  misc_feature 1..25: note = Synthetic Construct
  source 1..25: mol_type = other DNA
ccatcatctggttatgctacagtct

SEQ ID NO: 509 - DNA, 24 bp, synthetic construct
  misc_feature 1..24: note = Synthetic Construct
  source 1..24: mol_type = other DNA
cttgatgactccacttctccatca

SEQ ID NO: 510 - DNA, 22 bp, synthetic construct
  misc_feature 1..22: note = Synthetic Construct
  source 1..22: mol_type = other DNA
gccaaggagtgaaccaggtttg

SEQ ID NO: 511 - DNA, 22 bp, synthetic construct
  misc_feature 1..22: note = Synthetic Construct
  source 1..22: mol_type = other DNA
cgacctgtgttaggggttcagt

SEQ ID NO: 512 - DNA, 19 bp, synthetic construct
  misc_feature 1..19: note = Synthetic Construct
  source 1..19: mol_type = other DNA
gtggcccagaaggctgctt

SEQ ID NO: 513 - DNA, 25 bp, synthetic construct
  misc_feature 1..25: note = Synthetic Construct
  source 1..25: mol_type = other DNA
cacaggaggtcattaaggttcaaca

SEQ ID NO: 514 - DNA, 24 bp, synthetic construct
  misc_feature 1..24: note = Synthetic Construct
  source 1..24: mol_type = other DNA
gcagacattgtatgtcggtgaaca

SEQ ID NO: 515 - DNA, 18 bp, synthetic construct
  misc_feature 1..18: note = Synthetic Construct
  source 1..18: mol_type = other DNA
tgggttcgcacggctgtt

SEQ ID NO: 516 - DNA, 22 bp, synthetic construct
  misc_feature 1..22: note = Synthetic Construct
  source 1..22: mol_type = other DNA
accaccacacctagctgcaaag

SEQ ID NO: 517 - DNA, 19 bp, synthetic construct
  misc_feature 1..19: note = Synthetic Construct
  source 1..19: mol_type = other DNA
tgtccctggggccactgaa

SEQ ID NO: 518 - DNA, 22 bp, synthetic construct
  misc_feature 1..22: note = Synthetic Construct
  source 1..22: mol_type = other DNA
gtggggtaacagccacaggtat

SEQ ID NO: 519 - DNA, 22 bp, synthetic construct
  misc_feature 1..22: note = Synthetic Construct
  source 1..22: mol_type = other DNA
ctgccggagactatgctcagta

SEQ ID NO: 520 - DNA, 22 bp, synthetic construct
  misc_feature 1..22: note = Synthetic Construct
  source 1..22: mol_type = other DNA
gtcacccaggccatgtgaactt

SEQ ID NO: 521 - DNA, 22 bp, synthetic construct
  misc_feature 1..22: note = Synthetic Construct
  source 1..22: mol_type = other DNA
gggccatgtcattgctctgtag

SEQ ID NO: 522 - DNA, 23 bp, synthetic construct
  misc_feature 1..23: note = Synthetic Construct
  source 1..23: mol_type = other DNA
ccccaagatgtctgccatagttc

SEQ ID NO: 523 - DNA, 29 bp, synthetic construct
  misc_feature 1..29: note = Synthetic Construct
  source 1..29: mol_type = other DNA
gcagttggtaaaggcaaagcttaacgaaa

SEQ ID NO: 524 - DNA, 21 bp, synthetic construct
  misc_feature 1..21: note = Synthetic Construct
  source 1..21: mol_type = other DNA
agactaggcagggtacacaca

SEQ ID NO: 525 - DNA, 27 bp, synthetic construct
  misc_feature 1..27: note = Synthetic Construct
  source 1..27: mol_type = other DNA
gtgagcacaaatttggatcgagtgaga

SEQ ID NO: 526 - DNA, 23 bp, synthetic construct
  misc_feature 1..23: note = Synthetic Construct
  source 1..23: mol_type = other DNA
gagtggctagctctcaagacaca

SEQ ID NO: 527 - DNA, 23 bp, synthetic construct
  misc_feature 1..23: note = Synthetic Construct
  source 1..23: mol_type = other DNA
gtgtgggaaggaggattccatgt

SEQ ID NO: 528 - DNA, 22 bp, synthetic construct
  misc_feature 1..22: note = Synthetic Construct
  source 1..22: mol_type = other DNA
atggtaggtcagacccagaagt

SEQ ID NO: 529 - DNA, 25 bp, synthetic construct
  misc_feature 1..25: note = Synthetic Construct
  source 1..25: mol_type = other DNA
cgtccaggagacagttaacctcttg

SEQ ID NO: 530 - DNA, 23 bp, synthetic construct
  misc_feature 1..23: note = Synthetic Construct
  source 1..23: mol_type = other DNA
ttccaagagcattcaggtgtctt

SEQ ID NO: 531 - DNA, 23 bp, synthetic construct
  misc_feature 1..23: note = Synthetic Construct
  source 1..23: mol_type = other DNA
agcagctcaaactatgccaaaga

SEQ ID NO: 532 - DNA, 21 bp, synthetic construct
  misc_feature 1..21: note = Synthetic Construct
  source 1..21: mol_type = other DNA
agtgccagagcccgctagaaa

SEQ ID NO: 533 - DNA, 22 bp, synthetic construct
  misc_feature 1..22: note = Synthetic Construct
  source 1..22: mol_type = other DNA
acccctgtgcctaagctgaagt

SEQ ID NO: 534 - DNA, 20 bp, synthetic construct
  misc_feature 1..20: note = Synthetic Construct
  source 1..20: mol_type = other DNA
ctgtgctggctgctgtttca

SEQ ID NO: 535 - DNA, 21 bp, synthetic construct
  misc_feature 1..21: note = Synthetic Construct
  source 1..21: mol_type = other DNA
gatgggtgttgcaaggcaaag

SEQ ID NO: 536 - DNA, 25 bp, synthetic construct
  misc_feature 1..25: note = Synthetic Construct
  source 1..25: mol_type = other DNA
ggcccatttaccctttctatcatgt

SEQ ID NO: 537 - DNA, 23 bp, synthetic construct
  misc_feature 1..23: note = Synthetic Construct
  source 1..23: mol_type = other DNA
caagtggattgtgggtggacact

SEQ ID NO: 538 - DNA, 23 bp, synthetic construct
  misc_feature 1..23: note = Synthetic Construct
  source 1..23: mol_type = other DNA
tgtgtgacattcctggtgctaaa

SEQ ID NO: 539 - DNA, 20 bp, synthetic construct
  misc_feature 1..20: note = Synthetic Construct
  source 1..20: mol_type = other DNA
aggcaggcgatgagccaaat

SEQ ID NO: 540 - DNA, 24 bp, synthetic construct
  misc_feature 1..24: note = Synthetic Construct
  source 1..24: mol_type = other DNA
gttccaatcacaggacaggggtat

SEQ ID NO: 541 - DNA, 21 bp, synthetic construct
  misc_feature 1..21: note = Synthetic Construct
  source 1..21: mol_type = other DNA
ggagatgcaatcggcccataa

SEQ ID NO: 542 - DNA, 20 bp, synthetic construct
  misc_feature 1..20: note = Synthetic Construct
  source 1..20: mol_type = other DNA
tgttggccaggggttaggtt

SEQ ID NO: 543 - DNA, 22 bp, synthetic construct
  misc_feature 1..22: note = Synthetic Construct
  source 1..22: mol_type = other DNA
gtcatggggacctggattgcta

SEQ ID NO: 544 - DNA, 22 bp, synthetic construct
  misc_feature 1..22: note = Synthetic Construct
  source 1..22: mol_type = other DNA
gccacatggacacctcacactt

SEQ ID NO: 545 - DNA, 28 bp, synthetic construct
  misc_feature 1..28: note = Synthetic Construct
  source 1..28: mol_type = other DNA
ggttttcctatcggtgtttgaggtctac

SEQ ID NO: 546 - DNA, 24 bp, synthetic construct
  misc_feature 1..24: note = Synthetic Construct
  source 1..24: mol_type = other DNA
cagggtgataagtccacagcattc

SEQ ID NO: 547 - DNA, 20 bp, synthetic construct
  misc_feature 1..20: note = Synthetic Construct
  source 1..20: mol_type = other DNA
cagcacccagagagcagctt

SEQ ID NO: 548 - DNA, 19 bp, synthetic construct
  misc_feature 1..19: note = Synthetic Construct
  source 1..19: mol_type = other DNA
gcgcaggcgcagcattatt

SEQ ID NO: 549 - DNA, 20 bp, synthetic construct
  misc_feature 1..20: note = Synthetic Construct
  source 1..20: mol_type = other DNA
cacgacaccacacgcattca

SEQ ID NO: 550 - DNA, 22 bp, synthetic construct
  misc_feature 1..22: note = Synthetic Construct
  source 1..22: mol_type = other DNA
tcccatcagcaccagtggaaac

SEQ ID NO: 551 - DNA, 26 bp, synthetic construct
  misc_feature 1..26: note = Synthetic Construct
  source 1..26: mol_type = other DNA
gggagatcatacacagagaggaggtt

SEQ ID NO: 552 - DNA, 25 bp, synthetic construct
  misc_feature 1..25: note = Synthetic Construct
  source 1..25: mol_type = other DNA
tcaggctaaagacattgctgtagaa

SEQ ID NO: 553 - DNA, 22 bp, synthetic construct
  misc_feature 1..22: note = Synthetic Construct
  source 1..22: mol_type = other DNA
ccctgctcttccatgctgctaa

SEQ ID NO: 554 - DNA, 23 bp, synthetic construct
  misc_feature 1..23: note = Synthetic Construct
  source 1..23: mol_type = other DNA
cctaggagggtaaaggcggagtt

SEQ ID NO: 555 - DNA, 20 bp, synthetic construct
  misc_feature 1..20: note = Synthetic Construct
  source 1..20: mol_type = other DNA
ttgccagctctgccctgcta

SEQ ID NO: 556 - DNA, 22 bp, synthetic construct
  misc_feature 1..22: note = Synthetic Construct
  source 1..22: mol_type = other DNA
gcaccaggagtgtgctgaagtt

SEQ ID NO: 557 - DNA, 26 bp, synthetic construct
  misc_feature 1..26: note = Synthetic Construct
  source 1..26: mol_type = other DNA
gtctctgacaatacattcagccacta

SEQ ID NO: 558 - DNA, 20 bp, synthetic construct
  misc_feature 1..20: note = Synthetic Construct
  source 1..20: mol_type = other DNA
aaggctcgcctgagggtgaa

SEQ ID NO: 559 - DNA, 24 bp, synthetic construct
  misc_feature 1..24: note = Synthetic Construct
  source 1..24: mol_type = other DNA
cgtgattaagtacggctgcctgtt

SEQ ID NO: 560 - DNA, 24 bp, synthetic construct
  misc_feature 1..24: note = Synthetic Construct
  source 1..24: mol_type = other DNA
gaccacagaaattggaaggagcta

SEQ ID NO: 561 - DNA, 20 bp, synthetic construct
  misc_feature 1..20: note = Synthetic Construct
  source 1..20: mol_type = other DNA
ggcagcttcccttcgctctt

SEQ ID NO: 562 - DNA, 24 bp, synthetic construct
  misc_feature 1..24: note = Synthetic Construct
  source 1..24: mol_type = other DNA
gcctgctgttgggtgaattactgt

SEQ ID NO: 563 - DNA, 20 bp, synthetic construct
  misc_feature 1..20: note = Synthetic Construct
  source 1..20: mol_type = other DNA
gtgatgctgctacggaggaa

SEQ ID NO: 564 - DNA, 19 bp, synthetic construct
  misc_feature 1..19: note = Synthetic Construct
  source 1..19: mol_type = other DNA
cccgcaatgcccagtgaca

SEQ ID NO: 565 - DNA, 22 bp, synthetic construct
  misc_feature 1..22: note = Synthetic Construct
  source 1..22: mol_type = other DNA
aggggctgagtgctttttcttc

SEQ ID NO: 566 - DNA, 22 bp, synthetic construct
  misc_feature 1..22: note = Synthetic Construct
  source 1..22: mol_type = other DNA
gcatcagagcagtgggcttaca

SEQ ID NO: 567 - DNA, 19 bp, synthetic construct
  misc_feature 1..19: note = Synthetic Construct
  source 1..19: mol_type = other DNA
tggagggagggagctgttc

SEQ ID NO: 568 - DNA, 21 bp, synthetic construct
  misc_feature 1..21: note = Synthetic Construct
  source 1..21: mol_type = other DNA
tgggagggccagagactcatt

SEQ ID NO: 569 - DNA, 23 bp, synthetic construct
  misc_feature 1..23: note = Synthetic Construct
  source 1..23: mol_type = other DNA
gaagaaagccaggcctccaaaac

SEQ ID NO: 570 - DNA, 19 bp, synthetic construct
  misc_feature 1..19: note = Synthetic Construct
  source 1..19: mol_type = other DNA
acagttggggcaagcacat

SEQ ID NO: 571 - DNA, 19 bp, synthetic construct
  misc_feature 1..19: note = Synthetic Construct
  source 1..19: mol_type = other DNA
tgcaacgcgagggtgagtt

SEQ ID NO: 572 - DNA, 22 bp, synthetic construct
  misc_feature 1..22: note = Synthetic Construct
  source 1..22: mol_type = other DNA
ggagagatgcgtccatcacaga

SEQ ID NO: 573 - DNA, 20 bp, synthetic construct
  misc_feature 1..20: note = Synthetic Construct
  source 1..20: mol_type = other DNA
ggatggcttcaggcagttga

SEQ ID NO: 574 - DNA, 20 bp, synthetic construct
  misc_feature 1..20: note = Synthetic Construct
  source 1..20: mol_type = other DNA
cacttctggggcacttgtgt

SEQ ID NO: 575 - DNA, 25 bp, synthetic construct
  misc_feature 1..25: note = Synthetic Construct
  source 1..25: mol_type = other DNA
ctcttgcaaatcgaggaacgagaga

SEQ ID NO: 576 - DNA, 21 bp, synthetic construct
  misc_feature 1..21: note = Synthetic Construct
  source 1..21: mol_type = other DNA
accttcagggccaccagtgtt

SEQ ID NO: 577 - DNA, 22 bp, synthetic construct
  misc_feature 1..22: note = Synthetic Construct
  source 1..22: mol_type = other DNA
tgcactcactcagggcagaagt

SEQ ID NO: 578 - DNA, 21 bp, synthetic construct
  misc_feature 1..21: note = Synthetic Construct
  source 1..21: mol_type = other DNA
gcagtgcgtgttcttgcatca

SEQ ID NO: 579 - DNA, 21 bp, synthetic construct
  misc_feature 1..21: note = Synthetic Construct
  source 1..21: mol_type = other DNA
tcaggcagggctcagaactgt

SEQ ID NO: 580 - DNA, 20 bp, synthetic construct
  misc_feature 1..20: note = Synthetic Construct
  source 1..20: mol_type = other DNA
tcctctgccttcagcactgt

SEQ ID NO: 581 - DNA, 22 bp, synthetic construct
  misc_feature 1..22: note = Synthetic Construct
  source 1..22: mol_type = other DNA
ggagaagactgcggaacacaca

SEQ ID NO: 582 - DNA, 28 bp, synthetic construct
  misc_feature 1..28: note = Synthetic Construct
  source 1..28: mol_type = other DNA
cacccctaagtttgagatctgttgattc

SEQ ID NO: 583 - DNA, 22 bp, synthetic construct
  misc_feature 1..22: note = Synthetic Construct
  source 1..22: mol_type = other DNA
tgccccttccaatcctgtgtga

SEQ ID NO: 584 - DNA, 27 bp, synthetic construct
  misc_feature 1..27: note = Synthetic Construct
  source 1..27: mol_type = other DNA
gccacaggggatgaataaaaagcagta

SEQ ID NO: 585 - DNA, 24 bp, synthetic construct
  misc_feature 1..24: note = Synthetic Construct
  source 1..24: mol_type = other DNA
caaagatgggtcaagttcctctca

SEQ ID NO: 586 - DNA, 19 bp, synthetic construct
  misc_feature 1..19: note = Synthetic Construct
  source 1..19: mol_type = other DNA
ggtgggcccagaacaaact

SEQ ID NO: 587 - DNA, 20 bp, synthetic construct
  misc_feature 1..20: note = Synthetic Construct
  source 1..20: mol_type = other DNA
aaggctgccctggtcaaaca

SEQ ID NO: 588 - DNA, 23 bp, synthetic construct
  misc_feature 1..23: note = Synthetic Construct
  source 1..23: mol_type = other DNA
gttttaggacagccagtcgagaa

SEQ ID NO: 589 - DNA, 25 bp, synthetic construct
  misc_feature 1..25: note = Synthetic Construct
  source 1..25: mol_type = other DNA
acagttgaagtccaggcttatttga

SEQ ID NO: 590 - DNA, 23 bp, synthetic construct
  misc_feature 1..23: note = Synthetic Construct
  source 1..23: mol_type = other DNA
cagtggacccagatggtgacttc

SEQ ID NO: 591 - DNA, 23 bp, synthetic construct
  misc_feature 1..23: note = Synthetic Construct
  source 1..23: mol_type = other DNA
tgctttagggagcatggagtaca

SEQ ID NO: 592 - DNA, 23 bp, synthetic construct
  misc_feature 1..23: note = Synthetic Construct
  source 1..23: mol_type = other DNA
cctcagtcttagcctgggctctt

SEQ ID NO: 593 - DNA, 20 bp, synthetic construct
  misc_feature 1..20: note = Synthetic Construct
  source 1..20: mol_type = other DNA
acagacccaggacgctgaag

SEQ ID NO: 594 - DNA, 22 bp, synthetic construct
  misc_feature 1..22: note = Synthetic Construct
  source 1..22: mol_type = other DNA
cgaggggctttgtaccagtgtt

SEQ ID NO: 595 - DNA, 21 bp, synthetic construct
  misc_feature 1..21: note = Synthetic Construct
  source 1..21: mol_type = other DNA
ccatctggagcaggggagaag

SEQ ID NO: 596 - DNA, 26 bp, synthetic construct
  misc_feature 1..26: note = Synthetic Construct
  source 1..26: mol_type = other DNA
ggttaccccattccatcttctctgta

SEQ ID NO: 597 - DNA, 19 bp, synthetic construct
  misc_feature 1..19: note = Synthetic Construct
  source 1..19: mol_type = other DNA
gggagagagctggcgttca

SEQ ID NO: 598 - DNA, 22 bp, synthetic construct
  misc_feature 1..22: note = Synthetic Construct
  source 1..22: mol_type = other DNA
cctgcatgtctctggtctcttg

SEQ ID NO: 599 - DNA, 24 bp, synthetic construct
  misc_feature 1..24: note = Synthetic Construct
  source 1..24: mol_type = other DNA
ccgcacaacttactattgctgttg

SEQ ID NO: 600 - DNA, 26 bp, synthetic construct
  misc_feature 1..26: note = Synthetic Construct
  source 1..26: mol_type = other DNA
aggagtgaatcaaaggatggaagtag

SEQ ID NO: 601 - DNA, 24 bp, synthetic construct
  misc_feature 1..24: note = Synthetic Construct
  source 1..24: mol_type = other DNA
gtcttctgcaggggtgaaaacagt

SEQ ID NO: 602 - DNA, 20 bp, synthetic construct
  misc_feature 1..20: note = Synthetic Construct
  source 1..20: mol_type = other DNA
aggccctgaagttgctggaa

SEQ ID NO: 603 - DNA, 26 bp, synthetic construct
  misc_feature 1..26: note = Synthetic Construct
  source 1..26: mol_type = other DNA
gtgagtaagtcaacagtgatgaggaa

SEQ ID NO: 604 - DNA, 21 bp, synthetic construct
  misc_feature 1..21: note = Synthetic Construct
  source 1..21: mol_type = other DNA
ccagcacagaaccgacacgtt

SEQ ID NO: 605 - DNA, 20 bp, synthetic construct
  misc_feature 1..20: note = Synthetic Construct
  source 1..20: mol_type = other DNA
agctgccgcatcttgctttc

SEQ ID NO: 606 - DNA, 22 bp, synthetic construct
  misc_feature 1..22: note = Synthetic Construct
  source 1..22: mol_type = other DNA
gatggtcccaaggagccaatgt

SEQ ID NO: 607 - DNA, 24 bp, synthetic construct
  misc_feature 1..24: note = Synthetic Construct
  source 1..24: mol_type = other DNA
cgtgcagacctcacattactcttg

SEQ ID NO: 608 - DNA, 22 bp, synthetic construct
  misc_feature 1..22: note = Synthetic Construct
  source 1..22: mol_type = other DNA
gcctgagtgtccatgaacttgt

SEQ ID NO: 609 - DNA, 24 bp, synthetic construct
  misc_feature 1..24: note = Synthetic Construct
  source 1..24: mol_type = other DNA
tggatagctacatgcttgcttctt

SEQ ID NO: 610 - DNA, 22 bp, synthetic construct
  misc_feature 1..22: note = Synthetic Construct
  source 1..22: mol_type = other DNA
cggagccactttactcccacaa

SEQ ID NO: 611 - DNA, 24 bp, synthetic construct
  misc_feature 1..24: note = Synthetic Construct
  source 1..24: mol_type = other DNA
cttagcaaagagccttctgactgt

SEQ ID NO: 612 - DNA, 22 bp, synthetic construct
  misc_feature 1..22: note = Synthetic Construct
  source 1..22: mol_type = other DNA
acaagggaaagctgagggttct

SEQ ID NO: 613 - DNA, 23 bp, synthetic construct
  misc_feature 1..23: note = Synthetic Construct
  source 1..23: mol_type = other DNA
caaagcaccaatcctctgtgtga

SEQ ID NO: 614 - DNA, 24 bp, synthetic construct
  misc_feature 1..24: note = Synthetic Construct
  source 1..24: mol_type = other DNA
gggcaaaagaatactctggtcagt

SEQ ID NO: 615 - DNA, 20 bp, synthetic construct
  misc_feature 1..20: note = Synthetic Construct
  source 1..20: mol_type = other DNA
cacttcccaccctccctaca

SEQ ID NO: 616 - DNA, 21 bp, synthetic construct
  misc_feature 1..21: note = Synthetic Construct
  source 1..21: mol_type = other DNA
gcactttgcgtggactgtttc

SEQ ID NO: 617 - DNA, 23 bp, synthetic construct
  misc_feature 1..23: note = Synthetic Construct
  source 1..23: mol_type = other DNA
ctccgccacaaactgaaatctct

SEQ ID NO: 618 - DNA, 20 bp, synthetic construct
  misc_feature 1..20: note = Synthetic Construct
  source 1..20: mol_type = other DNA
tgggcaagagtgtggagtca

SEQ ID NO: 619 - DNA, 26 bp, synthetic construct
  misc_feature 1..26: note = Synthetic Construct
  source 1..26: mol_type = other DNA
ccgaaatcattgaacgagcaggctat

SEQ ID NO: 620 - DNA, 23 bp, synthetic construct
  misc_feature 1..23: note = Synthetic Construct
  source 1..23: mol_type = other DNA
ccacctaagccctaggatcatct

SEQ ID NO: 621 - DNA, 20 bp, synthetic construct
  misc_feature 1..20: note = Synthetic Construct
  source 1..20: mol_type = other DNA
cagcaggaaggggtgagttc

SEQ ID NO: 622 - DNA, 22 bp, synthetic construct
  misc_feature 1..22: note = Synthetic Construct
  source 1..22: mol_type = other DNA
cgcctggagcctcaaattggtt

SEQ ID NO: 623 - DNA, 25 bp, synthetic construct
  misc_feature 1..25: note = Synthetic Construct
  source 1..25: mol_type = other DNA
gtctggaaccaacagaattgtcact

SEQ ID NO: 624 - DNA, 22 bp, synthetic construct
  misc_feature 1..22: note = Synthetic Construct
  source 1..22: mol_type = other DNA
caagaccctggacgctcaagaa

SEQ ID NO: 625 - DNA, 23 bp, synthetic construct
  misc_feature 1..23: note = Synthetic Construct
  source 1..23: mol_type = other DNA
gtcagcaaaggaaggagtaccat

SEQ ID NO: 626 - DNA, 23 bp, synthetic construct
  misc_feature 1..23: note = Synthetic Construct
  source 1..23: mol_type = other DNA
cagaagtcattgctgaggaggaa

SEQ ID NO: 627 - DNA, 24 bp, synthetic construct
  misc_feature 1..24: note = Synthetic Construct
  source 1..24: mol_type = other DNA
ctggagaaagatgcagtcgaccat

SEQ ID NO: 628 - DNA, 25 bp, synthetic construct
  misc_feature 1..25: note = Synthetic Construct
  source 1..25: mol_type = other DNA
agctctacttcacagaaaggagttg

SEQ ID NO: 629 - DNA, 19 bp, synthetic construct
  misc_feature 1..19: note = Synthetic Construct
  source 1..19: mol_type = other DNA
cctgctcctgtggccctta

SEQ ID NO: 630 - DNA, 22 bp, synthetic construct
  misc_feature 1..22: note = Synthetic Construct
  source 1..22: mol_type = other DNA
ccagccttgcttccccttcaat

SEQ ID NO: 631 - DNA, 22 bp, synthetic construct
  misc_feature 1..22: note = Synthetic Construct
  source 1..22: mol_type = other DNA
ggggcagggaatacaggaattt

SEQ ID NO: 632 - DNA, 25 bp, synthetic construct
  misc_feature 1..25: note = Synthetic Construct
  source 1..25: mol_type = other DNA
gaaatactcacaatgccctcagcat

SEQ ID NO: 633 - DNA, 24 bp, synthetic construct
  misc_feature 1..24: note = Synthetic Construct
  source 1..24: mol_type = other DNA
gtgaggtgtggaaacgaaggtttg

SEQ ID NO: 634 - DNA, 21 bp, synthetic construct
  misc_feature 1..21: note = Synthetic Construct
  source 1..21: mol_type = other DNA
ttgattgagcgggagcaaaga

SEQ ID NO: 635 - DNA, 27 bp, synthetic construct
  misc_feature 1..27: note = Synthetic Construct
  source 1..27: mol_type = other DNA
caacccgaagaatctttgttcctcaag

SEQ ID NO: 636 - DNA, 25 bp, synthetic construct
  misc_feature 1..25: note = Synthetic Construct
  source 1..25: mol_type = other DNA
ggcatgggaataaatgccaggtgaa

SEQ ID NO: 637 - DNA, 25 bp, synthetic construct
  misc_feature 1..25: note = Synthetic Construct
  source 1..25: mol_type = other DNA
ggagacttggagggtaaaggcaact

SEQ ID NO: 638 - DNA, 26 bp, synthetic construct
  misc_feature 1..26: note = Synthetic Construct
  source 1..26: mol_type = other DNA
gcagttttgaaggcctagttatgttc

SEQ ID NO: 639 - DNA, 22 bp, synthetic construct
  misc_feature 1..22: note = Synthetic Construct
  source 1..22: mol_type = other DNA
gcaaggtctgagtggagaggat

SEQ ID NO: 640 - DNA, 23 bp, synthetic construct
  misc_feature 1..23: note = Synthetic Construct
  source 1..23: mol_type = other DNA
attgcagctccaggctccgagat

SEQ ID NO: 641 - DNA, 22 bp, synthetic construct
  misc_feature 1..22: note = Synthetic Construct
  source 1..22: mol_type = other DNA
cagccctctcctgttcagtgtt

SEQ ID NO: 642 - DNA, 22 bp, synthetic construct
  misc_feature 1..22: note = Synthetic Construct
  source 1..22: mol_type = other DNA
cgagggtcgttggcacttcaat

SEQ ID NO: 643 - DNA, 22 bp, synthetic construct
  misc_feature 1..22: note = Synthetic Construct
  source 1..22: mol_type = other DNA
tgggaaagagcgagatccaaaa

SEQ ID NO: 644 - DNA, 20 bp, synthetic construct
  misc_feature 1..20: note = Synthetic Construct
  source 1..20: mol_type = other DNA
tctgcccagccgatggagta

SEQ ID NO: 645 - DNA, 23 bp, synthetic construct
  misc_feature 1..23: note = Synthetic Construct
  source 1..23: mol_type = other DNA
gtcagtccctctgttctctgtca

SEQ ID NO: 646 - DNA, 24 bp, synthetic construct
  misc_feature 1..24: note = Synthetic Construct
  source 1..24: mol_type = other DNA
tgacacaagaatcaggttggttga

SEQ ID NO: 647 - DNA, 23 bp, synthetic construct
  misc_feature 1..23: note = Synthetic Construct
  source 1..23: mol_type = other DNA
tttattggctaccccaggtccta

SEQ ID NO: 648 - DNA, 24 bp, synthetic construct
  misc_feature 1..24: note = Synthetic Construct
  source 1..24: mol_type = other DNA
gatgtcttccctgaacagtcagaa

SEQ ID NO: 649 - DNA, 21 bp, synthetic construct
  misc_feature 1..21: note = Synthetic Construct
  source 1..21: mol_type = other DNA
gctgggctggttagggaaaca

SEQ ID NO: 650 - DNA, 24 bp, synthetic construct
  misc_feature 1..24: note = Synthetic Construct
  source 1..24: mol_type = other DNA
caacactgtgctgtatgggaaaat

SEQ ID NO: 651 - DNA, 21 bp, synthetic construct
  misc_feature 1..21: note = Synthetic Construct
  source 1..21: mol_type = other DNA
caacccaggaagacacaccaa

SEQ ID NO: 652 - DNA, 24 bp, synthetic construct
  misc_feature 1..24: note = Synthetic Construct
  source 1..24: mol_type = other DNA
agaaggtagttcacctgaccgtta

SEQ ID NO: 653 - DNA, 24 bp, synthetic construct
  misc_feature 1..24: note = Synthetic Construct
  source 1..24: mol_type = other DNA
gggctggcacatatgtagtagaag

SEQ ID NO: 654 - DNA, 22 bp, synthetic construct
  misc_feature 1..22: note = Synthetic Construct
  source 1..22: mol_type = other DNA
ggcgacaacattgccaggatct

SEQ ID NO: 655 - DNA, 25 bp, synthetic construct
  misc_feature 1..25: note = Synthetic Construct
  source 1..25: mol_type = other DNA
ctcagctcaggtatttgtgctgtta

SEQ ID NO: 656 - DNA, 24 bp, synthetic construct
  misc_feature 1..24: note = Synthetic Construct
  source 1..24: mol_type = other DNA
gctgcactgcatacatacatggaa

SEQ ID NO: 657 - DNA, 22 bp, synthetic construct
  misc_feature 1..22: note = Synthetic Construct
  source 1..22: mol_type = other DNA
ggcaaagtgatggtggcagctt

SEQ ID NO: 658 - DNA, 23 bp, synthetic construct
  misc_feature 1..23: note = Synthetic Construct
  source 1..23: mol_type = other DNA
ggaaatctgagcatgtggagtga

SEQ ID NO: 659 - DNA, 24 bp, synthetic construct
  misc_feature 1..24: note = Synthetic Construct
  source 1..24: mol_type = other DNA
cgatacccaggtaccatgttgaga

SEQ ID NO: 660 - DNA, 22 bp, synthetic construct
  misc_feature 1..22: note = Synthetic Construct
  source 1..22: mol_type = other DNA
ggaaggccatttggcaagaatc

SEQ ID NO: 661 - DNA, 24 bp, synthetic construct
  misc_feature 1..24: note = Synthetic Construct
  source 1..24: mol_type = other DNA
cttggtctgtccccaggttgttag

SEQ ID NO: 662 - DNA, 25 bp, synthetic construct
  misc_feature 1..25: note = Synthetic Construct
  source 1..25: mol_type = other DNA
tcgagagaaagatggggtagaaagt

SEQ ID NO: 663 - DNA, 24 bp, synthetic construct
  misc_feature 1..24: note = Synthetic Construct
  source 1..24: mol_type = other DNA
ccctgcctaacccaacatctgtgt

SEQ ID NO: 664 - DNA, 21 bp, synthetic construct
  misc_feature 1..21: note = Synthetic Construct
  source 1..21: mol_type = other DNA
gtggaaaaggcgtcagactgt

SEQ ID NO: 665 - DNA, 21 bp, synthetic construct
  misc_feature 1..21: note = Synthetic Construct
  source 1..21: mol_type = other DNA
cctgcgagttcctggagcaat

SEQ ID NO: 666 - DNA, 20 bp, synthetic construct
  misc_feature 1..20: note = Synthetic Construct
  source 1..20: mol_type = other DNA
ggactaggtggttggtgcaa

SEQ ID NO: 667 - DNA, 23 bp, synthetic construct
  misc_feature 1..23: note = Synthetic Construct
  source 1..23: mol_type = other DNA
agggcttttcatgtgagtgttgt

SEQ ID NO: 668 - DNA, 22 bp, synthetic construct
  misc_feature 1..22: note = Synthetic Construct
  source 1..22: mol_type = other DNA
agcatctggctcccaagtgcta

SEQ ID NO: 669 - DNA, 24 bp, synthetic construct
  misc_feature 1..24: note = Synthetic Construct
  source 1..24: mol_type = other DNA
ggcaagagacgaagtggaagcatt

SEQ ID NO: 670 - DNA, 27 bp, synthetic construct
  misc_feature 1..27: note = Synthetic Construct
  source 1..27: mol_type = other DNA
gcaagctgggtgaagttatcttgtttc

SEQ ID NO: 671 - DNA, 21 bp, synthetic construct
  misc_feature 1..21: note = Synthetic Construct
  source 1..21: mol_type = other DNA
gccagttgagggaagccatct

SEQ ID NO: 672 - DNA, 20 bp, synthetic construct
  misc_feature 1..20: note = Synthetic Construct
  source 1..20: mol_type = other DNA
gcctccttagtgggcaggtt

SEQ ID NO: 673 - DNA, 26 bp, synthetic construct
  misc_feature 1..26: note = Synthetic Construct
  source 1..26: mol_type = other DNA
cggaaacaaaacaactcttcccagat

SEQ ID NO: 674 - DNA, 19 bp, synthetic construct
  misc_feature 1..19: note = Synthetic Construct
  source 1..19: mol_type = other DNA
tgagccttgctggctgtca

SEQ ID NO: 675 - DNA, 22 bp, synthetic construct
  misc_feature 1..22: note = Synthetic Construct
  source 1..22: mol_type = other DNA
tgggaggcatagtccctgtgat

SEQ ID NO: 676 - DNA, 22 bp, synthetic construct
  misc_feature 1..22: note = Synthetic Construct
  source 1..22: mol_type = other DNA
ttctgtggggcacttgtacttt

SEQ ID NO: 677 - DNA, 26 bp, synthetic construct
  misc_feature 1..26: note = Synthetic Construct
  source 1..26: mol_type = other DNA
caaaggaggttcaaagaccagtttgt

SEQ ID NO: 678 - DNA, 26 bp, synthetic construct
  misc_feature 1..26: note = Synthetic Construct
  source 1..26: mol_type = other DNA
ccttagtcctactttttcccttgcat

SEQ ID NO: 679 - DNA, 21 bp, synthetic construct
  misc_feature 1..21: note = Synthetic Construct
  source 1..21: mol_type = other DNA
gaccttgcaagaacggagtca

SEQ ID NO: 680 - DNA, 23 bp, synthetic construct
  misc_feature 1..23: note = Synthetic Construct
  source 1..23: mol_type = other DNA
gactgccatctggcattgagaac

SEQ ID NO: 681 - DNA, 19 bp, synthetic construct
  misc_feature 1..19: note = Synthetic Construct
  source 1..19: mol_type = other DNA
agccgctcctgctttttga

SEQ ID NO: 682 - DNA, 25 bp, synthetic construct
  misc_feature 1..25: note = Synthetic Construct
  source 1..25: mol_type = other DNA
gccaaaagtgcagagttatttcagt

SEQ ID NO: 683 - DNA, 19 bp, synthetic construct
  misc_feature 1..19: note = Synthetic Construct
  source 1..19: mol_type = other DNA
tattggccgccagcactgt

SEQ ID NO: 684 - DNA, 22 bp, synthetic construct
  misc_feature 1..22: note = Synthetic Construct
  source 1..22: mol_type = other DNA
gagcgcctagtcagtactttgt

SEQ ID NO: 685 - DNA, 21 bp, synthetic construct
  misc_feature 1..21: note = Synthetic Construct
  source 1..21: mol_type = other DNA
gaagccaagttggtggaggat

SEQ ID NO: 686 - DNA, 24 bp, synthetic construct
  misc_feature 1..24: note = Synthetic Construct
  source 1..24: mol_type = other DNA
gagaagggagagatgcatgggttt

SEQ ID NO: 687 - DNA, 21 bp, synthetic construct
  misc_feature 1..21: note = Synthetic Construct
  source 1..21: mol_type = other DNA
ggccacccctgtgcatcttta

SEQ ID NO: 688 - DNA, 21 bp, synthetic construct
  misc_feature 1..21: note = Synthetic Construct
  source 1..21: mol_type = other DNA
tgaatggtggccgaattgtgt

SEQ ID NO: 689 - DNA, 27 bp, synthetic construct
  misc_feature 1..27: note = Synthetic Construct
  source 1..27: mol_type = other DNA
gccctttctggaggtacttgagcttat

SEQ ID NO: 690 - DNA, 22 bp, synthetic construct
  misc_feature 1..22: note = Synthetic Construct
  source 1..22: mol_type = other DNA
gcagtctccagtgctgttcttc

SEQ ID NO: 691 - DNA, 22 bp, synthetic construct
  misc_feature 1..22: note = Synthetic Construct
  source 1..22: mol_type = other DNA
cttcacccacagccagaaatgt

SEQ ID NO: 692 - DNA, 25 bp, synthetic construct
  misc_feature 1..25: note = Synthetic Construct
  source 1..25: mol_type = other DNA
ctggcttggaacagaaaccatgact

SEQ ID NO: 693 - DNA, 20 bp, synthetic construct
  misc_feature 1..20: note = Synthetic Construct
  source 1..20: mol_type = other DNA
aaggcttgagacgtgcttgt

SEQ ID NO: 694 - DNA, 18 bp, synthetic construct
  misc_feature 1..18: note = Synthetic Construct
  source 1..18: mol_type = other DNA
gctgcagtgagccacgat

SEQ ID NO: 695 - DNA, 20 bp, synthetic construct
  misc_feature 1..20: note = Synthetic Construct
  source 1..20: mol_type = other DNA
tggctggagcagagtgaaca

SEQ ID NO: 696 - DNA, 22 bp, synthetic construct
  misc_feature 1..22: note = Synthetic Construct
  source 1..22: mol_type = other DNA
ccgccatcaggggttgatgtaa

SEQ ID NO: 697 - DNA, 20 bp, synthetic construct
  misc_feature 1..20: note = Synthetic Construct
  source 1..20: mol_type = other DNA
agggatcagggccatcttca

SEQ ID NO: 698 - DNA, 21 bp, synthetic construct
  misc_feature 1..21: note = Synthetic Construct
  source 1..21: mol_type = other DNA
agtcagcaggctggaaaaact

SEQ ID NO: 699 - DNA, 22 bp, synthetic construct
  misc_feature 1..22: note = Synthetic Construct
  source 1..22: mol_type = other DNA
ctgtgcaggaagcaaggtagat

SEQ ID NO: 700 - DNA, 25 bp, synthetic construct
  misc_feature 1..25: note = Synthetic Construct
  source 1..25: mol_type = other DNA
tgagtcaaggtgatacttgcttctt

SEQ ID NO: 701 - DNA, 26 bp, synthetic construct
  misc_feature 1..26: note = Synthetic Construct
  source 1..26: mol_type = other DNA
acctataacaaaggggaagtcaggat

SEQ ID NO: 702 - DNA, 22 bp, synthetic construct
  misc_feature 1..22: note = Synthetic Construct
  source 1..22: mol_type = other DNA
accttccccaccatgttctaca

SEQ ID NO: 703 - DNA, 24 bp, synthetic construct
  misc_feature 1..24: note = Synthetic Construct
  source 1..24: mol_type = other DNA
cacatgcccagtaaatggaacaaa

SEQ ID NO: 704 - DNA, 22 bp, synthetic construct
  misc_feature 1..22: note = Synthetic Construct
  source 1..22: mol_type = other DNA
cacctggaagctgaagccaaag

SEQ ID NO: 705 - DNA, 20 bp, synthetic construct
  misc_feature 1..20: note = Synthetic Construct
  source 1..20: mol_type = other DNA
agtgggcgagcgccccttat

SEQ ID NO: 706 - DNA, 19 bp, synthetic construct
  misc_feature 1..19: note = Synthetic Construct
  source 1..19: mol_type = other DNA
agccctgctgcgtggacaa

SEQ ID NO: 707 - DNA, 25 bp, synthetic construct
  misc_feature 1..25: note = Synthetic Construct
  source 1..25: mol_type = other DNA
cttgggaaactaagtgagggcaaag

SEQ ID NO: 708 - DNA, 22 bp, synthetic construct
  misc_feature 1..22: note = Synthetic Construct
  source 1..22: mol_type = other DNA
gcagcttttcctggtgtctttc

SEQ ID NO: 709 - DNA, 25 bp, synthetic construct
  misc_feature 1..25: note = Synthetic Construct
  source 1..25: mol_type = other DNA
ggggtggttaagtatgggctagcaa

SEQ ID NO: 710 - DNA, 25 bp, synthetic construct
  misc_feature 1..25: note = Synthetic Construct
  source 1..25: mol_type = other DNA
agtgagcatacagcttctcagaaat

SEQ ID NO: 711 - DNA, 25 bp, synthetic construct
  misc_feature 1..25: note = Synthetic Construct
  source 1..25: mol_type = other DNA
ggatctaagcagtgcatctctgtgt

SEQ ID NO: 712 - DNA, 21 bp, synthetic construct
  misc_feature 1..21: note = Synthetic Construct
  source 1..21: mol_type = other DNA
ggtgactgtgcacgcgttaat

SEQ ID NO: 713 - DNA, 22 bp, synthetic construct
  misc_feature 1..22: note = Synthetic Construct
  source 1..22: mol_type = other DNA
gctcaagtactccctggcttct

SEQ ID NO: 714 - DNA, 27 bp, synthetic construct
  misc_feature 1..27: note = Synthetic Construct
  source 1..27: mol_type = other DNA
caggatcttctttgtttgaaggagctt

SEQ ID NO: 715 - DNA, 21 bp, synthetic construct
  misc_feature 1..21: note = Synthetic Construct
  source 1..21: mol_type = other DNA
ggcagacaaatcagcccagtt

SEQ ID NO: 716 - DNA, 21 bp, synthetic construct
  misc_feature 1..21: note = Synthetic Construct
  source 1..21: mol_type = other DNA
gtcattgaactgcgcttgcat

SEQ ID NO: 717 - DNA, 24 bp, synthetic construct
  misc_feature 1..24: note = Synthetic Construct
  source 1..24: mol_type = other DNA
gggactacagataagcaccactgt

SEQ ID NO: 718 - DNA, 22 bp, synthetic construct
  misc_feature 1..22: note = Synthetic Construct
  source 1..22: mol_type = other DNA
caaagaggccctcatgctcagt

SEQ ID NO: 719 - DNA, 22 bp, synthetic construct
  misc_feature 1..22: note = Synthetic Construct
  source 1..22: mol_type = other DNA
ttggtcctacaaccaagcaagt

SEQ ID NO: 720 - DNA, 25 bp, synthetic construct
  misc_feature 1..25: note = Synthetic Construct
  source 1..25: mol_type = other DNA
gccagagatgaatggtttgcgaatg

SEQ ID NO: 721 - DNA, 24 bp, synthetic construct
  misc_feature 1..24: note = Synthetic Construct
  source 1..24: mol_type = other DNA
cctgtgctatagaatcagcactct

SEQ ID NO: 722 - DNA, 22 bp, synthetic construct
  misc_feature 1..22: note = Synthetic Construct
  source 1..22: mol_type = other DNA
tgtgtgttgtggagagggagat

SEQ ID NO: 723 - DNA, 26 bp, synthetic construct
  misc_feature 1..26: note = Synthetic Construct
  source 1..26: mol_type = other DNA
gaagctccttacattagtgccaggtt

SEQ ID NO: 724 - DNA, 25 bp, synthetic construct
  misc_feature 1..25: note = Synthetic Construct
  source 1..25: mol_type = other DNA
tgcactcagaggagaagttaaaaca

SEQ ID NO: 725 - DNA, 27 bp, synthetic construct
  misc_feature 1..27: note = Synthetic Construct
  source 1..27: mol_type = other DNA
ggatcaaagttcaaggagttagtgtga

SEQ ID NO: 726 - DNA, 22 bp, synthetic construct
  misc_feature 1..22: note = Synthetic Construct
  source 1..22: mol_type = other DNA
cgccaccagcatttgagtcttg

SEQ ID NO: 727 - DNA, 19 bp, synthetic construct
  misc_feature 1..19: note = Synthetic Construct
  source 1..19: mol_type = other DNA
ccggccaagaaggtagcaa

SEQ ID NO: 728 - DNA, 21 bp, synthetic construct
  misc_feature 1..21: note = Synthetic Construct
  source 1..21: mol_type = other DNA
gggctttctggccgagatgaa

SEQ ID NO: 729 - DNA, 20 bp, synthetic construct
  misc_feature 1..20: note = Synthetic Construct
  source 1..20: mol_type = other DNA
gccacaggttggaggcaaga

SEQ ID NO: 730 - DNA, 21 bp, synthetic construct
  misc_feature 1..21: note = Synthetic Construct
  source 1..21: mol_type = other DNA
agtgccctgctcaaccaatac

SEQ ID NO: 731 - DNA, 24 bp, synthetic construct
  misc_feature 1..24: note = Synthetic Construct
  source 1..24: mol_type = other DNA
tccctcttgtttccaggtttttgt

SEQ ID NO: 732 - DNA, 20 bp, synthetic construct
  misc_feature 1..20: note = Synthetic Construct
  source 1..20: mol_type = other DNA
ggaggctccatccacagtca

SEQ ID NO: 733 - DNA, 24 bp, synthetic construct
  misc_feature 1..24: note = Synthetic Construct
  source 1..24: mol_type = other DNA
gggcaaatctgtgtcctccagata

SEQ ID NO: 734 - DNA, 24 bp, synthetic construct
  misc_feature 1..24: note = Synthetic Construct
  source 1..24: mol_type = other DNA
gggttacaggttgactctgggatt

SEQ ID NO: 735 - DNA, 21 bp, synthetic construct
  misc_feature 1..21: note = Synthetic Construct
  source 1..21: mol_type = other DNA
cctagcctacaagcgcactct

SEQ ID NO: 736 - DNA, 23 bp, synthetic construct
  misc_feature 1..23: note = Synthetic Construct
  source 1..23: mol_type = other DNA
gagtactgaggcagggaaggttt

SEQ ID NO: 737 - DNA, 26 bp, synthetic construct
  misc_feature 1..26: note = Synthetic Construct
  source 1..26: mol_type = other DNA
ccaatgagttgtagagctcagattgt

SEQ ID NO: 738 - DNA, 22 bp, synthetic construct
  misc_feature 1..22: note = Synthetic Construct
  source 1..22: mol_type = other DNA
gaggggtgctagtcaactgtgt

SEQ ID NO: 739 - DNA, 20 bp, synthetic construct
  misc_feature 1..20: note = Synthetic Construct
  source 1..20: mol_type = other DNA
aatgccaagccaccctggaa

SEQ ID NO: 740 - DNA, 22 bp, synthetic construct
  misc_feature 1..22: note = Synthetic Construct
  source 1..22: mol_type = other DNA
aggaacccacagcggtaactga

SEQ ID NO: 741 - DNA, 19 bp, synthetic construct
  misc_feature 1..19: note = Synthetic Construct
  source 1..19: mol_type = other DNA
tgcgagctgagtgcagcat

SEQ ID NO: 742 - DNA, 26 bp, synthetic construct
  misc_feature 1..26: note = Synthetic Construct
  source 1..26: mol_type = other DNA
ctccaagtccaggatatatgaagcaa

SEQ ID NO: 743 - DNA, 24 bp, synthetic construct
  misc_feature 1..24: note = Synthetic Construct
  source 1..24: mol_type = other DNA
gcacagaaataatcgtgcaggaaa

SEQ ID NO: 744 - DNA, 24 bp, synthetic construct
  misc_feature 1..24: note = Synthetic Construct
  source 1..24: mol_type = other DNA
gggagcaaacctcttaggaagaca

SEQ ID NO: 745 - DNA, 24 bp, synthetic construct
  misc_feature 1..24: note = Synthetic Construct
  source 1..24: mol_type = other DNA
tttggggttttgggatgaggataa

SEQ ID NO: 746 - DNA, 21 bp, synthetic construct
  misc_feature 1..21: note = Synthetic Construct
  source 1..21: mol_type = other DNA
ttcctccgcccaaccgtcttt

SEQ ID NO: 747 - DNA, 23 bp, synthetic construct
  misc_feature 1..23: note = Synthetic Construct
  source 1..23: mol_type = other DNA
gctaccctgaagtgctgatggat

SEQ ID NO: 748 - DNA, 26 bp, synthetic construct
  misc_feature 1..26: note = Synthetic Construct
  source 1..26: mol_type = other DNA
cttgatctgtcaagggagaagagaga

SEQ ID NO: 749 - DNA, 23 bp, synthetic construct
  misc_feature 1..23: note = Synthetic Construct
  source 1..23: mol_type = other DNA
gcaaagggagtgatgggagatga

SEQ ID NO: 750 - DNA, 20 bp, synthetic construct
  misc_feature 1..20: note = Synthetic Construct
  source 1..20: mol_type = other DNA
ccgactcttggtgggttgaa

SEQ ID NO: 751 - DNA, 24 bp, synthetic construct
  misc_feature 1..24: note = Synthetic Construct
  source 1..24: mol_type = other DNA
tgtgttcctagagactctggcttt

SEQ ID NO: 752 - DNA, 22 bp, synthetic construct
  misc_feature 1..22: note = Synthetic Construct
  source 1..22: mol_type = other DNA
accagctgtgtgagctaagttg

SEQ ID NO: 753 - DNA, 22 bp, synthetic construct
  misc_feature 1..22: note = Synthetic Construct
  source 1..22: mol_type = other DNA
ttgcctttccctgtctttggaa

SEQ ID NO: 754 - DNA, 22 bp, synthetic construct
  misc_feature 1..22: note = Synthetic Construct
  source 1..22: mol_type = other DNA
gcaggactaacaatggctcaga

SEQ ID NO: 755 - DNA, 19 bp, synthetic construct
  misc_feature 1..19: note = Synthetic Construct
  source 1..19: mol_type = other DNA
caggagccacctgggaact

SEQ ID NO: 756 - DNA, 24 bp, synthetic construct
  misc_feature 1..24: note = Synthetic Construct
  source 1..24: mol_type = other DNA
tggagaagagcaaatccatgttgt

SEQ ID NO: 757 - DNA, 24 bp, synthetic construct
  misc_feature 1..24: note = Synthetic Construct
  source 1..24: mol_type = other DNA
ccaggacccagaagtactccctat

SEQ ID NO: 758 - DNA, 22 bp, synthetic construct
  misc_feature 1..22: note = Synthetic Construct
  source 1..22: mol_type = other DNA
cctaccatatgcaaggcaccat

SEQ ID NO: 759 - DNA, 22 bp, synthetic construct
  misc_feature 1..22: note = Synthetic Construct
  source 1..22: mol_type = other DNA
agaagtccaggcttcccacttg

SEQ ID NO: 760 - DNA, 26 bp, synthetic construct
  misc_feature 1..26: note = Synthetic Construct
  source 1..26: mol_type = other DNA
gggcttgttaaatgaacccgagaagt

SEQ ID NO: 761 - DNA, 25 bp, synthetic construct
  misc_feature 1..25: note = Synthetic Construct
  source 1..25: mol_type = other DNA
gccacagtaaaacaaagtacacagt

SEQ ID NO: 762 - DNA, 23 bp, synthetic construct
  misc_feature 1..23: note = Synthetic Construct
  source 1..23: mol_type = other DNA
tgtgcagtgaatgcagagactat

SEQ ID NO: 763 - DNA, 24 bp, synthetic construct
  misc_feature 1..24: note = Synthetic Construct
  source 1..24: mol_type = other DNA
ctcacaagcctagaagggtatgtt

SEQ ID NO: 764 - DNA, 22 bp, synthetic construct
  misc_feature 1..22: note = Synthetic Construct
  source 1..22: mol_type = other DNA
atgggacacctccctgctgagt

SEQ ID NO: 765 - DNA, 25 bp, synthetic construct
  misc_feature 1..25: note = Synthetic Construct
  source 1..25: mol_type = other DNA
ggtgtagcagggagagagattggtt

SEQ ID NO: 766 - DNA, 22 bp, synthetic construct
  misc_feature 1..22: note = Synthetic Construct
  source 1..22: mol_type = other DNA
ggccttgttgcctctccactta

SEQ ID NO: 767 - DNA, 25 bp, synthetic construct
  misc_feature 1..25: note = Synthetic Construct
  source 1..25: mol_type = other DNA
cacttcatagtgtcaccctggttgt

SEQ ID NO: 768 - DNA, 22 bp, synthetic construct
  misc_feature 1..22: note = Synthetic Construct
  source 1..22: mol_type = other DNA
agaagctgctttctgcttgtca

SEQ ID NO: 769 - DNA, 25 bp, synthetic construct
  misc_feature 1..25: note = Synthetic Construct
  source 1..25: mol_type = other DNA
gattgtttgtgctccagaaagaaga

SEQ ID NO: 770 - DNA, 22 bp, synthetic construct
  misc_feature 1..22: note = Synthetic Construct
  source 1..22: mol_type = other DNA
gaacagttggcgataggctgaa

SEQ ID NO: 771 - DNA, 22 bp, synthetic construct
  misc_feature 1..22: note = Synthetic Construct
  source 1..22: mol_type = other DNA
ggccctatactgccttcagaga

SEQ ID NO: 772 - DNA, 26 bp, synthetic construct
  misc_feature 1..26: note = Synthetic Construct
  source 1..26: mol_type = other DNA
cacaggtgatagcaacaacctaccat

SEQ ID NO: 773 - DNA, 24 bp, synthetic construct
  misc_feature 1..24: note = Synthetic Construct
  source 1..24: mol_type = other DNA
ccttgggtggaacctgtgattcaa

SEQ ID NO: 774 - DNA, 21 bp, synthetic construct
  misc_feature 1..21: note = Synthetic Construct
  source 1..21: mol_type = other DNA
aggcaccatgctcagctccta

SEQ ID NO: 775 - DNA, 22 bp, synthetic construct
  misc_feature 1..22: note = Synthetic Construct
  source 1..22: mol_type = other DNA
gctcaaagccttggggttctac

SEQ ID NO: 776 - DNA, 21 bp, synthetic construct
  misc_feature 1..21: note = Synthetic Construct
  source 1..21: mol_type = other DNA
gctccaatgtcagtcccttca

SEQ ID NO: 777 - DNA, 22 bp, synthetic construct
  misc_feature 1..22: note = Synthetic Construct
  source 1..22: mol_type = other DNA
gctggagttccaggttggactt

SEQ ID NO: 778 - DNA, 19 bp, synthetic construct
  misc_feature 1..19: note = Synthetic Construct
  source 1..19: mol_type = other DNA
gggcaccccaccattggaa

SEQ ID NO: 779 - DNA, 22 bp, synthetic construct
  misc_feature 1..22: note = Synthetic Construct
  source 1..22: mol_type = other DNA
gccagtctgtggtgttcattgt

SEQ ID NO: 780 - DNA, 21 bp, synthetic construct
  misc_feature 1..21: note = Synthetic Construct
  source 1..21: mol_type = other DNA
caccctgggaagctgactgta

SEQ ID NO: 781 - DNA, 22 bp, synthetic construct
  misc_feature 1..22: note = Synthetic Construct
  source 1..22: mol_type = other DNA
gtggcatctgaggtgagctttg

SEQ ID NO: 782 - DNA, 24 bp, synthetic construct
  misc_feature 1..24: note = Synthetic Construct
  source 1..24: mol_type = other DNA
gccggtagttgtgacaataggaaa

SEQ ID NO: 783 - DNA, 25 bp, synthetic construct
  misc_feature 1..25: note = Synthetic Construct
  source 1..25: mol_type = other DNA
gggcgtacttcctttttcattctac

SEQ ID NO: 784 - DNA, 22 bp, synthetic construct
  misc_feature 1..22: note = Synthetic Construct
  source 1..22: mol_type = other DNA
tctaggctggactggacaccaa

SEQ ID NO: 785 - DNA, 26 bp, synthetic construct
  misc_feature 1..26: note = Synthetic Construct
  source 1..26: mol_type = other DNA
gagtttcctgttctgggtatgggttt

SEQ ID NO: 786 - DNA, 22 bp, synthetic construct
  misc_feature 1..22: note = Synthetic Construct
  source 1..22: mol_type = other DNA
gagacacctggaaggacgaaca

SEQ ID NO: 787 - DNA, 23 bp, synthetic construct
  misc_feature 1..23: note = Synthetic Construct
  source 1..23: mol_type = other DNA
gcttgcctgagaaatgcctgtga

SEQ ID NO: 788 - DNA, 20 bp, synthetic construct
  misc_feature 1..20: note = Synthetic Construct
  source 1..20: mol_type = other DNA
cccacacacaactgctcaca

SEQ ID NO: 789 - DNA, 19 bp, synthetic construct
  misc_feature 1..19: note = Synthetic Construct
  source 1..19: mol_type = other DNA
tggcaggacaaggggtttg

SEQ ID NO: 790 - DNA, 24 bp, synthetic construct
  misc_feature 1..24: note = Synthetic Construct
  source 1..24: mol_type = other DNA
cctattcccatggagccattgttg

SEQ ID NO: 791 - DNA, 20 bp, synthetic construct
  misc_feature 1..20: note = Synthetic Construct
  source 1..20: mol_type = other DNA
accttgctgagggagcagta

SEQ ID NO: 792 - DNA, 23 bp, synthetic construct
  misc_feature 1..23: note = Synthetic Construct
  source 1..23: mol_type = other DNA
caaggcagatgggagaagagcaa

SEQ ID NO: 793 - DNA, 19 bp, synthetic construct
  misc_feature 1..19: note = Synthetic Construct
  source 1..19: mol_type = other DNA
ccaccttccagccccttga

SEQ ID NO: 794 - DNA, 20 bp, synthetic construct
  misc_feature 1..20: note = Synthetic Construct
  source 1..20: mol_type = other DNA
gcaacatcctggggcacaga

SEQ ID NO: 795 - DNA, 20 bp, synthetic construct
  misc_feature 1..20: note = Synthetic Construct
  source 1..20: mol_type = other DNA
tcccaacacaggtggctaga

SEQ ID NO: 796 - DNA, 26 bp, synthetic construct
  misc_feature 1..26: note = Synthetic Construct
  source 1..26: mol_type = other DNA
ggagtggatgcagaagtgtttctttc

SEQ ID NO: 797 - DNA, 24 bp, synthetic construct
  misc_feature 1..24: note = Synthetic Construct
  source 1..24: mol_type = other DNA
gtacactagcaagtaccggtgaga

SEQ ID NO: 798 - DNA, 20 bp, synthetic construct
  misc_feature 1..20: note = Synthetic Construct
  source 1..20: mol_type = other DNA
tgaggcttgtttccgcatgt

SEQ ID NO: 799 - DNA, 26 bp, synthetic construct
  misc_feature 1..26: note = Synthetic Construct
  source 1..26: mol_type = other DNA
actggactacactggactactttgat

SEQ ID NO: 800 - DNA, 22 bp, synthetic construct
  misc_feature 1..22: note = Synthetic Construct
  source 1..22: mol_type = other DNA
ccaagagcccacctgattctct

SEQ ID NO: 801 - DNA, 22 bp, synthetic construct
  misc_feature 1..22: note = Synthetic Construct
  source 1..22: mol_type = other DNA
tgataggcaaacagcagacagt

SEQ ID NO: 802 - DNA, 20 bp, synthetic construct
  misc_feature 1..20: note = Synthetic Construct
  source 1..20: mol_type = other DNA
cccgcgttacaatgcaactt

SEQ ID NO: 803 - DNA, 24 bp, synthetic construct
  misc_feature 1..24: note = Synthetic Construct
  source 1..24: mol_type = other DNA
cacttccaaaaggcagctacaatc

SEQ ID NO: 804 - DNA, 20 bp, synthetic construct
  misc_feature 1..20: note = Synthetic Construct
  source 1..20: mol_type = other DNA
tgcctggtgatcctccatca

SEQ ID NO: 805 - DNA, 23 bp, synthetic construct
  misc_feature 1..23: note = Synthetic Construct
  source 1..23: mol_type = other DNA
gctgcaaacgagaagtaaagcat

SEQ ID NO: 806 - DNA, 21 bp, synthetic construct
  misc_feature 1..21: note = Synthetic Construct
  source 1..21: mol_type = other DNA
gccctatgcacattggcttgt

SEQ ID NO: 807 - DNA, 21 bp, synthetic construct
  misc_feature 1..21: note = Synthetic Construct
  source 1..21: mol_type = other DNA
aaggactgagcaatggctgtt

SEQ ID NO: 808 - DNA, 20 bp, synthetic construct
  misc_feature 1..20: note = Synthetic Construct
  source 1..20: mol_type = other DNA
ggccgcagagcctcaacttt

SEQ ID NO: 809 - DNA, 26 bp, synthetic construct
  misc_feature 1..26: note = Synthetic Construct
  source 1..26: mol_type = other DNA
ggagtctgcagtttgaggtttatatg

SEQ ID NO: 810 - DNA, 24 bp, synthetic construct
  misc_feature 1..24: note = Synthetic Construct
  source 1..24: mol_type = other DNA
cctgtttcaggattaagggcttct

SEQ ID NO: 811 - DNA, 21 bp, synthetic construct
  misc_feature 1..21: note = Synthetic Construct
  source 1..21: mol_type = other DNA
agctttggggtccctcagtat

SEQ ID NO: 812 - DNA, 23 bp, synthetic construct
  misc_feature 1..23: note = Synthetic Construct
  source 1..23: mol_type = other DNA
agatcaaatcaccccagctttgt

SEQ ID NO: 813 - DNA, 21 bp, synthetic construct
  misc_feature 1..21: note = Synthetic Construct
  source 1..21: mol_type = other DNA
cacacatgtccctgcagtttg

SEQ ID NO: 814 - DNA, 21 bp, synthetic construct
  misc_feature 1..21: note = Synthetic Construct
  source 1..21: mol_type = other DNA
gcgtctgactcatgtcctgtt

SEQ ID NO: 815 - DNA, 22 bp, synthetic construct
  misc_feature 1..22: note = Synthetic Construct
  source 1..22: mol_type = other DNA
ccggcttctttaccccacttag

SEQ ID NO: 816 - DNA, 19 bp, synthetic construct
  misc_feature 1..19: note = Synthetic Construct
  source 1..19: mol_type = other DNA
caccccagaccccaagttc

SEQ ID NO: 817 - DNA, 20 bp, synthetic construct
  misc_feature 1..20: note = Synthetic Construct
  source 1..20: mol_type = other DNA
agcctgtctgccacctgaaa

SEQ ID NO: 818 - DNA, 19 bp, synthetic construct
  misc_feature 1..19: note = Synthetic Construct
  source 1..19: mol_type = other DNA
ggagcagagcgaccgtcat

SEQ ID NO: 819 - DNA, 24 bp, synthetic construct
  misc_feature 1..24: note = Synthetic Construct
  source 1..24: mol_type = other DNA
gcactggactagtattcgggagat

SEQ ID NO: 820 - DNA, 23 bp, synthetic construct
  misc_feature 1..23: note = Synthetic Construct
  source 1..23: mol_type = other DNA
ctcttctggcacaaggtgtgtct

SEQ ID NO: 821 - DNA, 23 bp, synthetic construct
  misc_feature 1..23: note = Synthetic Construct
  source 1..23: mol_type = other DNA
caccagcaaagagggaagttaga

SEQ ID NO: 822 - DNA, 24 bp, synthetic construct
  misc_feature 1..24: note = Synthetic Construct
  source 1..24: mol_type = other DNA
gatgtcaacgtactgactccaaca

SEQ ID NO: 823 - DNA, 21 bp, synthetic construct
  misc_feature 1..21: note = Synthetic Construct
  source 1..21: mol_type = other DNA
ccaccagcttcattggtctct

SEQ ID NO: 824 - DNA, 24 bp, synthetic construct
  misc_feature 1..24: note = Synthetic Construct
  source 1..24: mol_type = other DNA
gggatggttatcatgcccctcttc

SEQ ID NO: 825 - DNA, 23 bp, synthetic construct
  misc_feature 1..23: note = Synthetic Construct
  source 1..23: mol_type = other DNA
ggttctagatcccgctctcttct

SEQ ID NO: 826 - DNA, 24 bp, synthetic construct
  misc_feature 1..24: note = Synthetic Construct
  source 1..24: mol_type = other DNA
ctctggtacctgaaccttcccatt

SEQ ID NO: 827 - DNA, 21 bp, synthetic construct
  misc_feature 1..21: note = Synthetic Construct
  source 1..21: mol_type = other DNA
tgcttcgaggagaggtagtga

SEQ ID NO: 828 - DNA, 21 bp, synthetic construct
  misc_feature 1..21: note = Synthetic Construct
  source 1..21: mol_type = other DNA
gcacttgactcacagggagaa

SEQ ID NO: 829 - DNA, 22 bp, synthetic construct
  misc_feature 1..22: note = Synthetic Construct
  source 1..22: mol_type = other DNA
gttatggcagctgacaccagta

SEQ ID NO: 830 - DNA, 23 bp, synthetic construct
  misc_feature 1..23: note = Synthetic Construct
  source 1..23: mol_type = other DNA
gtcacagattcagggagaagcaa

SEQ ID NO: 831 - DNA, 22 bp, synthetic construct
  misc_feature 1..22: note = Synthetic Construct
  source 1..22: mol_type = other DNA
cagccttttccctaggcaatgt

SEQ ID NO: 832 - DNA, 25 bp, synthetic construct
  misc_feature 1..25: note = Synthetic Construct
  source 1..25: mol_type = other DNA
gctctggctactgctattggtgtga

SEQ ID NO: 833 - DNA, 23 bp, synthetic construct
  misc_feature 1..23: note = Synthetic Construct
  source 1..23: mol_type = other DNA
acacaaagagttcgatggccttt

SEQ ID NO: 834 - DNA, 23 bp, synthetic construct
  misc_feature 1..23: note = Synthetic Construct
  source 1..23: mol_type = other DNA
tgtttccagacaagccaacaagt

SEQ ID NO: 835 - DNA, 23 bp, synthetic construct
  misc_feature 1..23: note = Synthetic Construct
  source 1..23: mol_type = other DNA
ggcagagcagcttctttccatct

SEQ ID NO: 836 - DNA, 19 bp, synthetic construct
  misc_feature 1..19: note = Synthetic Construct
  source 1..19: mol_type = other DNA
gtccagcctcggagcaaaa

SEQ ID NO: 837 - DNA, 24 bp, synthetic construct
  misc_feature 1..24: note = Synthetic Construct
  source 1..24: mol_type = other DNA
tcactatgaaccctaccaccacta

SEQ ID NO: 838 - DNA, 21 bp, synthetic construct
  misc_feature 1..21: note = Synthetic Construct
  source 1..21: mol_type = other DNA
cccctgccttcctggtagtaa

SEQ ID NO: 839 - DNA, 19 bp, synthetic construct
  misc_feature 1..19: note = Synthetic Construct
  source 1..19: mol_type = other DNA
aaggcgaccctccggaaca

SEQ ID NO: 840 - DNA, 20 bp, synthetic construct
  misc_feature 1..20: note = Synthetic Construct
  source 1..20: mol_type = other DNA
aggcggagctctaagcacta

SEQ ID NO: 841 - DNA, 24 bp, synthetic construct
  misc_feature 1..24: note = Synthetic Construct
  source 1..24: mol_type = other DNA
atgagctctgcagtcattgaattg

SEQ ID NO: 842 - DNA, 20 bp, synthetic construct
  misc_feature 1..20: note = Synthetic Construct
  source 1..20: mol_type = other DNA
ctggctgctatgcactcaga

SEQ ID NO: 843 - DNA, 23 bp, synthetic construct
  misc_feature 1..23: note = Synthetic Construct
  source 1..23: mol_type = other DNA
gcttcgtgcttttacctgactgt

SEQ ID NO: 844 - DNA, 22 bp, synthetic construct
  misc_feature 1..22: note = Synthetic Construct
  source 1..22: mol_type = other DNA
ccaaggacagacctcccagaga

SEQ ID NO: 845 - DNA, 27 bp, synthetic construct
  misc_feature 1..27: note = Synthetic Construct
  source 1..27: mol_type = other DNA
ggggttacttaccggtcagacaaattc

SEQ ID NO: 846 - DNA, 24 bp, synthetic construct
  misc_feature 1..24: note = Synthetic Construct
  source 1..24: mol_type = other DNA
gcagaagcatcactgcgtaatatc

SEQ ID NO: 847 - DNA, 23 bp, synthetic construct
  misc_feature 1..23: note = Synthetic Construct
  source 1..23: mol_type = other DNA
accatcctccccatctcagtaaa

SEQ ID NO: 848 - DNA, 26 bp, synthetic construct
  misc_feature 1..26: note = Synthetic Construct
  source 1..26: mol_type = other DNA
cgtctccatttctgtatccctctcaa

SEQ ID NO: 849 - DNA, 23 bp, synthetic construct
  misc_feature 1..23: note = Synthetic Construct
  source 1..23: mol_type = other DNA
gtggggtaacggtttaggagttg

SEQ ID NO: 850 - DNA, 25 bp, synthetic construct
  misc_feature 1..25: note = Synthetic Construct
  source 1..25: mol_type = other DNA
ccttaattactgccgattgcctgtt

SEQ ID NO: 851 - DNA, 23 bp, synthetic construct
  misc_feature 1..23: note = Synthetic Construct
  source 1..23: mol_type = other DNA
agcctggagaacaaaaggtgaaa

SEQ ID NO: 852 - DNA, 20 bp, synthetic construct
  misc_feature 1..20: note = Synthetic Construct
  source 1..20: mol_type = other DNA
cgaggcaatttcccctgcaa

SEQ ID NO: 853 - DNA, 22 bp, synthetic construct
  misc_feature 1..22: note = Synthetic Construct
  source 1..22: mol_type = other DNA
gaggtgacatgcctgttgtcat

SEQ ID NO: 854 - DNA, 26 bp, synthetic construct
  misc_feature 1..26: note = Synthetic Construct
  source 1..26: mol_type = other DNA
gcccttctagtgaatgtttgggttca

SEQ ID NO: 855 - DNA, 23 bp, synthetic construct
  misc_feature 1..23: note = Synthetic Construct
  source 1..23: mol_type = other DNA
ccaacaatctctgtgcctctact

SEQ ID NO: 856 - DNA, 23 bp, synthetic construct
  misc_feature 1..23: note = Synthetic Construct
  source 1..23: mol_type = other DNA
ccctgcctaaaggtctccaaaac

SEQ ID NO: 857 - DNA, 21 bp, synthetic construct
  misc_feature 1..21: note = Synthetic Construct
  source 1..21: mol_type = other DNA
tgagggctatcctcgaccttt

SEQ ID NO: 858 - DNA, 25 bp, synthetic construct
  misc_feature 1..25: note = Synthetic Construct
  source 1..25: mol_type = other DNA
gtggtagctactgaatcagccctat

SEQ ID NO: 859 - DNA, 21 bp, synthetic construct
  misc_feature 1..21: note = Synthetic Construct
  source 1..21: mol_type = other DNA
tccaggtgaaagcaggtcaag

SEQ ID NO: 860 - DNA, 24 bp, synthetic construct
  misc_feature 1..24: note = Synthetic Construct
  source 1..24: mol_type = other DNA
gcagataaagcaaaagggtgactt

SEQ ID NO: 861 - DNA, 22 bp, synthetic construct
  misc_feature 1..22: note = Synthetic Construct
  source 1..22: mol_type = other DNA
tccaggtcactgcctcatagat

SEQ ID NO: 862 - DNA, 21 bp, synthetic construct
  misc_feature 1..21: note = Synthetic Construct
  source 1..21: mol_type = other DNA
tgtgggaggagaggtcaccat

SEQ ID NO: 863 - DNA, 20 bp, synthetic construct
  misc_feature 1..20: note = Synthetic Construct
  source 1..20: mol_type = other DNA
agggcctagcggtcaacatt

SEQ ID NO: 864 - DNA, 25 bp, synthetic construct
  misc_feature 1..25: note = Synthetic Construct
  source 1..25: mol_type = other DNA
gggcaacagaagtaacatccattag

SEQ ID NO: 865 - DNA, 22 bp, synthetic construct
  misc_feature 1..22: note = Synthetic Construct
  source 1..22: mol_type = other DNA
tctgctacagtctttgcgttca

SEQ ID NO: 866 - DNA, 22 bp, synthetic construct
  misc_feature 1..22: note = Synthetic Construct
  source 1..22: mol_type = other DNA
tgaccttttcagcttccgttgt

SEQ ID NO: 867 - DNA, 20 bp, synthetic construct
  misc_feature 1..20: note = Synthetic Construct
  source 1..20: mol_type = other DNA
tggaggaccaaagccctcat

SEQ ID NO: 868 - DNA, 23 bp, synthetic construct
  misc_feature 1..23: note = Synthetic Construct
  source 1..23: mol_type = other DNA
gtgacacctctgcctttgcatgt

SEQ ID NO: 869 - DNA, 23 bp, synthetic construct
  misc_feature 1..23: note = Synthetic Construct
  source 1..23: mol_type = other DNA
tctgggatttgagcatggaactt

SEQ ID NO: 870 - DNA, 24 bp, synthetic construct
  misc_feature 1..24: note = Synthetic Construct
  source 1..24: mol_type = other DNA
gaccgtctactaacagcaccaagt

SEQ ID NO: 871 - DNA, 23 bp, synthetic construct
  misc_feature 1..23: note = Synthetic Construct
  source 1..23: mol_type = other DNA
ggtgtaagactaggctccctcta

SEQ ID NO: 872 - DNA, 22 bp, synthetic construct
  misc_feature 1..22: note = Synthetic Construct
  source 1..22: mol_type = other DNA
ggggcgtagtgaatctccaatg

SEQ ID NO: 873 - DNA, 21 bp, synthetic construct
  misc_feature 1..21: note = Synthetic Construct
  source 1..21: mol_type = other DNA
accaccacactccccttctct

SEQ ID NO: 874 - DNA, 27 bp, synthetic construct
  misc_feature 1..27: note = Synthetic Construct
  source 1..27: mol_type = other DNA
gagaggtcaaagacaggagactgaatc

SEQ ID NO: 875 - DNA, 23 bp, synthetic construct
  misc_feature 1..23: note = Synthetic Construct
  source 1..23: mol_type = other DNA
ggcataggtgacatgccatcaga

SEQ ID NO: 876 - DNA, 24 bp, synthetic construct
  misc_feature 1..24: note = Synthetic Construct
  source 1..24: mol_type = other DNA
cagacaatggaactacgcctgcat

SEQ ID NO: 877 - DNA, 25 bp, synthetic construct
  misc_feature 1..25: note = Synthetic Construct
  source 1..25: mol_type = other DNA
cgcctgagcttagacttcacctaca

SEQ ID NO: 878 - DNA, 21 bp, synthetic construct
  misc_feature 1..21: note = Synthetic Construct
  source 1..21: mol_type = other DNA
tccccacctggagcccaaaat

SEQ ID NO: 879 - DNA, 22 bp, synthetic construct
  misc_feature 1..22: note = Synthetic Construct
  source 1..22: mol_type = other DNA
ctgtccagacttgtccccaaga

SEQ ID NO: 880 - DNA, 22 bp, synthetic construct
  misc_feature 1..22: note = Synthetic Construct
  source 1..22: mol_type = other DNA
aggagacagtgcaagcttttgt

SEQ ID NO: 881 - DNA, 23 bp, synthetic construct
  misc_feature 1..23: note = Synthetic Construct
  source 1..23: mol_type = other DNA
tggactcactgttctccaagtga

SEQ ID NO: 882 - DNA, 22 bp, synthetic construct
  misc_feature 1..22: note = Synthetic Construct
  source 1..22: mol_type = other DNA
gccctggtgaatgcacattttg

SEQ ID NO: 883 - DNA, 20 bp, synthetic construct
  misc_feature 1..20: note = Synthetic Construct
  source 1..20: mol_type = other DNA
tggcatcgaggatggcatga

SEQ ID NO: 884 - DNA, 24 bp, synthetic construct
  misc_feature 1..24: note = Synthetic Construct
  source 1..24: mol_type = other DNA
tcctgtttgttatgggaaccaagt

SEQ ID NO: 885 - DNA, 22 bp, synthetic construct
  misc_feature 1..22: note = Synthetic Construct
  source 1..22: mol_type = other DNA
gcatccagcccaaatcctcact

SEQ ID NO: 886 - DNA, 21 bp, synthetic construct
  misc_feature 1..21: note = Synthetic Construct
  source 1..21: mol_type = other DNA
tcctccctgagaccacagctt

SEQ ID NO: 887 - DNA, 24 bp, synthetic construct
  misc_feature 1..24: note = Synthetic Construct
  source 1..24: mol_type = other DNA
ccatcacccatttacccctacttg

SEQ ID NO: 888 - DNA, 20 bp, synthetic construct
  misc_feature 1..20: note = Synthetic Construct
  source 1..20: mol_type = other DNA
actggctgtcaggcttgctt

SEQ ID NO: 889 - DNA, 25 bp, synthetic construct
  misc_feature 1..25: note = Synthetic Construct
  source 1..25: mol_type = other DNA
gcacgagatgaactaagacaccatt

SEQ ID NO: 890 - DNA, 25 bp, synthetic construct
  misc_feature 1..25: note = Synthetic Construct
  source 1..25: mol_type = other DNA
gagggaatggtacctggattagcaa

SEQ ID NO: 891 - DNA, 24 bp, synthetic construct
  misc_feature 1..24: note = Synthetic Construct
  source 1..24: mol_type = other DNA
tgccacttcacccatactgaattt

SEQ ID NO: 892 - DNA, 22 bp, synthetic construct
  misc_feature 1..22: note = Synthetic Construct
  source 1..22: mol_type = other DNA
cacactgccacctgcttgagta

SEQ ID NO: 893 - DNA, 22 bp, synthetic construct
  misc_feature 1..22: note = Synthetic Construct
  source 1..22: mol_type = other DNA
tgatgagtggaagcccatgttg

SEQ ID NO: 894 - DNA, 23 bp, synthetic construct
  misc_feature 1..23: note = Synthetic Construct
  source 1..23: mol_type = other DNA
tgctcatcatggctatgctttct

SEQ ID NO: 895 - DNA, 22 bp, synthetic construct
  misc_feature 1..22: note = Synthetic Construct
  source 1..22: mol_type = other DNA
gctgatccagagatggacacaa

SEQ ID NO: 896 - DNA, 21 bp, synthetic construct
  misc_feature 1..21: note = Synthetic Construct
  source 1..21: mol_type = other DNA
gcagtgctgtctatgccaatg

SEQ ID NO: 897 - DNA, 24 bp, synthetic construct
  misc_feature 1..24: note = Synthetic Construct
  source 1..24: mol_type = other DNA
gccagatgtggagttaacaagtca

SEQ ID NO: 898 - DNA, 25 bp, synthetic construct
  misc_feature 1..25: note = Synthetic Construct
  source 1..25: mol_type = other DNA
tgacttaacaggtgacctagacaca

SEQ ID NO: 899 - DNA, 19 bp, synthetic construct
  misc_feature 1..19: note = Synthetic Construct
  source 1..19: mol_type = other DNA
ccttggaggccagcaacaa

SEQ ID NO: 900 - DNA, 26 bp, synthetic construct
  misc_feature 1..26: note = Synthetic Construct
  source 1..26: mol_type = other DNA
gaggcactgattcattcaacaggatt

SEQ ID NO: 901 - DNA, 24 bp, synthetic construct
  misc_feature 1..24: note = Synthetic Construct
  source 1..24: mol_type = other DNA
cccatgggtaaactgctgtaagta

SEQ ID NO: 902 - DNA, 22 bp, synthetic construct
  misc_feature 1..22: note = Synthetic Construct
  source 1..22: mol_type = other DNA
caggcctcaaaacacgaagaag

SEQ ID NO: 903 - DNA, 23 bp, synthetic construct
  misc_feature 1..23: note = Synthetic Construct
  source 1..23: mol_type = other DNA
ggggagaagtgtcaccagattca

SEQ ID NO: 904 - DNA, 24 bp, synthetic construct
  misc_feature 1..24: note = Synthetic Construct
  source 1..24: mol_type = other DNA
gcgggttaggaagattccctgaag

SEQ ID NO: 905 - DNA, 24 bp, synthetic construct
  misc_feature 1..24: note = Synthetic Construct
  source 1..24: mol_type = other DNA
cttcctcacccgtccttaataaca

SEQ ID NO: 906 - DNA, 23 bp, synthetic construct
  misc_feature 1..23: note = Synthetic Construct
  source 1..23: mol_type = other DNA
ggtgctttcctttccaccgaagt

SEQ ID NO: 907 - DNA, 23 bp, synthetic construct
  misc_feature 1..23: note = Synthetic Construct
  source 1..23: mol_type = other DNA
gggaggaacagtgatctgagcat

SEQ ID NO: 908 - DNA, 27 bp, synthetic construct
  misc_feature 1..27: note = Synthetic Construct
  source 1..27: mol_type = other DNA
gagaattaaacagggctttgagggatt

SEQ ID NO: 909 - DNA, 22 bp, synthetic construct
  misc_feature 1..22: note = Synthetic Construct
  source 1..22: mol_type = other DNA
caccgagcactcgggtgaataa

SEQ ID NO: 910 - DNA, 24 bp, synthetic construct
  misc_feature 1..24: note = Synthetic Construct
  source 1..24: mol_type = other DNA
ttgatggctcccatgtaagtttga

SEQ ID NO: 911 - DNA, 23 bp, synthetic construct
  misc_feature 1..23: note = Synthetic Construct
  source 1..23: mol_type = other DNA
cgaagaagcaagaccgcagtaac

SEQ ID NO: 912 - DNA, 23 bp, synthetic construct
  misc_feature 1..23: note = Synthetic Construct
  source 1..23: mol_type = other DNA
ctctggggaatgcctaacaatga

SEQ ID NO: 913 - DNA, 22 bp, synthetic construct
  misc_feature 1..22: note = Synthetic Construct
  source 1..22: mol_type = other DNA
cagcaatgaggccagcgtagtt

SEQ ID NO: 914 - DNA, 28 bp, synthetic construct
  misc_feature 1..28: note = Synthetic Construct
  source 1..28: mol_type = other DNA
ccctatccagaaagaaaaagccaagtga

SEQ ID NO: 915 - DNA, 23 bp, synthetic construct
  misc_feature 1..23: note = Synthetic Construct
  source 1..23: mol_type = other DNA
ccttcctgcaagtcaaggactca

SEQ ID NO: 916 - DNA, 22 bp, synthetic construct
  misc_feature 1..22: note = Synthetic Construct
  source 1..22: mol_type = other DNA
gccgtaggtagttccatgctaa

SEQ ID NO: 917 - DNA, 22 bp, synthetic construct
  misc_feature 1..22: note = Synthetic Construct
  source 1..22: mol_type = other DNA
catcctcttgccgtgtgtgact

SEQ ID NO: 918 - DNA, 22 bp, synthetic construct
  misc_feature 1..22: note = Synthetic Construct
  source 1..22: mol_type = other DNA
caagtagcgttcatcccaggaa

SEQ ID NO: 919 - DNA, 22 bp, synthetic construct
  misc_feature 1..22: note = Synthetic Construct
  source 1..22: mol_type = other DNA
gcccctgaaattggaagcaaat

SEQ ID NO: 920 - DNA, 21 bp, synthetic construct
  misc_feature 1..21: note = Synthetic Construct
  source 1..21: mol_type = other DNA
gccacaggtcgccttctgaac

SEQ ID NO: 921 - DNA, 26 bp, synthetic construct
  misc_feature 1..26: note = Synthetic Construct
  source 1..26: mol_type = other DNA
ggcaacactctgtacaactccttact

SEQ ID NO: 922 - DNA, 23 bp, synthetic construct
  misc_feature 1..23: note = Synthetic Construct
  source 1..23: mol_type = other DNA
aggcccttcaagaagttgaaaca

SEQ ID NO: 923 - DNA, 23 bp, synthetic construct
  misc_feature 1..23: note = Synthetic Construct
  source 1..23: mol_type = other DNA
cccgtgtagccaagagactgaag

SEQ ID NO: 924 - DNA, 21 bp, synthetic construct
  misc_feature 1..21: note = Synthetic Construct
  source 1..21: mol_type = other DNA
tgtgtggtacaggcccgatct

SEQ ID NO: 925 - DNA, 22 bp, synthetic construct
  misc_feature 1..22: note = Synthetic Construct
  source 1..22: mol_type = other DNA
gctctcaaggactttgcagtct

SEQ ID NO: 926 - DNA, 22 bp, synthetic construct
  misc_feature 1..22: note = Synthetic Construct
  source 1..22: mol_type = other DNA
gagggaggtgctttgctgtcaa

SEQ ID NO: 927 - DNA, 23 bp, synthetic construct
  misc_feature 1..23: note = Synthetic Construct
  source 1..23: mol_type = other DNA
ggctctgtgaggatggagagagt

SEQ ID NO: 928 - DNA, 22 bp, synthetic construct
  misc_feature 1..22: note = Synthetic Construct
  source 1..22: mol_type = other DNA
gccaggggaagtggtgtttaag

SEQ ID NO: 929 - DNA, 24 bp, synthetic construct
  misc_feature 1..24: note = Synthetic Construct
  source 1..24: mol_type = other DNA
gtagactccacaccttcctacctt

SEQ ID NO: 930 - DNA, 25 bp, synthetic construct
  misc_feature 1..25: note = Synthetic Construct
  source 1..25: mol_type = other DNA
tctcctggaaatgtgaacaggattg

SEQ ID NO: 931 - DNA, 20 bp, synthetic construct
  misc_feature 1..20: note = Synthetic Construct
  source 1..20: mol_type = other DNA
ctcgctgcatctgagtgagt

SEQ ID NO: 932 - DNA, 21 bp, synthetic construct
  misc_feature 1..21: note = Synthetic Construct
  source 1..21: mol_type = other DNA
tcggatgcttcctgggcaaag

SEQ ID NO: 933 - DNA, 19 bp, synthetic construct
  misc_feature 1..19: note = Synthetic Construct
  source 1..19: mol_type = other DNA
caaccgctcaggctgtgaa

SEQ ID NO: 934 - DNA, 24 bp, synthetic construct
  misc_feature 1..24: note = Synthetic Construct
  source 1..24: mol_type = other DNA
gatgataagcctgtccctgagatg

SEQ ID NO: 935 - DNA, 24 bp, synthetic construct
  misc_feature 1..24: note = Synthetic Construct
  source 1..24: mol_type = other DNA
caggagggagaaagctttggaaga

SEQ ID NO: 936 - DNA, 27 bp, synthetic construct
  misc_feature 1..27: note = Synthetic Construct
  source 1..27: mol_type = other DNA
catccgtctcttcactagctgttaaat

SEQ ID NO: 937 - DNA, 21 bp, synthetic construct
  misc_feature 1..21: note = Synthetic Construct
  source 1..21: mol_type = other DNA
gtccctctgcttcctgccata

SEQ ID NO: 938 - DNA, 22 bp, synthetic construct
  misc_feature 1..22: note = Synthetic Construct
  source 1..22: mol_type = other DNA
gctgtactcctgggtgacattc

SEQ ID NO: 939 - DNA, 22 bp, synthetic construct
  misc_feature 1..22: note = Synthetic Construct
  source 1..22: mol_type = other DNA
agccctctgattccaggtaaga

SEQ ID NO: 940 - DNA, 22 bp, synthetic construct
  misc_feature 1..22: note = Synthetic Construct
  source 1..22: mol_type = other DNA
tcgatggcagagacaaatgaca

SEQ ID NO: 941 - DNA, 22 bp, synthetic construct
  misc_feature 1..22: note = Synthetic Construct
  source 1..22: mol_type = other DNA
cagggtcacacactcgggtatt

SEQ ID NO: 942 - DNA, 22 bp, synthetic construct
  misc_feature 1..22: note = Synthetic Construct
  source 1..22: mol_type = other DNA
ctccagcagacagcatgcaaac

SEQ ID NO: 943 - DNA, 24 bp, synthetic construct
  misc_feature 1..24: note = Synthetic Construct
  source 1..24: mol_type = other DNA
gcacacctgaaggtcaaacgaaca

SEQ ID NO: 944 - DNA, 24 bp, synthetic construct
  misc_feature 1..24: note = Synthetic Construct
  source 1..24: mol_type = other DNA
gttgatggtcgcattccagatgta

SEQ ID NO: 945 - DNA, 20 bp, synthetic construct
  misc_feature 1..20: note = Synthetic Construct
  source 1..20: mol_type = other DNA
tgtggcctggctcagacata

SEQ ID NO: 946 - DNA, 20 bp, synthetic construct
  misc_feature 1..20: note = Synthetic Construct
  source 1..20: mol_type = other DNA
ttgcggccactgtcactact

SEQ ID NO: 947 - DNA, 25 bp, synthetic construct
  misc_feature 1..25: note = Synthetic Construct
  source 1..25: mol_type = other DNA
caaatcctttgtgggtgttaagtgt

SEQ ID NO: 948 - DNA, 21 bp, synthetic construct
  misc_feature 1..21: note = Synthetic Construct
  source 1..21: mol_type = other DNA
tgccctgatggataggtggat

SEQ ID NO: 949 - DNA, 22 bp, synthetic construct
  misc_feature 1..22: note = Synthetic Construct
  source 1..22: mol_type = other DNA
agagctccaggctcatccctat

SEQ ID NO: 950 - DNA, 24 bp, synthetic construct
  misc_feature 1..24: note = Synthetic Construct
  source 1..24: mol_type = other DNA
cagagtcccttggatctgttctca

SEQ ID NO: 951 - DNA, 19 bp, synthetic construct
  misc_feature 1..19: note = Synthetic Construct
  source 1..19: mol_type = other DNA
ctggggcaggaccaggaaa

SEQ ID NO: 952 - DNA, 22 bp, synthetic construct
  misc_feature 1..22: note = Synthetic Construct
  source 1..22: mol_type = other DNA
cagtggagcttgctggttgact

SEQ ID NO: 953 - DNA, 26 bp, synthetic construct
  misc_feature 1..26: note = Synthetic Construct
  source 1..26: mol_type = other DNA
gggtaccttctctcaaagcagcatct

SEQ ID NO: 954 - DNA, 20 bp, synthetic construct
  misc_feature 1..20: note = Synthetic Construct
  source 1..20: mol_type = other DNA
catccagcaccatggcatct

SEQ ID NO: 955 - DNA, 19 bp, synthetic construct
  misc_feature 1..19: note = Synthetic Construct
  source 1..19: mol_type = other DNA
tggcagagactggcaggaa

SEQ ID NO: 956 - DNA, 23 bp, synthetic construct
  misc_feature 1..23: note = Synthetic Construct
  source 1..23: mol_type = other DNA
ttcctgaagggttgtaccagttg

SEQ ID NO: 957 - DNA, 21 bp, synthetic construct
  misc_feature 1..21: note = Synthetic Construct
  source 1..21: mol_type = other DNA
agggccctgctgaacactgaa

SEQ ID NO: 958 - DNA, 21 bp, synthetic construct
  misc_feature 1..21: note = Synthetic Construct
  source 1..21: mol_type = other DNA
catctccagacggtggtgttc

SEQ ID NO: 959 - DNA, 22 bp, synthetic construct
  misc_feature 1..22: note = Synthetic Construct
  source 1..22: mol_type = other DNA
cttggcttgggactgtctctct

SEQ ID NO: 960 - DNA, 19 bp, synthetic construct
  misc_feature 1..19: note = Synthetic Construct
  source 1..19: mol_type = other DNA
actggcacagcccaggatt

SEQ ID NO: 961 - DNA, 23 bp, synthetic construct
  misc_feature 1..23: note = Synthetic Construct
  source 1..23: mol_type = other DNA
caggacttctggaaacccactgt

SEQ ID NO: 962 - DNA, 22 bp, synthetic construct
  misc_feature 1..22: note = Synthetic Construct
  source 1..22: mol_type = other DNA
catccctgcgcctaactctaag

SEQ ID NO: 963 - DNA, 19 bp, synthetic construct
  misc_feature 1..19: note = Synthetic Construct
  source 1..19: mol_type = other DNA
tgcacatggcggctaaaca

SEQ ID NO: 964 - DNA, 24 bp, synthetic construct
  misc_feature 1..24: note = Synthetic Construct
  source 1..24: mol_type = other DNA
ggagttcgcatggtacctccctta

SEQ ID NO: 965 - DNA, 20 bp, synthetic construct
  misc_feature 1..20: note = Synthetic Construct
  source 1..20: mol_type = other DNA
agccatgccgattgcctctt

SEQ ID NO: 966 - DNA, 22 bp, synthetic construct
  misc_feature 1..22: note = Synthetic Construct
  source 1..22: mol_type = other DNA
ttggtcttcaggtccggaggtt

SEQ ID NO: 967 - DNA, 22 bp, synthetic construct
  misc_feature 1..22: note = Synthetic Construct
  source 1..22: mol_type = other DNA
ggcttttgttggaagcacagaa

SEQ ID NO: 968 - DNA, 19 bp, synthetic construct
  misc_feature 1..19: note = Synthetic Construct
  source 1..19: mol_type = other DNA
ttgagtcgtggggctctct

SEQ ID NO: 969 - DNA, 20 bp, synthetic construct
  misc_feature 1..20: note = Synthetic Construct
  source 1..20: mol_type = other DNA
tgtggatggccaggatgtgt

SEQ ID NO: 970 - DNA, 22 bp, synthetic construct
  misc_feature 1..22: note = Synthetic Construct
  source 1..22: mol_type = other DNA
ccatgacagacacccagcatct

SEQ ID NO: 971 - DNA, 24 bp, synthetic construct
  misc_feature 1..24: note = Synthetic Construct
  source 1..24: mol_type = other DNA
cctgcctcaaacagaggaactcta

SEQ ID NO: 972 - DNA, 23 bp, synthetic construct
  misc_feature 1..23: note = Synthetic Construct
  source 1..23: mol_type = other DNA
cactgagcaatcatggcatttgt

SEQ ID NO: 973 - DNA, 22 bp, synthetic construct
  misc_feature 1..22: note = Synthetic Construct
  source 1..22: mol_type = other DNA
tccatccctgtcccagctccta

SEQ ID NO: 974 - DNA, 22 bp, synthetic construct
  misc_feature 1..22: note = Synthetic Construct
  source 1..22: mol_type = other DNA
ggaacagcagcctaagtcatgt

SEQ ID NO: 975 - DNA, 22 bp, synthetic construct
  misc_feature 1..22: note = Synthetic Construct
  source 1..22: mol_type = other DNA
gtaagaaggaggcgtcggaatc

SEQ ID NO: 976 - DNA, 20 bp, synthetic construct
  misc_feature 1..20: note = Synthetic Construct
  source 1..20: mol_type = other DNA
tgctgggtcttgcccaacat

SEQ ID NO: 977 - DNA, 21 bp, synthetic construct
  misc_feature 1..21: note = Synthetic Construct
  source 1..21: mol_type = other DNA
gcctggagatcaagctgcaaa

SEQ ID NO: 978 - DNA, 25 bp, synthetic construct
  misc_feature 1..25: note = Synthetic Construct
  source 1..25: mol_type = other DNA
caccagggtaggtatccaatactgt

SEQ ID NO: 979 - DNA, 22 bp, synthetic construct
  misc_feature 1..22: note = Synthetic Construct
  source 1..22: mol_type = other DNA
gcaactgaatgcacgtgtgtga

SEQ ID NO: 980 - DNA, 23 bp, synthetic construct
  misc_feature 1..23: note = Synthetic Construct
  source 1..23: mol_type = other DNA
ggaccttagagcaatgaccttca

SEQ ID NO: 981 - DNA, 26 bp, synthetic construct
  misc_feature 1..26: note = Synthetic Construct
  source 1..26: mol_type = other DNA
ggagtaggtggaaacaaactgcttct

SEQ ID NO: 982 - DNA, 22 bp, synthetic construct
  misc_feature 1..22: note = Synthetic Construct
  source 1..22: mol_type = other DNA
gaagcagtcagcagtgctcaga

SEQ ID NO: 983 - DNA, 22 bp, synthetic construct
  misc_feature 1..22: note = Synthetic Construct
  source 1..22: mol_type = other DNA
gcagtctctcctcctccagcaa

SEQ ID NO: 984 - DNA, 25 bp, synthetic construct
  misc_feature 1..25: note = Synthetic Construct
  source 1..25: mol_type = other DNA
gagctctacccaactcttggtccta

SEQ ID NO: 985 - DNA, 24 bp, synthetic construct
  misc_feature 1..24: note = Synthetic Construct
  source 1..24: mol_type = other DNA
ccctgaagagctgaatcacagaca

SEQ ID NO: 986 - DNA, 25 bp, synthetic construct
  misc_feature 1..25: note = Synthetic Construct
  source 1..25: mol_type = other DNA
aggaaggtgtaggaactgcaaatac

SEQ ID NO: 987 - DNA, 22 bp, synthetic construct
  misc_feature 1..22: note = Synthetic Construct
  source 1..22: mol_type = other DNA
cctcaacatacgggctaccaaa

SEQ ID NO: 988 - DNA, 21 bp, synthetic construct
  misc_feature 1..21: note = Synthetic Construct
  source 1..21: mol_type = other DNA
ggcaaggagttctgggagctt

SEQ ID NO: 989 - DNA, 21 bp, synthetic construct
  misc_feature 1..21: note = Synthetic Construct
  source 1..21: mol_type = other DNA
ggtggagggtttggtgctatg

SEQ ID NO: 990 - DNA, 25 bp, synthetic construct
  misc_feature 1..25: note = Synthetic Construct
  source 1..25: mol_type = other DNA
caaagcaaagaacctctacccatga

SEQ ID NO: 991 - DNA, 20 bp, synthetic construct
  misc_feature 1..20: note = Synthetic Construct
  source 1..20: mol_type = other DNA
gccaaacagctctgcactga

SEQ ID NO: 992 - DNA, 23 bp, synthetic construct
  misc_feature 1..23: note = Synthetic Construct
  source 1..23: mol_type = other DNA
gcagccaagaatgcacctgaaag

SEQ ID NO: 993 - DNA, 20 bp, synthetic construct
  misc_feature 1..20: note = Synthetic Construct
  source 1..20: mol_type = other DNA
gggaaggagctctcgaccta

SEQ ID NO: 994 - DNA, 22 bp, synthetic construct
  misc_feature 1..22: note = Synthetic Construct
  source 1..22: mol_type = other DNA
ctcccaagtcacctgcgtttgt

SEQ ID NO: 995 - DNA, 20 bp, synthetic construct
  misc_feature 1..20: note = Synthetic Construct
  source 1..20: mol_type = other DNA
gccgtacaactgacgccaaa

SEQ ID NO: 996 - DNA, 21 bp, synthetic construct
  misc_feature 1..21: note = Synthetic Construct
  source 1..21: mol_type = other DNA
gctcctcctccagctcaattt

SEQ ID NO: 997 - DNA, 20 bp, synthetic construct
  misc_feature 1..20: note = Synthetic Construct
  source 1..20: mol_type = other DNA
ctcgggtgcttggattgtgt

SEQ ID NO: 998 - DNA, 22 bp, synthetic construct
  misc_feature 1..22: note = Synthetic Construct
  source 1..22: mol_type = other DNA
tggttcctccgctccattctct

SEQ ID NO: 999 - DNA, 22 bp, synthetic construct
  misc_feature 1..22: note = Synthetic Construct
  source 1..22: mol_type = other DNA
ctgtgtgtctggctgctgacat

SEQ ID NO: 1000 - DNA, 22 bp, synthetic construct
  misc_feature 1..22: note = Synthetic Construct
  source 1..22: mol_type = other DNA
gttagcgtgggtggctctgaat

SEQ ID NO: 1001 - DNA, 20 bp, synthetic construct
  misc_feature 1..20: note = Synthetic Construct
  source 1..20: mol_type = other DNA
gggcacttctgagtgcttga

SEQ ID NO: 1002 - DNA, 21 bp, synthetic construct
  misc_feature 1..21: note = Synthetic Construct
  source 1..21: mol_type = other DNA
ctctctgttcccacccaccta

SEQ ID NO: 1003 - DNA, 24 bp, synthetic construct
  misc_feature 1..24: note = Synthetic Construct
  source 1..24: mol_type = other DNA
gtctgaggagataaaccccacact

SEQ ID NO: 1004 - DNA, 27 bp, synthetic construct
  misc_feature 1..27: note = Synthetic Construct
  source 1..27: mol_type = other DNA
ggaatgcatgggcataaattctgtctt

SEQ ID NO: 1005 - DNA, 28 bp, synthetic construct
  misc_feature 1..28: note = Synthetic Construct
  source 1..28: mol_type = other DNA
gcaaggagcctattgttactaagagaga

SEQ ID NO: 1006 - DNA, 22 bp, synthetic construct
  misc_feature 1..22: note = Synthetic Construct
  source 1..22: mol_type = other DNA
gggttgtgtggcaaatggaagt

SEQ ID NO: 1007 - DNA, 28 bp, synthetic construct
  misc_feature 1..28: note = Synthetic Construct
  source 1..28: mol_type = other DNA
caggagcaggaggaggtagaattaatga

SEQ ID NO: 1008 - DNA, 24 bp, synthetic construct
  misc_feature 1..24: note = Synthetic Construct
  source 1..24: mol_type = other DNA
ggccccagtgatgttttaggttca

SEQ ID NO: 1009 - DNA, 25 bp, synthetic construct
  misc_feature 1..25: note = Synthetic Construct
  source 1..25: mol_type = other DNA
tgatttttccatcgtgatggtgttg

SEQ ID NO: 1010 - DNA, 22 bp, synthetic construct
  misc_feature 1..22: note = Synthetic Construct
  source 1..22: mol_type = other DNA
gggagagcagtcacttggaaga

SEQ ID NO: 1011 - DNA, 24 bp, synthetic construct
  misc_feature 1..24: note = Synthetic Construct
  source 1..24: mol_type = other DNA
cgtggctagggttgtactgtcgtt

SEQ ID NO: 1012 - DNA, 22 bp, synthetic construct
  misc_feature 1..22: note = Synthetic Construct
  source 1..22: mol_type = other DNA
ccatgcgtgcaggggagaatta

SEQ ID NO: 1013 - DNA, 24 bp, synthetic construct
  misc_feature 1..24: note = Synthetic Construct
  source 1..24: mol_type = other DNA
tgtgctcagtaagtgcttgttaga

SEQ ID NO: 1014 - DNA, 21 bp, synthetic construct
  misc_feature 1..21: note = Synthetic Construct
  source 1..21: mol_type = other DNA
tggtgaaggccctgactcgat

SEQ ID NO: 1015 - DNA, 23 bp, synthetic construct
  misc_feature 1..23: note = Synthetic Construct
  source 1..23: mol_type = other DNA
gggtccctctctaggccactttt

SEQ ID NO: 1016 - DNA, 27 bp, synthetic construct
  misc_feature 1..27: note = Synthetic Construct
  source 1..27: mol_type = other DNA
ggaccttagattcgggagaaaatcact

SEQ ID NO: 1017 - DNA, 22 bp, synthetic construct
  misc_feature 1..22: note = Synthetic Construct
  source 1..22: mol_type = other DNA
cctgaccatcctagctgcaagt

SEQ ID NO: 1018 - DNA, 21 bp, synthetic construct
  misc_feature 1..21: note = Synthetic Construct
  source 1..21: mol_type = other DNA
ggcaggcagggtgtggatttt

SEQ ID NO: 1019 - DNA, 21 bp, synthetic construct
  misc_feature 1..21: note = Synthetic Construct
  source 1..21: mol_type = other DNA
ctgtgccagtgacgaaagaca

SEQ ID NO: 1020 - DNA, 25 bp, synthetic construct
  misc_feature 1..25: note = Synthetic Construct
  source 1..25: mol_type = other DNA
gatgtgaaggtgcaatgaagttaca

SEQ ID NO: 1021 - DNA, 20 bp, synthetic construct
  misc_feature 1..20: note = Synthetic Construct
  source 1..20: mol_type = other DNA
ccccagtttggtgcttctca

SEQ ID NO: 1022 - DNA, 21 bp, synthetic construct
  misc_feature 1..21: note = Synthetic Construct
  source 1..21: mol_type = other DNA
ggacaggaagcagctctcaca

SEQ ID NO: 1023 - DNA, 23 bp, synthetic construct
  misc_feature 1..23: note = Synthetic Construct
  source 1..23: mol_type = other DNA
cggctcctgaactggaaggagat

SEQ ID NO: 1024 - DNA, 20 bp, synthetic construct
  misc_feature 1..20: note = Synthetic Construct
  source 1..20: mol_type = other DNA
actcacggccctgaagcaaa

SEQ ID NO: 1025 - DNA, 24 bp, synthetic construct
  misc_feature 1..24: note = Synthetic Construct
  source 1..24: mol_type = other DNA
caggagcaccaagactggtagatg

SEQ ID NO: 1026 - DNA, 22 bp, synthetic construct
  misc_feature 1..22: note = Synthetic Construct
  source 1..22: mol_type = other DNA
ccctccaagtgtcaccaagcaa

SEQ ID NO: 1027 - DNA, 24 bp, synthetic construct
  misc_feature 1..24: note = Synthetic Construct
  source 1..24: mol_type = other DNA
cagtgccatgtcagtttaccattg

SEQ ID NO: 1028 - DNA, 22 bp, synthetic construct
  misc_feature 1..22: note = Synthetic Construct
  source 1..22: mol_type = other DNA
aaggactggacccacccactga

SEQ ID NO: 1029 - DNA, 23 bp, synthetic construct
  misc_feature 1..23: note = Synthetic Construct
  source 1..23: mol_type = other DNA
cagagaaaagccccactcgttac

SEQ ID NO: 1030 - DNA, 22 bp, synthetic construct
  misc_feature 1..22: note = Synthetic Construct
  source 1..22: mol_type = other DNA
cacatctgcctgatgcctgcta

SEQ ID NO: 1031 - DNA, 19 bp, synthetic construct
  misc_feature 1..19: note = Synthetic Construct
  source 1..19: mol_type = other DNA
gggttatggtgggcagcaa

SEQ ID NO: 1032 - DNA, 24 bp, synthetic construct
  misc_feature 1..24: note = Synthetic Construct
  source 1..24: mol_type = other DNA
acagagaaaatgaccctccaggaa

SEQ ID NO: 1033 - DNA, 24 bp, synthetic construct
  misc_feature 1..24: note = Synthetic Construct
  source 1..24: mol_type = other DNA
ctggtgccctggttataggaagaa

SEQ ID NO: 1034 - DNA, 25 bp, synthetic construct
  misc_feature 1..25: note = Synthetic Construct
  source 1..25: mol_type = other DNA
cctttcagcctatggcattggattt

SEQ ID NO: 1035 - DNA, 22 bp, synthetic construct
  misc_feature 1..22: note = Synthetic Construct
  source 1..22: mol_type = other DNA
cagaggcagtttggaccctaca

SEQ ID NO: 1036 - DNA, 23 bp, synthetic construct
  misc_feature 1..23: note = Synthetic Construct
  source 1..23: mol_type = other DNA
agcaaaaatagcctctgggacaa

SEQ ID NO: 1037 - DNA, 22 bp, synthetic construct
  misc_feature 1..22: note = Synthetic Construct
  source 1..22: mol_type = other DNA
gcatttggagggctagggacaa

SEQ ID NO: 1038 - DNA, 23 bp, synthetic construct
  misc_feature 1..23: note = Synthetic Construct
  source 1..23: mol_type = other DNA
gcaagggcaggtagggagaaaat

SEQ ID NO: 1039 - DNA, 23 bp, synthetic construct
  misc_feature 1..23: note = Synthetic Construct
  source 1..23: mol_type = other DNA
cctcccagtggagtctgtgtttc

SEQ ID NO: 1040 - DNA, 19 bp, synthetic construct
  misc_feature 1..19: note = Synthetic Construct
  source 1..19: mol_type = other DNA
gctgtcagccccacagatg

SEQ ID NO: 1041 - DNA, 22 bp, synthetic construct
  misc_feature 1..22: note = Synthetic Construct
  source 1..22: mol_type = other DNA
gaggacgcatatggacccgaat

SEQ ID NO: 1042 - DNA, 26 bp, synthetic construct
  misc_feature 1..26: note = Synthetic Construct
  source 1..26: mol_type = other DNA
gtctagaagctgtatccccagagtca

SEQ ID NO: 1043 - DNA, 21 bp, synthetic construct
  misc_feature 1..21: note = Synthetic Construct
  source 1..21: mol_type = other DNA
cgcttccgtaagggagcatct

SEQ ID NO: 1044 - DNA, 22 bp, synthetic construct
  misc_feature 1..22: note = Synthetic Construct
  source 1..22: mol_type = other DNA
cacggtcacaatgtttgtgcat

SEQ ID NO: 1045 - DNA, 24 bp, synthetic construct
  misc_feature 1..24: note = Synthetic Construct
  source 1..24: mol_type = other DNA
gcccttggctacatttgaggttgt

SEQ ID NO: 1046 - DNA, 23 bp, synthetic construct
  misc_feature 1..23: note = Synthetic Construct
  source 1..23: mol_type = other DNA
ggattggggtgttcagagcaaga

SEQ ID NO: 1047 - DNA, 20 bp, synthetic construct
  misc_feature 1..20: note = Synthetic Construct
  source 1..20: mol_type = other DNA
aggagcgtgcgtgaatgtgt

SEQ ID NO: 1048 - DNA, 21 bp, synthetic construct
  misc_feature 1..21: note = Synthetic Construct
  source 1..21: mol_type = other DNA
ggcactgagggactggaactt

SEQ ID NO: 1049 - DNA, 22 bp, synthetic construct
  misc_feature 1..22: note = Synthetic Construct
  source 1..22: mol_type = other DNA
gagactttgaggcagactgtca

SEQ ID NO: 1050 - DNA, 26 bp, synthetic construct
  misc_feature 1..26: note = Synthetic Construct
  source 1..26: mol_type = other DNA
ctggaagtcaggaaagtacagttcta

SEQ ID NO: 1051 - DNA, 22 bp, synthetic construct
  misc_feature 1..22: note = Synthetic Construct
  source 1..22: mol_type = other DNA
ggttgtcctggttcgcagagtt

SEQ ID NO: 1052 - DNA, 23 bp, synthetic construct
  misc_feature 1..23: note = Synthetic Construct
  source 1..23: mol_type = other DNA
gcctgatgggagaatcagaaact

SEQ ID NO: 1053 - DNA, 23 bp, synthetic construct
  misc_feature 1..23: note = Synthetic Construct
  source 1..23: mol_type = other DNA
ggcaaatcaaagcctgccttttc

SEQ ID NO: 1054 - DNA, 22 bp, synthetic construct
  misc_feature 1..22: note = Synthetic Construct
  source 1..22: mol_type = other DNA
agtgtgggccctacctgtgatt

SEQ ID NO: 1055 - DNA, 19 bp, synthetic construct
  misc_feature 1..19: note = Synthetic Construct
  source 1..19: mol_type = other DNA
ttttgccgctgcccctgat

SEQ ID NO: 1056 - DNA, 22 bp, synthetic construct
  misc_feature 1..22: note = Synthetic Construct
  source 1..22: mol_type = other DNA
ggactgtgttgggtgcaataac

SEQ ID NO: 1057 - DNA, 18 bp, synthetic construct
  misc_feature 1..18: note = Synthetic Construct
  source 1..18: mol_type = other DNA
acccgatgccccatgact

SEQ ID NO: 1058 - DNA, 22 bp, synthetic construct
  misc_feature 1..22: note = Synthetic Construct
  source 1..22: mol_type = other DNA
cccagtgaagccccacctttag

SEQ ID NO: 1059 - DNA, 22 bp, synthetic construct
  misc_feature 1..22: note = Synthetic Construct
  source 1..22: mol_type = other DNA
gtggcagacaaggacagtgagt

SEQ ID NO: 1060 - DNA, 23 bp, synthetic construct
  misc_feature 1..23: note = Synthetic Construct
  source 1..23: mol_type = other DNA
ccatggcaactccatgcttccaa

SEQ ID NO: 1061 - DNA, 24 bp, synthetic construct
  misc_feature 1..24: note = Synthetic Construct
  source 1..24: mol_type = other DNA
gcttcccaggatacccacccatta

SEQ ID NO: 1062 - DNA, 21 bp, synthetic construct
  misc_feature 1..21: note = Synthetic Construct
  source 1..21: mol_type = other DNA
gctgtctcggtcctcgttagt

SEQ ID NO: 1063 - DNA, 27 bp, synthetic construct
  misc_feature 1..27: note = Synthetic Construct
  source 1..27: mol_type = other DNA
gagccgattttatatccatgcctgtag

SEQ ID NO: 1064 - DNA, 22 bp, synthetic construct
  misc_feature 1..22: note = Synthetic Construct
  source 1..22: mol_type = other DNA
cccagaaacgagccatggaaag

SEQ ID NO: 1065 - DNA, 20 bp, synthetic construct
  misc_feature 1..20: note = Synthetic Construct
  source 1..20: mol_type = other DNA
aggtcgccagagtgctgtga

SEQ ID NO: 1066 - DNA, 25 bp, synthetic construct
  misc_feature 1..25: note = Synthetic Construct
  source 1..25: mol_type = other DNA
ccaaacccaattgcagctgtgtaac

SEQ ID NO: 1067 - DNA, 24 bp, synthetic construct
  misc_feature 1..24: note = Synthetic Construct
  source 1..24: mol_type = other DNA
gctgccttcttgagctcctgattt

SEQ ID NO: 1068 - DNA, 23 bp, synthetic construct
  misc_feature 1..23: note = Synthetic Construct
  source 1..23: mol_type = other DNA
cagcctagaggcagcaaaactgt

SEQ ID NO: 1069 - DNA, 24 bp, synthetic construct
  misc_feature 1..24: note = Synthetic Construct
  source 1..24: mol_type = other DNA
gcaagtgtcaggtccctctagtca

SEQ ID NO: 1070 - DNA, 20 bp, synthetic construct
  misc_feature 1..20: note = Synthetic Construct
  source 1..20: mol_type = other DNA
agccaactgagccaggaaca

SEQ ID NO: 1071 - DNA, 24 bp, synthetic construct
  misc_feature 1..24: note = Synthetic Construct
  source 1..24: mol_type = other DNA
cctgcatgcttgggttaattcttg

SEQ ID NO: 1072 - DNA, 20 bp, synthetic construct
  misc_feature 1..20: note = Synthetic Construct
  source 1..20: mol_type = other DNA
aaggggagctgtgtgtcctt

SEQ ID NO: 1073 - DNA, 22 bp, synthetic construct
  misc_feature 1..22: note = Synthetic Construct
  source 1..22: mol_type = other DNA
ccaatcctacgacgggaccaaa

SEQ ID NO: 1074 - DNA, 21 bp, synthetic construct
  misc_feature 1..21: note = Synthetic Construct
  source 1..21: mol_type = other DNA
tgctgattgcctgtgttgcta

SEQ ID NO: 1075 - DNA, 22 bp, synthetic construct
  misc_feature 1..22: note = Synthetic Construct
  source 1..22: mol_type = other DNA
gggacactgacctgcaccaaaa

SEQ ID NO: 1076 - DNA, 25 bp, synthetic construct
  misc_feature 1..25: note = Synthetic Construct
  source 1..25: mol_type = other DNA
ggacccttctaagccactgatctct

SEQ ID NO: 1077 - DNA, 22 bp, synthetic construct
  misc_feature 1..22: note = Synthetic Construct
  source 1..22: mol_type = other DNA
ctaaccccagctcaacctcttg

SEQ ID NO: 1078 - DNA, 22 bp, synthetic construct
  misc_feature 1..22: note = Synthetic Construct
  source 1..22: mol_type = other DNA
gtgacacaggctgcttctcatc

SEQ ID NO: 1079 - DNA, 21 bp, synthetic construct
  misc_feature 1..21: note = Synthetic Construct
  source 1..21: mol_type = other DNA
ttggtgtagggagcaggagat

SEQ ID NO: 1080 - DNA, 26 bp, synthetic construct
  misc_feature 1..26: note = Synthetic Construct
  source 1..26: mol_type = other DNA
cctcttacacccactgttccactaag

SEQ ID NO: 1081 - DNA, 23 bp, synthetic construct
  misc_feature 1..23: note = Synthetic Construct
  source 1..23: mol_type = other DNA
gaagcattctgggctgagagaga

SEQ ID NO: 1082 - DNA, 22 bp, synthetic construct
  misc_feature 1..22: note = Synthetic Construct
  source 1..22: mol_type = other DNA
ggaaacctggtccaaaccacaa

SEQ ID NO: 1083 - DNA, 21 bp, synthetic construct
  misc_feature 1..21: note = Synthetic Construct
  source 1..21: mol_type = other DNA
aggcacctgtttgcccgaatg

SEQ ID NO: 1084 - DNA, 23 bp, synthetic construct
  misc_feature 1..23: note = Synthetic Construct
  source 1..23: mol_type = other DNA
gctgtcagaaccagcctgagtat

SEQ ID NO: 1085 - DNA, 24 bp, synthetic construct
  misc_feature 1..24: note = Synthetic Construct
  source 1..24: mol_type = other DNA
gcggtaggatgttaaaggcagctt

SEQ ID NO: 1086 - DNA, 22 bp, synthetic construct
  misc_feature 1..22: note = Synthetic Construct
  source 1..22: mol_type = other DNA
ggttcaatctcaggctcacact

SEQ ID NO: 1087 - DNA, 21 bp, synthetic construct
  misc_feature 1..21: note = Synthetic Construct
  source 1..21: mol_type = other DNA
gcatggatctgcgtggagaca

SEQ ID NO: 1088 - DNA, 23 bp, synthetic construct
  misc_feature 1..23: note = Synthetic Construct
  source 1..23: mol_type = other DNA
cagaactgggtggtgtcgttttg

SEQ ID NO: 1089 - DNA, 21 bp, synthetic construct
  misc_feature 1..21: note = Synthetic Construct
  source 1..21: mol_type = other DNA
cagaccacttgagagcaggtt

SEQ ID NO: 1090 - DNA, 22 bp, synthetic construct
  misc_feature 1..22: note = Synthetic Construct
  source 1..22: mol_type = other DNA
gctaccaagggaggtctcttct

SEQ ID NO: 1091 - DNA, 22 bp, synthetic construct
  misc_feature 1..22: note = Synthetic Construct
  source 1..22: mol_type = other DNA
gaggtgggtaacagacccatca

SEQ ID NO: 1092 - DNA, 23 bp, synthetic construct
  misc_feature 1..23: note = Synthetic Construct
  source 1..23: mol_type = other DNA
ggaagcaagcacatactcaccat

SEQ ID NO: 1093 - DNA, 20 bp, synthetic construct
  misc_feature 1..20: note = Synthetic Construct
  source 1..20: mol_type = other DNA
actgcgtaagcggtggcata

SEQ ID NO: 1094 - DNA, 25 bp, synthetic construct
  misc_feature 1..25: note = Synthetic Construct
  source 1..25: mol_type = other DNA
ggtatcagcagtgtgggttaaggat

SEQ ID NO: 1095 - DNA, 24 bp, synthetic construct
  misc_feature 1..24: note = Synthetic Construct
  source 1..24: mol_type = other DNA
ctcggaagtcccagcagatctttc

SEQ ID NO: 1096 - DNA, 23 bp, synthetic construct
  misc_feature 1..23: note = Synthetic Construct
  source 1..23: mol_type = other DNA
ggtgaggttcacaccctcctttc

SEQ ID NO: 1097 - DNA, 20 bp, synthetic construct
  misc_feature 1..20: note = Synthetic Construct
  source 1..20: mol_type = other DNA
ctgcagtcatggctgtggaa

SEQ ID NO: 1098 - DNA, 23 bp, synthetic construct
  misc_feature 1..23: note = Synthetic Construct
  source 1..23: mol_type = other DNA
cccctgcctgtggaccttatatt

SEQ ID NO: 1099 - DNA, 20 bp, synthetic construct
  misc_feature 1..20: note = Synthetic Construct
  source 1..20: mol_type = other DNA
gggcattgccacaatggttt

SEQ ID NO: 1100 - DNA, 20 bp, synthetic construct
  misc_feature 1..20: note = Synthetic Construct
  source 1..20: mol_type = other DNA
gtggcaacaggacagggatt

SEQ ID NO: 1101 - DNA, 22 bp, synthetic construct
  misc_feature 1..22: note = Synthetic Construct
  source 1..22: mol_type = other DNA
tctaggaccaggagccatcaga

SEQ ID NO: 1102 - DNA, 23 bp, synthetic construct
  misc_feature 1..23: note = Synthetic Construct
  source 1..23: mol_type = other DNA
cgaggggtctttgaggcaaactt

SEQ ID NO: 1103 - DNA, 26 bp, synthetic construct
  misc_feature 1..26: note = Synthetic Construct
  source 1..26: mol_type = other DNA
tccccacctctctttctttagagtat

SEQ ID NO: 1104 - DNA, 21 bp, synthetic construct
  misc_feature 1..21: note = Synthetic Construct
  source 1..21: mol_type = other DNA
ccaggaaagccaccaatgcaa

SEQ ID NO: 1105 - DNA, 26 bp, synthetic construct
  misc_feature 1..26: note = Synthetic Construct
  source 1..26: mol_type = other DNA
gggctgatataatggaggcagcttag

SEQ ID NO: 1106 - DNA, 22 bp, synthetic construct
  misc_feature 1..22: note = Synthetic Construct
  source 1..22: mol_type = other DNA
gccctgtcctgactgacattct

SEQ ID NO: 1107 - DNA, 26 bp, synthetic construct
  misc_feature 1..26: note = Synthetic Construct
  source 1..26: mol_type = other DNA
tctttggccacacagatttactctac

SEQ ID NO: 1108 - DNA, 22 bp, synthetic construct
  misc_feature 1..22: note = Synthetic Construct
  source 1..22: mol_type = other DNA
cagagtaggtgtgccgtaggaa

SEQ ID NO: 1109 - DNA, 23 bp, synthetic construct
  misc_feature 1..23: note = Synthetic Construct
  source 1..23: mol_type = other DNA
cgctgtctctccatccaagtgtt

SEQ ID NO: 1110 - DNA, 24 bp, synthetic construct
  misc_feature 1..24: note = Synthetic Construct
  source 1..24: mol_type = other DNA
cggagccttggagctaggtgatta

SEQ ID NO: 1111 - DNA, 25 bp, synthetic construct
  misc_feature 1..25: note = Synthetic Construct
  source 1..25: mol_type = other DNA
cagggttcctagctctttcctgttc

SEQ ID NO: 1112 - DNA, 24 bp, synthetic construct
  misc_feature 1..24: note = Synthetic Construct
  source 1..24: mol_type = other DNA
cattcccaaatggatgtggctaga

SEQ ID NO: 1113 - DNA, 21 bp, synthetic construct
  misc_feature 1..21: note = Synthetic Construct
  source 1..21: mol_type = other DNA
gctccactttcgccctcactt

SEQ ID NO: 1114 - DNA, 24 bp, synthetic construct
  misc_feature 1..24: note = Synthetic Construct
  source 1..24: mol_type = other DNA
ctttgctcttgtctgcactgagta

SEQ ID NO: 1115 - DNA, 19 bp, synthetic construct
  misc_feature 1..19: note = Synthetic Construct
  source 1..19: mol_type = other DNA
ttgagctgtgcaggcttgt

SEQ ID NO: 1116 - DNA, 23 bp, synthetic construct
  misc_feature 1..23: note = Synthetic Construct
  source 1..23: mol_type = other DNA
tgtggctactttcccacagtttg

SEQ ID NO: 1117 - DNA, 24 bp, synthetic construct
  misc_feature 1..24: note = Synthetic Construct
  source 1..24: mol_type = other DNA
caaaggacaatcacagagctgttc

SEQ ID NO: 1118 - DNA, 25 bp, synthetic construct
  misc_feature 1..25: note = Synthetic Construct
  source 1..25: mol_type = other DNA
ggaatggaccaagtttgtcttgatt

SEQ ID NO: 1119 - DNA, 20 bp, synthetic construct
  misc_feature 1..20: note = Synthetic Construct
  source 1..20: mol_type = other DNA
tggatgtggcccgcatttgt

SEQ ID NO: 1120 - DNA, 23 bp, synthetic construct
  misc_feature 1..23: note = Synthetic Construct
  source 1..23: mol_type = other DNA
cccctgccccaaatagcatttta

SEQ ID NO: 1121 - DNA, 22 bp, synthetic construct
  misc_feature 1..22: note = Synthetic Construct
  source 1..22: mol_type = other DNA
accaagcactggggaaactaaa

SEQ ID NO: 1122 - DNA, 19 bp, synthetic construct
  misc_feature 1..19: note = Synthetic Construct
  source 1..19: mol_type = other DNA
ggcatgctccgcaccaaga

SEQ ID NO: 1123 - DNA, 22 bp, synthetic construct
  misc_feature 1..22: note = Synthetic Construct
  source 1..22: mol_type = other DNA
caggccatgtaaacgactctca

SEQ ID NO: 1124 - DNA, 23 bp, synthetic construct
  misc_feature 1..23: note = Synthetic Construct
  source 1..23: mol_type = other DNA
tgctgaatggtttgctcagtttg

SEQ ID NO: 1125 - DNA, 24 bp, synthetic construct
  misc_feature 1..24: note = Synthetic Construct
  source 1..24: mol_type = other DNA
tcgagtcacttacctgctcaaatg

SEQ ID NO: 1126 - DNA, 20 bp, synthetic construct
  misc_feature 1..20: note = Synthetic Construct
  source 1..20: mol_type = other DNA
agcaagcgacggtcctccat

SEQ ID NO: 1127 - DNA, 22 bp, synthetic construct
  misc_feature 1..22: note = Synthetic Construct
  source 1..22: mol_type = other DNA
acctgcagaactgaggctctct

SEQ ID NO: 1128 - DNA, 21 bp, synthetic construct
  misc_feature 1..21: note = Synthetic Construct
  source 1..21: mol_type = other DNA
agtgtcaggaggggaaacgaa

SEQ ID NO: 1129 - DNA, 25 bp, synthetic construct
  misc_feature 1..25: note = Synthetic Construct
  source 1..25: mol_type = other DNA
ccactccttcccttatacccttgta

SEQ ID NO: 1130 - DNA, 21 bp, synthetic construct
  misc_feature 1..21: note = Synthetic Construct
  source 1..21: mol_type = other DNA
gcaaagattgctgcccgttca

SEQ ID NO: 1131 - DNA, 24 bp, synthetic construct
  misc_feature 1..24: note = Synthetic Construct
  source 1..24: mol_type = other DNA
tggacaagaatggagaaagacgtt

SEQ ID NO: 1132 - DNA, 22 bp, synthetic construct
  misc_feature 1..22: note = Synthetic Construct
  source 1..22: mol_type = other DNA
gcctttcccaggactcaacagt

SEQ ID NO: 1133 - DNA, 24 bp, synthetic construct
  misc_feature 1..24: note = Synthetic Construct
  source 1..24: mol_type = other DNA
ctgctttgaggcagataggagctt

SEQ ID NO: 1134 - DNA, 22 bp, synthetic construct
  misc_feature 1..22: note = Synthetic Construct
  source 1..22: mol_type = other DNA
cctgcacaaagtggctgtcaac

SEQ ID NO: 1135 - DNA, 25 bp, synthetic construct
  misc_feature 1..25: note = Synthetic Construct
  source 1..25: mol_type = other DNA
gcaggaaaccacaaaacatcaccta

SEQ ID NO: 1136 - DNA, 26 bp, synthetic construct
  misc_feature 1..26: note = Synthetic Construct
  source 1..26: mol_type = other DNA
gctttctctcccctaggacatacagt

SEQ ID NO: 1137 - DNA, 20 bp, synthetic construct
  misc_feature 1..20: note = Synthetic Construct
  source 1..20: mol_type = other DNA
agcctggctccctacacatt

SEQ ID NO: 1138 - DNA, 21 bp, synthetic construct
  misc_feature 1..21: note = Synthetic Construct
  source 1..21: mol_type = other DNA
tgctattggggcattggtgtt

SEQ ID NO: 1139 - DNA, 20 bp, synthetic construct
  misc_feature 1..20: note = Synthetic Construct
  source 1..20: mol_type = other DNA
tgcatcccgttgctgtcaag

SEQ ID NO: 1140 - DNA, 23 bp, synthetic construct
  misc_feature 1..23: note = Synthetic Construct
  source 1..23: mol_type = other DNA
gacctgtgtccctttgtccttag

SEQ ID NO: 1141 - DNA, 24 bp, synthetic construct
  misc_feature 1..24: note = Synthetic Construct
  source 1..24: mol_type = other DNA
cctttgcccttccagagtctcctt

SEQ ID NO: 1142 - DNA, 23 bp, synthetic construct
  misc_feature 1..23: note = Synthetic Construct
  source 1..23: mol_type = other DNA
gcctggtactctcccagttttag

SEQ ID NO: 1143 - DNA, 24 bp, synthetic construct
  misc_feature 1..24: note = Synthetic Construct
  source 1..24: mol_type = other DNA
gggaccagtcaactttgccagatt

SEQ ID NO: 1144 - DNA, 24 bp, synthetic construct
  misc_feature 1..24: note = Synthetic Construct
  source 1..24: mol_type = other DNA
attcccattcctaaaagccgtgta

SEQ ID NO: 1145 - DNA, 20 bp, synthetic construct
  misc_feature 1..20: note = Synthetic Construct
  source 1..20: mol_type = other DNA
tccaggcacgcacctctgat

SEQ ID NO: 1146 - DNA, 22 bp, synthetic construct
  misc_feature 1..22: note = Synthetic Construct
  source 1..22: mol_type = other DNA
ggcaggcatctgtgcagtcatt

SEQ ID NO: 1147 - DNA, 21 bp, synthetic construct
  misc_feature 1..21: note = Synthetic Construct
  source 1..21: mol_type = other DNA
tgccgacataaccccttcctt

SEQ ID NO: 1148 - DNA, 22 bp, synthetic construct
  misc_feature 1..22: note = Synthetic Construct
  source 1..22: mol_type = other DNA
cgccaatctcagtggttggaat

SEQ ID NO: 1149 - DNA, 25 bp, synthetic construct
  misc_feature 1..25: note = Synthetic Construct
  source 1..25: mol_type = other DNA
cggagcaacttggcatgttaataca

SEQ ID NO: 1150 - DNA, 22 bp, synthetic construct
  misc_feature 1..22: note = Synthetic Construct
  source 1..22: mol_type = other DNA
gtggcagcctttctgtagttga

SEQ ID NO: 1151 - DNA, 25 bp, synthetic construct
  misc_feature 1..25: note = Synthetic Construct
  source 1..25: mol_type = other DNA
gctcgttaagaattagccccacatc

SEQ ID NO: 1152 - DNA, 23 bp, synthetic construct
  misc_feature 1..23: note = Synthetic Construct
  source 1..23: mol_type = other DNA
caccagctagaacctcctgtagt

SEQ ID NO: 1153 - DNA, 18 bp, synthetic construct
  misc_feature 1..18: note = Synthetic Construct
  source 1..18: mol_type = other DNA
gctgctttgcgggacctt

SEQ ID NO: 1154 - DNA, 24 bp, synthetic construct
  misc_feature 1..24: note = Synthetic Construct
  source 1..24: mol_type = other DNA
ggcaggagtcagtgacaagtggta

SEQ ID NO: 1155 - DNA, 25 bp, synthetic construct
  misc_feature 1..25: note = Synthetic Construct
  source 1..25: mol_type = other DNA
tgtgtcaagcagatttgaagctaac

SEQ ID NO: 1156 - DNA, 22 bp, synthetic construct
  misc_feature 1..22: note = Synthetic Construct
  source 1..22: mol_type = other DNA
tgcacattccttccttggtgat

SEQ ID NO: 1157 - DNA, 19 bp, synthetic construct
  misc_feature 1..19: note = Synthetic Construct
  source 1..19: mol_type = other DNA
cctgcattgcaagccgttt

SEQ ID NO: 1158 - DNA, 21 bp, synthetic construct
  misc_feature 1..21: note = Synthetic Construct
  source 1..21: mol_type = other DNA
acctgcctgtgtggtatggaa

SEQ ID NO: 1159 - DNA, 25 bp, synthetic construct
  misc_feature 1..25: note = Synthetic Construct
  source 1..25: mol_type = other DNA
gagccgaatgttcacttatggagtt

SEQ ID NO: 1160 - DNA, 24 bp, synthetic construct
  misc_feature 1..24: note = Synthetic Construct
  source 1..24: mol_type = other DNA
ctgaagcctaatggggatccagaa

SEQ ID NO: 1161 - DNA, 24 bp, synthetic construct
  misc_feature 1..24: note = Synthetic Construct
  source 1..24: mol_type = other DNA
aaatagctgtcccattctggttgt

SEQ ID NO: 1162 - DNA, 21 bp, synthetic construct
  misc_feature 1..21: note = Synthetic Construct
  source 1..21: mol_type = other DNA
tccccggatttccacagtagt

SEQ ID NO: 1163 - DNA, 27 bp, synthetic construct
  misc_feature 1..27: note = Synthetic Construct
  source 1..27: mol_type = other DNA
gggtaggatgcatgagaagaactggat

SEQ ID NO: 1164 - DNA, 25 bp, synthetic construct
  misc_feature 1..25: note = Synthetic Construct
  source 1..25: mol_type = other DNA
gccagctgaggaactattagacact

SEQ ID NO: 1165 - DNA, 23 bp, synthetic construct
  misc_feature 1..23: note = Synthetic Construct
  source 1..23: mol_type = other DNA
ctgcagatctagccaatgaggtt

SEQ ID NO: 1166 - DNA, 25 bp, synthetic construct
  misc_feature 1..25: note = Synthetic Construct
  source 1..25: mol_type = other DNA
ggccaagattttggtgttcaagtag

SEQ ID NO: 1167 - DNA, 20 bp, synthetic construct
  misc_feature 1..20: note = Synthetic Construct
  source 1..20: mol_type = other DNA
acagctgcgaatggcctaat

SEQ ID NO: 1168 - DNA, 24 bp, synthetic construct
  misc_feature 1..24: note = Synthetic Construct
  source 1..24: mol_type = other DNA
gatctcatggctacggagatcaag

SEQ ID NO: 1169 - DNA, 25 bp, synthetic construct
  misc_feature 1..25: note = Synthetic Construct
  source 1..25: mol_type = other DNA
cctcctgggaaactggcaagtaaag

SEQ ID NO: 1170 - DNA, 24 bp, synthetic construct
  misc_feature 1..24: note = Synthetic Construct
  source 1..24: mol_type = other DNA
gtacatggttatggctaccaggaa

SEQ ID NO: 1171 - DNA, 20 bp, synthetic construct
  misc_feature 1..20: note = Synthetic Construct
  source 1..20: mol_type = other DNA
tggtcagtgctcccagagtt

SEQ ID NO: 1172 - DNA, 20 bp, synthetic construct
  misc_feature 1..20: note = Synthetic Construct
  source 1..20: mol_type = other DNA
cgcacatgtctcgtgtcact

SEQ ID NO: 1173 - DNA, 21 bp, synthetic construct
  misc_feature 1..21: note = Synthetic Construct
  source 1..21: mol_type = other DNA
accactgacaaacctgtgcat

SEQ ID NO: 1174 - DNA, 26 bp, synthetic construct
  misc_feature 1..26: note = Synthetic Construct
  source 1..26: mol_type = other DNA
cagggatgaataagcctcatgaaaga

SEQ ID NO: 1175 - DNA, 24 bp, synthetic construct
  misc_feature 1..24: note = Synthetic Construct
  source 1..24: mol_type = other DNA
actgcaacactgtgattgtcttca

SEQ ID NO: 1176 - DNA, 20 bp, synthetic construct
  misc_feature 1..20: note = Synthetic Construct
  source 1..20: mol_type = other DNA
ttggctccccagagtgttgt

SEQ ID NO: 1177 - DNA, 24 bp, synthetic construct
  misc_feature 1..24: note = Synthetic Construct
  source 1..24: mol_type = other DNA
cagtcgaaagagtggaaaggatga

SEQ ID NO: 1178 - DNA, 21 bp, synthetic construct
  misc_feature 1..21: note = Synthetic Construct
  source 1..21: mol_type = other DNA
tgaagcatctggcctgtctga

SEQ ID NO: 1179 - DNA, 20 bp, synthetic construct
  misc_feature 1..20: note = Synthetic Construct
  source 1..20: mol_type = other DNA
ttcggggtgcatcctcacat

SEQ ID NO: 1180 - DNA, 22 bp, synthetic construct
  misc_feature 1..22: note = Synthetic Construct
  source 1..22: mol_type = other DNA
catccacagctgtctccgtgta

SEQ ID NO: 1181 - DNA, 25 bp, synthetic construct
  misc_feature 1..25: note = Synthetic Construct
  source 1..25: mol_type = other DNA
ttccaggttgttttctgcaaagtag

SEQ ID NO: 1182 - DNA, 26 bp, synthetic construct
  misc_feature 1..26: note = Synthetic Construct
  source 1..26: mol_type = other DNA
tcccagagacacagctagttaaaaac

SEQ ID NO: 1183 - DNA, 21 bp, synthetic construct
  misc_feature 1..21: note = Synthetic Construct
  source 1..21: mol_type = other DNA
tgctgctcgtacagtggaaag

SEQ ID NO: 1184 - DNA, 25 bp, synthetic construct
  misc_feature 1..25: note = Synthetic Construct
  source 1..25: mol_type = other DNA
ggagcagtatcattttggtgcattg

SEQ ID NO: 1185 - DNA, 22 bp, synthetic construct
  misc_feature 1..22: note = Synthetic Construct
  source 1..22: mol_type = other DNA
cggtggtgcctttgttttaact

SEQ ID NO: 1186 - DNA, 25 bp, synthetic construct
  misc_feature 1..25: note = Synthetic Construct
  source 1..25: mol_type = other DNA
ggagaaggaatgtcaggaagcaaac

SEQ ID NO: 1187 - DNA, 21 bp, synthetic construct
  misc_feature 1..21: note = Synthetic Construct
  source 1..21: mol_type = other DNA
agtaggtgtgatggccaggat

SEQ ID NO: 1188 - DNA, 23 bp, synthetic construct
  misc_feature 1..23: note = Synthetic Construct
  source 1..23: mol_type = other DNA
tgtcttcctagcctcatctctca

SEQ ID NO: 1189 - DNA, 24 bp, synthetic construct
  misc_feature 1..24: note = Synthetic Construct
  source 1..24: mol_type = other DNA
gctaggggatactgagtcctgcat

SEQ ID NO: 1190 - DNA, 22 bp, synthetic construct
  misc_feature 1..22: note = Synthetic Construct
  source 1..22: mol_type = other DNA
cccaaagagtccccatctggtt

SEQ ID NO: 1191 - DNA, 20 bp, synthetic construct
  misc_feature 1..20: note = Synthetic Construct
  source 1..20: mol_type = other DNA
agacctaggcggcaaacaaa

SEQ ID NO: 1192 - DNA, 25 bp, synthetic construct
  misc_feature 1..25: note = Synthetic Construct
  source 1..25: mol_type = other DNA
agtttcctggaagccagctattaaa

SEQ ID NO: 1193 - DNA, 22 bp, synthetic construct
  misc_feature 1..22: note = Synthetic Construct
  source 1..22: mol_type = other DNA
cgtaagcataggggctgcagta

SEQ ID NO: 1194 - DNA, 25 bp, synthetic construct
  misc_feature 1..25: note = Synthetic Construct
  source 1..25: mol_type = other DNA
gcagttgagggagttcaactaaaga

SEQ ID NO: 1195 - DNA, 23 bp, synthetic construct
  misc_feature 1..23: note = Synthetic Construct
  source 1..23: mol_type = other DNA
cctaggctagaagcccagaaaac

SEQ ID NO: 1196 - DNA, 23 bp, synthetic construct
  misc_feature 1..23: note = Synthetic Construct
  source 1..23: mol_type = other DNA
ccttccctttgtcacaccacatc

SEQ ID NO: 1197 - DNA, 24 bp, synthetic construct
  misc_feature 1..24: note = Synthetic Construct
  source 1..24: mol_type = other DNA
cctgtgttcaggaagaatgaggat

SEQ ID NO: 1198 - DNA, 26 bp, synthetic construct
  misc_feature 1..26: note = Synthetic Construct
  source 1..26: mol_type = other DNA
gaaggaaactgactttgcagcttaac

SEQ ID NO: 1199 - DNA, 24 bp, synthetic construct
  misc_feature 1..24: note = Synthetic Construct
  source 1..24: mol_type = other DNA
agggagaaaatcacactcttgcat

SEQ ID NO: 1200 - DNA, 21 bp, synthetic construct
  misc_feature 1..21: note = Synthetic Construct
  source 1..21: mol_type = other DNA
ggggacgaagtcaaggtgtag

SEQ ID NO: 1201 - DNA, 26 bp, synthetic construct
  misc_feature 1..26: note = Synthetic Construct
  source 1..26: mol_type = other DNA
ctcactaaacttttccccagaactca

SEQ ID NO: 1202 - DNA, 24 bp, synthetic construct
  misc_feature 1..24: note = Synthetic Construct
  source 1..24: mol_type = other DNA
cctctgaagggagactgaaacaac

SEQ ID NO: 1203 - DNA, 20 bp, synthetic construct
  misc_feature 1..20: note = Synthetic Construct
  source 1..20: mol_type = other DNA
gcaagaatgcttggctgcaa

SEQ ID NO: 1204 - DNA, 21 bp, synthetic construct
  misc_feature 1..21: note = Synthetic Construct
  source 1..21: mol_type = other DNA
gtggcatttcactgccctttg

SEQ ID NO: 1205 - DNA, 23 bp, synthetic construct
  misc_feature 1..23: note = Synthetic Construct
  source 1..23: mol_type = other DNA
gcagcttgttcaattgtggttca

SEQ ID NO: 1206 - DNA, 26 bp, synthetic construct
  misc_feature 1..26: note = Synthetic Construct
  source 1..26: mol_type = other DNA
gtgaggatgagttttcagtggctatc

SEQ ID NO: 1207 - DNA, 27 bp, synthetic construct
  misc_feature 1..27: note = Synthetic Construct
  source 1..27: mol_type = other DNA
ccctggacaaaatgtaacagccaaagt

SEQ ID NO: 1208 - DNA, 24 bp, synthetic construct
  misc_feature 1..24: note = Synthetic Construct
  source 1..24: mol_type = other DNA
acctagctatccttccagcatttc

SEQ ID NO: 1209 - DNA, 23 bp, synthetic construct
  misc_feature 1..23: note = Synthetic Construct
  source 1..23: mol_type = other DNA
gctggacaaactactgcctcttc

SEQ ID NO: 1210 - DNA, 22 bp, synthetic construct
  misc_feature 1..22: note = Synthetic Construct
  source 1..22: mol_type = other DNA
gccaatagctgcttgatgcaat

SEQ ID NO: 1211 - DNA, 22 bp, synthetic construct
  misc_feature 1..22: note = Synthetic Construct
  source 1..22: mol_type = other DNA
tagttgcccgggattcccaaga

SEQ ID NO: 1212 - DNA, 20 bp, synthetic construct
  misc_feature 1..20: note = Synthetic Construct
  source 1..20: mol_type = other DNA
gggagaggctggtcctgagt

SEQ ID NO: 1213 - DNA, 25 bp, synthetic construct
  misc_feature 1..25: note = Synthetic Construct
  source 1..25: mol_type = other DNA
gtttgtgaaaggtcaatgtgaggaa

SEQ ID NO: 1214 - DNA, 22 bp, synthetic construct
  misc_feature 1..22: note = Synthetic Construct
  source 1..22: mol_type = other DNA
tcctcgggagctcacaacctta

SEQ ID NO: 1215 - DNA, 20 bp, synthetic construct
  misc_feature 1..20: note = Synthetic Construct
  source 1..20: mol_type = other DNA
tcccactgatgccagaccaa

SEQ ID NO: 1216 - DNA, 27 bp, synthetic construct
  misc_feature 1..27: note = Synthetic Construct
  source 1..27: mol_type = other DNA
cccagcttaagcaaaatagggcaagta

SEQ ID NO: 1217 - DNA, 26 bp, synthetic construct
  misc_feature 1..26: note = Synthetic Construct
  source 1..26: mol_type = other DNA
tggccagtagtaagttgagaagacta

SEQ ID NO: 1218 - DNA, 20 bp, synthetic construct
  misc_feature 1..20: note = Synthetic Construct
  source 1..20: mol_type = other DNA
ccggaagcttcacgttctgt

SEQ ID NO: 1219 - DNA, 22 bp, synthetic construct
  misc_feature 1..22: note = Synthetic Construct
  source 1..22: mol_type = other DNA
ggagggagagctccatctctga

SEQ ID NO: 1220 - DNA, 20 bp, synthetic construct
  misc_feature 1..20: note = Synthetic Construct
  source 1..20: mol_type = other DNA
ccggcaataggactcagcaa

SEQ ID NO: 1221 - DNA, 21 bp, synthetic construct
  misc_feature 1..21: note = Synthetic Construct
  source 1..21: mol_type = other DNA
tagggcaggtgtcctctgcat

SEQ ID NO: 1222 - DNA, 28 bp, synthetic construct
  misc_feature 1..28: note = Synthetic Construct
  source 1..28: mol_type = other DNA
gtgaaccaagctatactacctgcttttc

SEQ ID NO: 1223 - DNA, 25 bp, synthetic construct
  misc_feature 1..25: note = Synthetic Construct
  source 1..25: mol_type = other DNA
ggcttctgtgctcatagttcacact

SEQ ID NO: 1224 - DNA, 22 bp, synthetic construct
  misc_feature 1..22: note = Synthetic Construct
  source 1..22: mol_type = other DNA
gggcacacggaggtgaaaaagt

SEQ ID NO: 1225 - DNA, 23 bp, synthetic construct
  misc_feature 1..23: note = Synthetic Construct
  source 1..23: mol_type = other DNA
cgggagccgttataccagcttag

SEQ ID NO: 1226 - DNA, 23 bp, synthetic construct
  misc_feature 1..23: note = Synthetic Construct
  source 1..23: mol_type = other DNA
gcttcctatgaccaagtcccttt

SEQ ID NO: 1227 - DNA, 20 bp, synthetic construct
  misc_feature 1..20: note = Synthetic Construct
  source 1..20: mol_type = other DNA
gtgttggccagacccactgt

SEQ ID NO: 1228 - DNA, 23 bp, synthetic construct
  misc_feature 1..23: note = Synthetic Construct
  source 1..23: mol_type = other DNA
gggcacttttgagttgggctttg

SEQ ID NO: 1229 - DNA, 21 bp, synthetic construct
  misc_feature 1..21: note = Synthetic Construct
  source 1..21: mol_type = other DNA
gcagctcggtgcctaatggtt

SEQ ID NO: 1230 - DNA, 24 bp, synthetic construct
  misc_feature 1..24: note = Synthetic Construct
  source 1..24: mol_type = other DNA
cagacctggcaggatcagaatagt

SEQ ID NO: 1231 - DNA, 22 bp, synthetic construct
  misc_feature 1..22: note = Synthetic Construct
  source 1..22: mol_type = other DNA
tgcaatgcagaggagaaaggtt

SEQ ID NO: 1232 - DNA, 25 bp, synthetic construct
  misc_feature 1..25: note = Synthetic Construct
  source 1..25: mol_type = other DNA
agtcacaggtatcctgactctcata

SEQ ID NO: 1233 - DNA, 22 bp, synthetic construct
  misc_feature 1..22: note = Synthetic Construct
  source 1..22: mol_type = other DNA
ggagcaatcagccttgcagaga

SEQ ID NO: 1234 - DNA, 18 bp, synthetic construct
  misc_feature 1..18: note = Synthetic Construct
  source 1..18: mol_type = other DNA
tggcgcccggaaaaccat

SEQ ID NO: 1235 - DNA, 22 bp, synthetic construct
  misc_feature 1..22: note = Synthetic Construct
  source 1..22: mol_type = other DNA
ttcaagagcatccttgcgctat

SEQ ID NO: 1236 - DNA, 24 bp, synthetic construct
  misc_feature 1..24: note = Synthetic Construct
  source 1..24: mol_type = other DNA
accttgagaaggtggtatttgtgt

SEQ ID NO: 1237 - DNA, 24 bp, synthetic construct
  misc_feature 1..24: note = Synthetic Construct
  source 1..24: mol_type = other DNA
agaaagaccccaggtaagaaccat

SEQ ID NO: 1238 - DNA, 23 bp, synthetic construct
  misc_feature 1..23: note = Synthetic Construct
  source 1..23: mol_type = other DNA
cactcacacatccacaggagaca

SEQ ID NO: 1239 - DNA, 23 bp, synthetic construct
  misc_feature 1..23: note = Synthetic Construct
  source 1..23: mol_type = other DNA
gacgcagtatcccacagagcatt

SEQ ID NO: 1240 - DNA, 21 bp, synthetic construct
  misc_feature 1..21: note = Synthetic Construct
  source 1..21: mol_type = other DNA
accagctctgagtcaggaagt

SEQ ID NO: 1241 - DNA, 22 bp, synthetic construct
  misc_feature 1..22: note = Synthetic Construct
  source 1..22: mol_type = other DNA
cccacagtccgacgagtgtttt

SEQ ID NO: 1242 - DNA, 25 bp, synthetic construct
  misc_feature 1..25: note = Synthetic Construct
  source 1..25: mol_type = other DNA
tcactccactttacaggcacatatt

SEQ ID NO: 1243 - DNA, 23 bp, synthetic construct
  misc_feature 1..23: note = Synthetic Construct
  source 1..23: mol_type = other DNA
acgaggatcagacaagtcacaga

SEQ ID NO: 1244 - DNA, 23 bp, synthetic construct
  misc_feature 1..23: note = Synthetic Construct
  source 1..23: mol_type = other DNA
cccatgaccccaggttggaattg

SEQ ID NO: 1245 - DNA, 21 bp, synthetic construct
  misc_feature 1..21: note = Synthetic Construct
  source 1..21: mol_type = other DNA
cactctgtgcagttgctggtt

SEQ ID NO: 1246 - DNA, 22 bp, synthetic construct
  misc_feature 1..22: note = Synthetic Construct
  source 1..22: mol_type = other DNA
gtctgtggagcacaccttggaa

SEQ ID NO: 1247 - DNA, 20 bp, synthetic construct
  misc_feature 1..20: note = Synthetic Construct
  source 1..20: mol_type = other DNA
gcctttccactgagccatga

SEQ ID NO: 1248 - DNA, 23 bp, synthetic construct
  misc_feature 1..23: note = Synthetic Construct
  source 1..23: mol_type = other DNA
cagcctggttggttagattctgt

SEQ ID NO: 1249 - DNA, 24 bp, synthetic construct
  misc_feature 1..24: note = Synthetic Construct
  source 1..24: mol_type = other DNA
cttatgtgtggctttggcttcttg

SEQ ID NO: 1250 - DNA, 21 bp, synthetic construct
  misc_feature 1..21: note = Synthetic Construct
  source 1..21: mol_type = other DNA
ggggctgaatcagacaaggaa

SEQ ID NO: 1251 - DNA, 20 bp, synthetic construct
  misc_feature 1..20: note = Synthetic Construct
  source 1..20: mol_type = other DNA
cacagcttggaaggcctgaa

SEQ ID NO: 1252 - DNA, 24 bp, synthetic construct
  misc_feature 1..24: note = Synthetic Construct
  source 1..24: mol_type = other DNA
ctcatgatgtcaaatgctgctcaa

SEQ ID NO: 1253 - DNA, 23 bp, synthetic construct
  misc_feature 1..23: note = Synthetic Construct
  source 1..23: mol_type = other DNA
gttctggtgacagacaaccttct

SEQ ID NO: 1254 - DNA, 21 bp, synthetic construct
  misc_feature 1..21: note = Synthetic Construct
  source 1..21: mol_type = other DNA
tgagcagcacagtccaattct

SEQ ID NO: 1255 - DNA, 23 bp, synthetic construct
  misc_feature 1..23: note = Synthetic Construct
  source 1..23: mol_type = other DNA
cccctgggaaagttactgtcgat

SEQ ID NO: 1256 - DNA, 21 bp, synthetic construct
  misc_feature 1..21: note = Synthetic Construct
  source 1..21: mol_type = other DNA
gtcagtgagctgccagttttc

SEQ ID NO: 1257 - DNA, 21 bp, synthetic construct
  misc_feature 1..21: note = Synthetic Construct
  source 1..21: mol_type = other DNA
tcccaaatcctgagcctgtca

SEQ ID NO: 1258 - DNA, 28 bp, synthetic construct
  misc_feature 1..28: note = Synthetic Construct
  source 1..28: mol_type = other DNA
gccaacctatagacacaactttggttac

SEQ ID NO: 1259 - DNA, 25 bp, synthetic construct
  misc_feature 1..25: note = Synthetic Construct
  source 1..25: mol_type = other DNA
gttgacttccggcagtaagtgatga

SEQ ID NO: 1260 - DNA, 24 bp, synthetic construct
  misc_feature 1..24: note = Synthetic Construct
  source 1..24: mol_type = other DNA
actgggacatttctcacgttatca

SEQ ID NO: 1261 - DNA, 23 bp, synthetic construct
  misc_feature 1..23: note = Synthetic Construct
  source 1..23: mol_type = other DNA
ggaatccagcccatcctcacatc

SEQ ID NO: 1262 - DNA, 20 bp, synthetic construct
  misc_feature 1..20: note = Synthetic Construct
  source 1..20: mol_type = other DNA
actgcaccaccacacggaaa

SEQ ID NO: 1263 - DNA, 22 bp, synthetic construct
  misc_feature 1..22: note = Synthetic Construct
  source 1..22: mol_type = other DNA
ccttcaagggctttctctcaca

SEQ ID NO: 1264 - DNA, 24 bp, synthetic construct
  misc_feature 1..24: note = Synthetic Construct
  source 1..24: mol_type = other DNA
acttccacatggcttaaacagaga

SEQ ID NO: 1265 - DNA, 25 bp, synthetic construct
  misc_feature 1..25: note = Synthetic Construct
  source 1..25: mol_type = other DNA
tcgtgaagaagatggagaggagtta

SEQ ID NO: 1266 - DNA, 21 bp, synthetic construct
  misc_feature 1..21: note = Synthetic Construct
  source 1..21: mol_type = other DNA
ctgggaccaacccatttcaca

SEQ ID NO: 1267 - DNA, 22 bp, synthetic construct
  misc_feature 1..22: note = Synthetic Construct
  source 1..22: mol_type = other DNA
aaggaagtggggtatggactga

SEQ ID NO: 1268 - DNA, 24 bp, synthetic construct
  misc_feature 1..24: note = Synthetic Construct
  source 1..24: mol_type = other DNA
tgttggccacatacattgttctca

SEQ ID NO: 1269 - DNA, 19 bp, synthetic construct
  misc_feature 1..19: note = Synthetic Construct
  source 1..19: mol_type = other DNA
ctcctgccttcggggatgt

SEQ ID NO: 1270 - DNA, 21 bp, synthetic construct
  misc_feature 1..21: note = Synthetic Construct
  source 1..21: mol_type = other DNA
cacaggccagagattcaccat

SEQ ID NO: 1271 - DNA, 21 bp, synthetic construct
  misc_feature 1..21: note = Synthetic Construct
  source 1..21: mol_type = other DNA
tgggaagcctaccttgactct

SEQ ID NO: 1272 - DNA, 24 bp, synthetic construct
  misc_feature 1..24: note = Synthetic Construct
  source 1..24: mol_type = other DNA
aagcccctgagaatctaaaagcaa

SEQ ID NO: 1273 - DNA, 19 bp, synthetic construct
  misc_feature 1..19: note = Synthetic Construct
  source 1..19: mol_type = other DNA
cgacagggcctcccaattc

SEQ ID NO: 1274 - DNA, 24 bp, synthetic construct
  misc_feature 1..24: note = Synthetic Construct
  source 1..24: mol_type = other DNA
aggtagacaccggaagtaatcaca

SEQ ID NO: 1275 - DNA, 22 bp, synthetic construct
  misc_feature 1..22: note = Synthetic Construct
  source 1..22: mol_type = other DNA
tcaggtagaggtcgccaaggtt

SEQ ID NO: 1276 - DNA, 24 bp, synthetic construct
  misc_feature 1..24: note = Synthetic Construct
  source 1..24: mol_type = other DNA
ggaggctatgagaagtgaggtttg

SEQ ID NO: 1277 - DNA, 23 bp, synthetic construct
  misc_feature 1..23: note = Synthetic Construct
  source 1..23: mol_type = other DNA
gggcggttaaagagcttcagaga

SEQ ID NO: 1278 - DNA, 24 bp, synthetic construct
  misc_feature 1..24: note = Synthetic Construct
  source 1..24: mol_type = other DNA
tggtcttctttatgcccaacaaac

SEQ ID NO: 1279 - DNA, 20 bp, synthetic construct
  misc_feature 1..20: note = Synthetic Construct
  source 1..20: mol_type = other DNA
ctcacacgggctcacattct

SEQ ID NO: 1280 - DNA, 19 bp, synthetic construct
  misc_feature 1..19: note = Synthetic Construct
  source 1..19: mol_type = other DNA
cctgctcaccgatgctcaa

SEQ ID NO: 1281 - DNA, 24 bp, synthetic construct
  misc_feature 1..24: note = Synthetic Construct
  source 1..24: mol_type = other DNA
ggtcagaaacagagcctgtaaaac

SEQ ID NO: 1282 - DNA, 25 bp, synthetic construct
  misc_feature 1..25: note = Synthetic Construct
  source 1..25: mol_type = other DNA
cctgagacagaagcagtagcgtctt

SEQ ID NO: 1283 - DNA, 20 bp, synthetic construct
  misc_feature 1..20: note = Synthetic Construct
  source 1..20: mol_type = other DNA
cgcaaaatgggctcctgctt

SEQ ID NO: 1284 - DNA, 22 bp, synthetic construct
  misc_feature 1..22: note = Synthetic Construct
  source 1..22: mol_type = other DNA
gccggattaggggtgaactttg

SEQ ID NO: 1285 - DNA, 24 bp, synthetic construct
  misc_feature 1..24: note = Synthetic Construct
  source 1..24: mol_type = other DNA
ggaggtattctggcttccctaaga

SEQ ID NO: 1286 - DNA, 26 bp, synthetic construct
  misc_feature 1..26: note = Synthetic Construct
  source 1..26: mol_type = other DNA
ggaagggtgagtttagcacaatggtt

SEQ ID NO: 1287 - DNA, 22 bp, synthetic construct
  misc_feature 1..22: note = Synthetic Construct
  source 1..22: mol_type = other DNA
cccacttgcacaaatgcaaaga

SEQ ID NO: 1288 - DNA, 21 bp, synthetic construct
  misc_feature 1..21: note = Synthetic Construct
  source 1..21: mol_type = other DNA
agctgtggttttcctgtgtca

SEQ ID NO: 1289 - DNA, 24 bp, synthetic construct
  misc_feature 1..24: note = Synthetic Construct
  source 1..24: mol_type = other DNA
tgtgtgtgtttagcaagggatttc

SEQ ID NO: 1290 - DNA, 21 bp, synthetic construct
  misc_feature 1..21: note = Synthetic Construct
  source 1..21: mol_type = other DNA
cgtttggcaacggagatgtgt

SEQ ID NO: 1291 - DNA, 22 bp, synthetic construct
  misc_feature 1..22: note = Synthetic Construct
  source 1..22: mol_type = other DNA
tgcccacccttttcttttgctt

SEQ ID NO: 1292 - DNA, 23 bp, synthetic construct
  misc_feature 1..23: note = Synthetic Construct
  source 1..23: mol_type = other DNA
gggctatacatttctgggctcaa

SEQ ID NO: 1293 - DNA, 22 bp, synthetic construct
  misc_feature 1..22: note = Synthetic Construct
  source 1..22: mol_type = other DNA
tacattcccctctcccgcaaca

SEQ ID NO: 1294 - DNA, 25 bp, synthetic construct
  misc_feature 1..25: note = Synthetic Construct
  source 1..25: mol_type = other DNA
ccagccaatcaggatcatggacaga

SEQ ID NO: 1295 - DNA, 20 bp, synthetic construct
  misc_feature 1..20: note = Synthetic Construct
  source 1..20: mol_type = other DNA
ggcccatgactctgctggat

SEQ ID NO: 1296 - DNA, 19 bp, synthetic construct
  misc_feature 1..19: note = Synthetic Construct
  source 1..19: mol_type = other DNA
ggaggcatctccggctaca

SEQ ID NO: 1297 - DNA, 24 bp, synthetic construct
  misc_feature 1..24: note = Synthetic Construct
  source 1..24: mol_type = other DNA
agtgcaaggttggagaatgaaaag

SEQ ID NO: 1298 - DNA, 22 bp, synthetic construct
  misc_feature 1..22: note = Synthetic Construct
  source 1..22: mol_type = other DNA
cgagttggcctcgtcttaccaa

SEQ ID NO: 1299 - DNA, 22 bp, synthetic construct
  misc_feature 1..22: note = Synthetic Construct
  source 1..22: mol_type = other DNA
cgtggcagctggctttagaatc

SEQ ID NO: 1300 - DNA, 22 bp, synthetic construct
  misc_feature 1..22: note = Synthetic Construct
  source 1..22: mol_type = other DNA
tggtgcagccacctctcttatc

SEQ ID NO: 1301 - DNA, 21 bp, synthetic construct
  misc_feature 1..21: note = Synthetic Construct
  source 1..21: mol_type = other DNA
ctctggcacatgcgttagttg

SEQ ID NO: 1302 - DNA, 24 bp, synthetic construct
  misc_feature 1..24: note = Synthetic Construct
  source 1..24: mol_type = other DNA
ggggctttggataacaccaaggta

SEQ ID NO: 1303 - DNA, 20 bp, synthetic construct
  misc_feature 1..20: note = Synthetic Construct
  source 1..20: mol_type = other DNA
ttgcaacccctccgacattc

SEQ ID NO: 1304 - DNA, 21 bp, synthetic construct
  misc_feature 1..21: note = Synthetic Construct
  source 1..21: mol_type = other DNA
aggagaagttcaggggaccaa

SEQ ID NO: 1305 - DNA, 24 bp, synthetic construct
  misc_feature 1..24: note = Synthetic Construct
  source 1..24: mol_type = other DNA
agagctgctatcatgatgtggaaa

SEQ ID NO: 1306 - DNA, 21 bp, synthetic construct
  misc_feature 1..21: note = Synthetic Construct
  source 1..21: mol_type = other DNA
agggtgagtctggaagaggtt

SEQ ID NO: 1307 - DNA, 22 bp, synthetic construct
  misc_feature 1..22: note = Synthetic Construct
  source 1..22: mol_type = other DNA
ccccactcccctcaaggtatgt

SEQ ID NO: 1308 - DNA, 22 bp, synthetic construct
  misc_feature 1..22: note = Synthetic Construct
  source 1..22: mol_type = other DNA
gtcaccctctgaggtacacact

SEQ ID NO: 1309 - DNA, 23 bp, synthetic construct
  misc_feature 1..23: note = Synthetic Construct
  source 1..23: mol_type = other DNA
atgacaacatcacggacagagaa

SEQ ID NO: 1310 - DNA, 22 bp, synthetic construct
  misc_feature 1..22: note = Synthetic Construct
  source 1..22: mol_type = other DNA
tgacaaatgccgaagggattct

SEQ ID NO: 1311 - DNA, 24 bp, synthetic construct
  misc_feature 1..24: note = Synthetic Construct
  source 1..24: mol_type = other DNA
ctatgtttcagccacaccacattc

SEQ ID NO: 1312 - DNA, 23 bp, synthetic construct
  misc_feature 1..23: note = Synthetic Construct
  source 1..23: mol_type = other DNA
caggcttgttcgggaaatacaag

SEQ ID NO: 1313 - DNA, 20 bp, synthetic construct
  misc_feature 1..20: note = Synthetic Construct
  source 1..20: mol_type = other DNA
gccgaggtttcaaggtccaa

SEQ ID NO: 1314 - DNA, 22 bp, synthetic construct
  misc_feature 1..22: note = Synthetic Construct
  source 1..22: mol_type = other DNA
tgctcaactcaaacaggacact

SEQ ID NO: 1315 - DNA, 18 bp, synthetic construct
  misc_feature 1..18: note = Synthetic Construct
  source 1..18: mol_type = other DNA
tgcggcgatgtggctgta

SEQ ID NO: 1316 - DNA, 23 bp, synthetic construct
  misc_feature 1..23: note = Synthetic Construct
  source 1..23: mol_type = other DNA
cagagggtggatggatacagttc

SEQ ID NO: 1317 - DNA, 19 bp, synthetic construct
  misc_feature 1..19: note = Synthetic Construct
  source 1..19: mol_type = other DNA
cgtggcctcctgcactgat

SEQ ID NO: 1318 - DNA, 21 bp, synthetic construct
  misc_feature 1..21: note = Synthetic Construct
  source 1..21: mol_type = other DNA
gtgcaggctcaagttgcttct

SEQ ID NO: 1319 - DNA, 24 bp, synthetic construct
  misc_feature 1..24: note = Synthetic Construct
  source 1..24: mol_type = other DNA
gcttgcttggaaccgattttggat

SEQ ID NO: 1320 - DNA, 19 bp, synthetic construct
  misc_feature 1..19: note = Synthetic Construct
  source 1..19: mol_type = other DNA
ggcgggaccgagtgcttta

SEQ ID NO: 1321 - DNA, 26 bp, synthetic construct
  misc_feature 1..26: note = Synthetic Construct
  source 1..26: mol_type = other DNA
cctcaattactccccagatgttcaga

SEQ ID NO: 1322 - DNA, 22 bp, synthetic construct
  misc_feature 1..22: note = Synthetic Construct
  source 1..22: mol_type = other DNA
tcagcaggaggaaggatgtttg

SEQ ID NO: 1323 - DNA, 20 bp, synthetic construct
  misc_feature 1..20: note = Synthetic Construct
  source 1..20: mol_type = other DNA
accttccggccatgtgtgaa

SEQ ID NO: 1324 - DNA, 26 bp, synthetic construct
  misc_feature 1..26: note = Synthetic Construct
  source 1..26: mol_type = other DNA
caaatctgctctgtctatgctaggaa

SEQ ID NO: 1325 - DNA, 22 bp, synthetic construct
  misc_feature 1..22: note = Synthetic Construct
  source 1..22: mol_type = other DNA
agctcctgacattatgcccaaa

SEQ ID NO: 1326 - DNA, 24 bp, synthetic construct
  misc_feature 1..24: note = Synthetic Construct
  source 1..24: mol_type = other DNA
gggaaagccagacatcctctccta

SEQ ID NO: 1327 - DNA, 22 bp, synthetic construct
  misc_feature 1..22: note = Synthetic Construct
  source 1..22: mol_type = other DNA
gcccaggtagaggaacaaatca

SEQ ID NO: 1328 - DNA, 26 bp, synthetic construct
  misc_feature 1..26: note = Synthetic Construct
  source 1..26: mol_type = other DNA
ggagaatatcaagctgtcatgggatt

SEQ ID NO: 1329 - DNA, 23 bp, synthetic construct
  misc_feature 1..23: note = Synthetic Construct
  source 1..23: mol_type = other DNA
ccaaacgaggccctctctcttct

SEQ ID NO: 1330 - DNA, 20 bp, synthetic construct
  misc_feature 1..20: note = Synthetic Construct
  source 1..20: mol_type = other DNA
gcccagaagagtgcttgaca

SEQ ID NO: 1331 - DNA, 24 bp, synthetic construct
  misc_feature 1..24: note = Synthetic Construct
  source 1..24: mol_type = other DNA
ggcagtccttaactcctggttttc

SEQ ID NO: 1332 - DNA, 23 bp, synthetic construct
  misc_feature 1..23: note = Synthetic Construct
  source 1..23: mol_type = other DNA
ccagcacattcagtccagaatca

SEQ ID NO: 1333 - DNA, 20 bp, synthetic construct
  misc_feature 1..20: note = Synthetic Construct
  source 1..20: mol_type = other DNA
cagccaagtgcagactggaa

SEQ ID NO: 1334 - DNA, 22 bp, synthetic construct
  misc_feature 1..22: note = Synthetic Construct
  source 1..22: mol_type = other DNA
tcctggcaaatcttgcacaaag

SEQ ID NO: 1335 - DNA, 26 bp, synthetic construct
  misc_feature 1..26: note = Synthetic Construct
  source 1..26: mol_type = other DNA
gtgggattacattcacagatgcagaa

SEQ ID NO: 1336 - DNA, 22 bp, synthetic construct
  misc_feature 1..22: note = Synthetic Construct
  source 1..22: mol_type = other DNA
agaccttcacctctgccacagt

SEQ ID NO: 1337 - DNA, 22 bp, synthetic construct
  misc_feature 1..22: note = Synthetic Construct
  source 1..22: mol_type = other DNA
ggaacaggagaagagcaaggaa

SEQ ID NO: 1338 - DNA, 24 bp, synthetic construct
  misc_feature 1..24: note = Synthetic Construct
  source 1..24: mol_type = other DNA
actgatgctaccaaagaggctaga

SEQ ID NO: 1339 - DNA, 20 bp, synthetic construct
  misc_feature 1..20: note = Synthetic Construct
  source 1..20: mol_type = other DNA
cacaaccgctttccccttga

SEQ ID NO: 1340 - DNA, 22 bp, synthetic construct
  misc_feature 1..22: note = Synthetic Construct
  source 1..22: mol_type = other DNA
gggagacactgcaggacaaagt

SEQ ID NO: 1341 - DNA, 21 bp, synthetic construct
  misc_feature 1..21: note = Synthetic Construct
  source 1..21: mol_type = other DNA
gtgcctgagagtttcctggtt

SEQ ID NO: 1342 - DNA, 22 bp, synthetic construct
  misc_feature 1..22: note = Synthetic Construct
  source 1..22: mol_type = other DNA
cacagtgctgtagttgcctgtt

SEQ ID NO: 1343 - DNA, 23 bp, synthetic construct
  misc_feature 1..23: note = Synthetic Construct
  source 1..23: mol_type = other DNA
gccacaatctaggacctgcagaa

SEQ ID NO: 1344 - DNA, 23 bp, synthetic construct
  misc_feature 1..23: note = Synthetic Construct
  source 1..23: mol_type = other DNA
tttctgccctagttcaggtcatc

SEQ ID NO: 1345 - DNA, 29 bp, synthetic construct
  misc_feature 1..29: note = Synthetic Construct
  source 1..29: mol_type = other DNA
ccttgaagatgcaacagacattcttctac

SEQ ID NO: 1346 - DNA, 18 bp, synthetic construct
  misc_feature 1..18: note = Synthetic Construct
  source 1..18: mol_type = other DNA
ggatgcaggcaggcaagt

SEQ ID NO: 1347 - DNA, 24 bp, synthetic construct
  misc_feature 1..24: note = Synthetic Construct
  source 1..24: mol_type = other DNA
gtgctagagagcgaaatacctgtt

SEQ ID NO: 1348 - DNA, 24 bp, synthetic construct
  misc_feature 1..24: note = Synthetic Construct
  source 1..24: mol_type = other DNA
ccacagaactcccactcgaataag

SEQ ID NO: 1349 - DNA, 21 bp, synthetic construct
  misc_feature 1..21: note = Synthetic Construct
  source 1..21: mol_type = other DNA
ccccagaccaatccgaagtgt

SEQ ID NO: 1350 - DNA, 21 bp, synthetic construct
  misc_feature 1..21: note = Synthetic Construct
  source 1..21: mol_type = other DNA
aagcaacccagttccttccaa

SEQ ID NO: 1351 - DNA, 21 bp, synthetic construct
  misc_feature 1..21: note = Synthetic Construct
  source 1..21: mol_type = other DNA
cagctgctgcctcatttgcat

SEQ ID NO: 1352 - DNA, 23 bp, synthetic construct
  misc_feature 1..23: note = Synthetic Construct
  source 1..23: mol_type = other DNA
aatggtagcctttgagacgatgt

SEQ ID NO: 1353 - DNA, 24 bp, synthetic construct
  misc_feature 1..24: note = Synthetic Construct
  source 1..24: mol_type = other DNA
gccccttcttttctatgaggatgt

SEQ ID NO: 1354 - DNA, 22 bp, synthetic construct
  misc_feature 1..22: note = Synthetic Construct
  source 1..22: mol_type = other DNA
agcatgggaaccagtgttcatc

SEQ ID NO: 1355 - DNA, 21 bp, synthetic construct
  misc_feature 1..21: note = Synthetic Construct
  source 1..21: mol_type = other DNA
tgacaggacgaggagactcaa

SEQ ID NO: 1356 - DNA, 23 bp, synthetic construct
  misc_feature 1..23: note = Synthetic Construct
  source 1..23: mol_type = other DNA
tctgccttgcagagttacagaat

SEQ ID NO: 1357 - DNA, 23 bp, synthetic construct
  misc_feature 1..23: note = Synthetic Construct
  source 1..23: mol_type = other DNA
aaccttttcgctacccatgtact

SEQ ID NO: 1358 - DNA, 21 bp, synthetic construct
  misc_feature 1..21: note = Synthetic Construct
  source 1..21: mol_type = other DNA
ccgagctcgtctgggtttgaa

SEQ ID NO: 1359 - DNA, 20 bp, synthetic construct
  misc_feature 1..20: note = Synthetic Construct
  source 1..20: mol_type = other DNA
ctatctgcccgcatcacctt

SEQ ID NO: 1360 - DNA, 19 bp, synthetic construct
  misc_feature 1..19: note = Synthetic Construct
  source 1..19: mol_type = other DNA
cgacggctcggagagaatc

SEQ ID NO: 1361 - DNA, 20 bp, synthetic construct
  misc_feature 1..20: note = Synthetic Construct
  source 1..20: mol_type = other DNA
cccacgggtttgggtagctt

SEQ ID NO: 1362 - DNA, 24 bp, synthetic construct
  misc_feature 1..24: note = Synthetic Construct
  source 1..24: mol_type = other DNA
cttgaccttgctctagcagttttg

SEQ ID NO: 1363 - DNA, 22 bp, synthetic construct
  misc_feature 1..22: note = Synthetic Construct
  source 1..22: mol_type = other DNA
ctcacgtagtctccaccgtcat

SEQ ID NO: 1364 - DNA, 22 bp, synthetic construct
  misc_feature 1..22: note = Synthetic Construct
  source 1..22: mol_type = other DNA
aaccctttcaaccctccacatt

SEQ ID NO: 1365 - DNA, 21 bp, synthetic construct
  misc_feature 1..21: note = Synthetic Construct
  source 1..21: mol_type = other DNA
agttctcaggccaccttgttc

SEQ ID NO: 1366 - DNA, 19 bp, synthetic construct
  misc_feature 1..19: note = Synthetic Construct
  source 1..19: mol_type = other DNA
cccgcaggactgagcacaa

SEQ ID NO: 1367 - DNA, 21 bp, synthetic construct
  misc_feature 1..21: note = Synthetic Construct
  source 1..21: mol_type = other DNA
catccaggcacaccgttaaga

SEQ ID NO: 1368 - DNA, 20 bp, synthetic construct
  misc_feature 1..20: note = Synthetic Construct
  source 1..20: mol_type = other DNA
tcgggagcacgtttgcagat

SEQ ID NO: 1369 - DNA, 22 bp, synthetic construct
  misc_feature 1..22: note = Synthetic Construct
  source 1..22: mol_type = other DNA
ggttgctctcacgggaataaga

SEQ ID NO: 1370 - DNA, 23 bp, synthetic construct
  misc_feature 1..23: note = Synthetic Construct
  source 1..23: mol_type = other DNA
ccggtaaacccaatccaaacaaa

SEQ ID NO: 1371 - DNA, 18 bp, synthetic construct
  misc_feature 1..18: note = Synthetic Construct
  source 1..18: mol_type = other DNA
tgcacactgcgtcagctt

SEQ ID NO: 1372 - DNA, 27 bp, synthetic construct
  misc_feature 1..27: note = Synthetic Construct
  source 1..27: mol_type = other DNA
gcatgcttcacaaacattatcccattc

SEQ ID NO: 1373 - DNA, 22 bp, synthetic construct
  misc_feature 1..22: note = Synthetic Construct
  source 1..22: mol_type = other DNA
gggcatccaaggagagaagaga

SEQ ID NO: 1374 - DNA, 21 bp, synthetic construct
  misc_feature 1..21: note = Synthetic Construct
  source 1..21: mol_type = other DNA
tgtcagcctggcttctgtaag

SEQ ID NO: 1375 - DNA, 21 bp, synthetic construct
  misc_feature 1..21: note = Synthetic Construct
  source 1..21: mol_type = other DNA
tgagctggcctggtgaaatag

SEQ ID NO: 1376 - DNA, 25 bp, synthetic construct
  misc_feature 1..25: note = Synthetic Construct
  source 1..25: mol_type = other DNA
acctcaccttctaattctggactgt

SEQ ID NO: 1377 - DNA, 22 bp, synthetic construct
  misc_feature 1..22: note = Synthetic Construct
  source 1..22: mol_type = other DNA
cgtgacagctaatcacccacat

SEQ ID NO: 1378 - DNA, 24 bp, synthetic construct
  misc_feature 1..24: note = Synthetic Construct
  source 1..24: mol_type = other DNA
ggaacacctctccctcaattcttt

SEQ ID NO: 1379 - DNA, 23 bp, synthetic construct
  misc_feature 1..23: note = Synthetic Construct
  source 1..23: mol_type = other DNA
ccttggcagagggagatttgaga

SEQ ID NO: 1380 - DNA, 20 bp, synthetic construct
  misc_feature 1..20: note = Synthetic Construct
  source 1..20: mol_type = other DNA
gtgaagcgtcctcctgttga

SEQ ID NO: 1381 - DNA, 25 bp, synthetic construct
  misc_feature 1..25: note = Synthetic Construct
  source 1..25: mol_type = other DNA
ccagactagccgaattttccaggat

SEQ ID NO: 1382 - DNA, 24 bp, synthetic construct
  misc_feature 1..24: note = Synthetic Construct
  source 1..24: mol_type = other DNA
tctggagaaagtgacagggtaaga

SEQ ID NO: 1383 - DNA, 25 bp, synthetic construct
  misc_feature 1..25: note = Synthetic Construct
  source 1..25: mol_type = other DNA
gaaaggctgggtatttttgaaccaa

SEQ ID NO: 1384 - DNA, 24 bp, synthetic construct
  misc_feature 1..24: note = Synthetic Construct
  source 1..24: mol_type = other DNA
cacaacctcacattctccaggtta

SEQ ID NO: 1385 - DNA, 22 bp, synthetic construct
  misc_feature 1..22: note = Synthetic Construct
  source 1..22: mol_type = other DNA
gagcccacgtatcagctcaaca

SEQ ID NO: 1386 - DNA, 22 bp, synthetic construct
  misc_feature 1..22: note = Synthetic Construct
  source 1..22: mol_type = other DNA
actgcaacctttttgcctgaga

SEQ ID NO: 1387 - DNA, 20 bp, synthetic construct
  misc_feature 1..20: note = Synthetic Construct
  source 1..20: mol_type = other DNA
tctcaccgcttggtcagagt

SEQ ID NO: 1388 - DNA, 21 bp, synthetic construct
  misc_feature 1..21: note = Synthetic Construct
  source 1..21: mol_type = other DNA
tctccagccctcagtccttct

SEQ ID NO: 1389 - DNA, 21 bp, synthetic construct
  misc_feature 1..21: note = Synthetic Construct
  source 1..21: mol_type = other DNA
tgagaggtcaccacacacaga

SEQ ID NO: 1390 - DNA, 25 bp, synthetic construct
  misc_feature 1..25: note = Synthetic Construct
  source 1..25: mol_type = other DNA
tcatcccagcatcatttgttgagaa

SEQ ID NO: 1391 - DNA, 22 bp, synthetic construct
  misc_feature 1..22: note = Synthetic Construct
  source 1..22: mol_type = other DNA
ccgcctctccacctttgaactt

SEQ ID NO: 1392 - DNA, 25 bp, synthetic construct
  misc_feature 1..25: note = Synthetic Construct
  source 1..25: mol_type = other DNA
cgacaatttaaggcgagacatggaa

SEQ ID NO: 1393 - DNA, 21 bp, synthetic construct
  misc_feature 1..21: note = Synthetic Construct
  source 1..21: mol_type = other DNA
gcacattgccaccgtccagat

SEQ ID NO: 1394 - DNA, 21 bp, synthetic construct
  misc_feature 1..21: note = Synthetic Construct
  source 1..21: mol_type = other DNA
cccatccttcaagtcgtggtt

SEQ ID NO: 1395 - DNA, 22 bp, synthetic construct
  misc_feature 1..22: note = Synthetic Construct
  source 1..22: mol_type = other DNA
acccggtggagtcaggatttga

SEQ ID NO: 1396 - DNA, 21 bp, synthetic construct
  misc_feature 1..21: note = Synthetic Construct
  source 1..21: mol_type = other DNA
tggatgggttggcttggtact

SEQ ID NO: 1397 - DNA, 23 bp, synthetic construct
  misc_feature 1..23: note = Synthetic Construct
  source 1..23: mol_type = other DNA
gctgtgtatttgttgagccttgt

SEQ ID NO: 1398 - DNA, 25 bp, synthetic construct
  misc_feature 1..25: note = Synthetic Construct
  source 1..25: mol_type = other DNA
ggggtgaggtactgcagttaaacat

SEQ ID NO: 1399 - DNA, 19 bp, synthetic construct
  misc_feature 1..19: note = Synthetic Construct
  source 1..19: mol_type = other DNA
atcggcgcgagccaggatt

SEQ ID NO: 1400 - DNA, 24 bp, synthetic construct
  misc_feature 1..24: note = Synthetic Construct
  source 1..24: mol_type = other DNA
gcagtctctcaactctgctgttgt

SEQ ID NO: 1401 - DNA, 20 bp, synthetic construct
  misc_feature 1..20: note = Synthetic Construct
  source 1..20: mol_type = other DNA
agggatgtcctccccaactt

SEQ ID NO: 1402 - DNA, 22 bp, synthetic construct
  misc_feature 1..22: note = Synthetic Construct
  source 1..22: mol_type = other DNA
gtcagcaccatgtagcagatgt

SEQ ID NO: 1403 - DNA, 20 bp, synthetic construct
  misc_feature 1..20: note = Synthetic Construct
  source 1..20: mol_type = other DNA
ccagcattggggcagcttct

SEQ ID NO: 1404 - DNA, 23 bp, synthetic construct
  misc_feature 1..23: note = Synthetic Construct
  source 1..23: mol_type = other DNA
gccctttaaggaaccttgctaca

SEQ ID NO: 1405 - DNA, 21 bp, synthetic construct
  misc_feature 1..21: note = Synthetic Construct
  source 1..21: mol_type = other DNA
tccaggtccactactgtgtca

SEQ ID NO: 1406 - DNA, 21 bp, synthetic construct
  misc_feature 1..21: note = Synthetic Construct
  source 1..21: mol_type = other DNA
cccttgggtccctcttcttca

SEQ ID NO: 1407 - DNA, 20 bp, synthetic construct
  misc_feature 1..20: note = Synthetic Construct
  source 1..20: mol_type = other DNA
ggcgggtattgtgcctgaca

SEQ ID NO: 1408 - DNA, 24 bp, synthetic construct
  misc_feature 1..24: note = Synthetic Construct
  source 1..24: mol_type = other DNA
ccattctgccaaatttctgtgtgt

SEQ ID NO: 1409 - DNA, 24 bp, synthetic construct
  misc_feature 1..24: note = Synthetic Construct
  source 1..24: mol_type = other DNA
ggggagcagaatggatttgtcact

SEQ ID NO: 1410 - DNA, 22 bp, synthetic construct
  misc_feature 1..22: note = Synthetic Construct
  source 1..22: mol_type = other DNA
cagctactcaggcaaccacaga

SEQ ID NO: 1411 - DNA, 25 bp, synthetic construct
  misc_feature 1..25: note = Synthetic Construct
  source 1..25: mol_type = other DNA
aggcagatcactaactggttctaag

SEQ ID NO: 1412 - DNA, 23 bp, synthetic construct
  misc_feature 1..23: note = Synthetic Construct
  source 1..23: mol_type = other DNA
tcagtagagccttgaggtagctt

SEQ ID NO: 1413 - DNA, 21 bp, synthetic construct
  misc_feature 1..21: note = Synthetic Construct
  source 1..21: mol_type = other DNA
cctgccctaccaacccacatt

SEQ ID NO: 1414 - DNA, 22 bp, synthetic construct
  misc_feature 1..22: note = Synthetic Construct
  source 1..22: mol_type = other DNA
ccctctgcttttgctccagata

SEQ ID NO: 1415 - DNA, 24 bp, synthetic construct
  misc_feature 1..24: note = Synthetic Construct
  source 1..24: mol_type = other DNA
aagccaagctaaatcttccctgaa

SEQ ID NO: 1416 - DNA, 19 bp, synthetic construct
  misc_feature 1..19: note = Synthetic Construct
  source 1..19: mol_type = other DNA
aggccttcagcctgagaca

SEQ ID NO: 1417 - DNA, 20 bp, synthetic construct
  misc_feature 1..20: note = Synthetic Construct
  source 1..20: mol_type = other DNA
tcttcctgggcacgttcttc

SEQ ID NO: 1418 - DNA, 22 bp, synthetic construct
  misc_feature 1..22: note = Synthetic Construct
  source 1..22: mol_type = other DNA
gggatctctgcagcatgacttg

SEQ ID NO: 1419 - DNA, 23 bp, synthetic construct
  misc_feature 1..23: note = Synthetic Construct
  source 1..23: mol_type = other DNA
tcaacacctttttcggtgacagt

SEQ ID NO: 1420 - DNA, 22 bp, synthetic construct
  misc_feature 1..22: note = Synthetic Construct
  source 1..22: mol_type = other DNA
ccgcgctctacctcttgattta

SEQ ID NO: 1421 - DNA, 23 bp, synthetic construct
  misc_feature 1..23: note = Synthetic Construct
  source 1..23: mol_type = other DNA
tctgttcttgaacatgccagtga

SEQ ID NO: 1422 - DNA, 20 bp, synthetic construct
  misc_feature 1..20: note = Synthetic Construct
  source 1..20: mol_type = other DNA
gcagtaggtggagggtgttc

SEQ ID NO: 1423 - DNA, 22 bp, synthetic construct
  misc_feature 1..22: note = Synthetic Construct
  source 1..22: mol_type = other DNA
agaccttcctggcttccttttg

SEQ ID NO: 1424 - DNA, 20 bp, synthetic construct
  misc_feature 1..20: note = Synthetic Construct
  source 1..20: mol_type = other DNA
atgggcctgaggcagattgt

SEQ ID NO: 1425 - DNA, 22 bp, synthetic construct
  misc_feature 1..22: note = Synthetic Construct
  source 1..22: mol_type = other DNA
gcaagaggaaagaccagcatca

SEQ ID NO: 1426 - DNA, 19 bp, synthetic construct
  misc_feature 1..19: note = Synthetic Construct
  source 1..19: mol_type = other DNA
caaccctgggctggactgt

SEQ ID NO: 1427 - DNA, 20 bp, synthetic construct
  misc_feature 1..20: note = Synthetic Construct
  source 1..20: mol_type = other DNA
cagccgcaaagagagcctaa

SEQ ID NO: 1428 - DNA, 26 bp, synthetic construct
  misc_feature 1..26: note = Synthetic Construct
  source 1..26: mol_type = other DNA
gaacacaccaggtttctgcactagat

SEQ ID NO: 1429 - DNA, 20 bp, synthetic construct
  misc_feature 1..20: note = Synthetic Construct
  source 1..20: mol_type = other DNA
ccccgctctctgtcccatca

SEQ ID NO: 1430 - DNA, 20 bp, synthetic construct
  misc_feature 1..20: note = Synthetic Construct
  source 1..20: mol_type = other DNA
atcgggagtcacagcacttg

SEQ ID NO: 1431 - DNA, 26 bp, synthetic construct
  misc_feature 1..26: note = Synthetic Construct
  source 1..26: mol_type = other DNA
ctgagagaggagtctatcttccttga

SEQ ID NO: 1432 - DNA, 21 bp, synthetic construct
  misc_feature 1..21: note = Synthetic Construct
  source 1..21: mol_type = other DNA
ggccaagggtgaactggagaa

SEQ ID NO: 1433 - DNA, 20 bp, synthetic construct
  misc_feature 1..20: note = Synthetic Construct
  source 1..20: mol_type = other DNA
ccccgccaggtactgtctca

SEQ ID NO: 1434 - DNA, 19 bp, synthetic construct
  misc_feature 1..19: note = Synthetic Construct
  source 1..19: mol_type = other DNA
ggaccagggctgcgagaaa

SEQ ID NO: 1435 - DNA, 25 bp, synthetic construct
  misc_feature 1..25: note = Synthetic Construct
  source 1..25: mol_type = other DNA
gtgggacatcttatgatccgcttag

SEQ ID NO: 1436 - DNA, 25 bp, synthetic construct
  misc_feature 1..25: note = Synthetic Construct
  source 1..25: mol_type = other DNA
tgagtgtctaaacatgggcacatac

SEQ ID NO: 1437 - DNA, 20 bp, synthetic construct
  misc_feature 1..20: note = Synthetic Construct
  source 1..20: mol_type = other DNA
agcctgccctaccccaatct

SEQ ID NO: 1438 - DNA, 25 bp, synthetic construct
  misc_feature 1..25: note = Synthetic Construct
  source 1..25: mol_type = other DNA
tgactatttgactggtcctggtaac

SEQ ID NO: 1439 - DNA, 23 bp, synthetic construct
  misc_feature 1..23: note = Synthetic Construct
  source 1..23: mol_type = other DNA
gggacttgaccttgcttccacaa

SEQ ID NO: 1440 - DNA, 20 bp, synthetic construct
  misc_feature 1..20: note = Synthetic Construct
  source 1..20: mol_type = other DNA
aagtaccgccctcgtctgtt

SEQ ID NO: 1441 - DNA, 20 bp, synthetic construct
  misc_feature 1..20: note = Synthetic Construct
  source 1..20: mol_type = other DNA
tgccatggcgtgttggatct

SEQ ID NO: 1442 - DNA, 21 bp, synthetic construct
  misc_feature 1..21: note = Synthetic Construct
  source 1..21: mol_type = other DNA
agagacccttggcaggtgcat

SEQ ID NO: 1443 - DNA, 23 bp, synthetic construct
  misc_feature 1..23: note = Synthetic Construct
  source 1..23: mol_type = other DNA
cacattagtctgggagcttggtt

SEQ ID NO: 1444 - DNA, 23 bp, synthetic construct
  misc_feature 1..23: note = Synthetic Construct
  source 1..23: mol_type = other DNA
ccccagtactcaggggactttgt

SEQ ID NO: 1445 - DNA, 19 bp, synthetic construct
  misc_feature 1..19: note = Synthetic Construct
  source 1..19: mol_type = other DNA
gatgggccatgtggcttct

SEQ ID NO: 1446 - DNA, 21 bp, synthetic construct
  misc_feature 1..21: note = Synthetic Construct
  source 1..21: mol_type = other DNA
tctccccagtggagcttatgt

SEQ ID NO: 1447 - DNA, 20 bp, synthetic construct
  misc_feature 1..20: note = Synthetic Construct
  source 1..20: mol_type = other DNA
caccaacaagctggctctga

SEQ ID NO: 1448 - DNA, 19 bp, synthetic construct
  misc_feature 1..19: note = Synthetic Construct
  source 1..19: mol_type = other DNA
cggctccaagttcccacat

SEQ ID NO: 1449 - DNA, 21 bp, synthetic construct
  misc_feature 1..21: note = Synthetic Construct
  source 1..21: mol_type = other DNA
tgtccaaggttgaggggttgt

SEQ ID NO: 1450 - DNA, 23 bp, synthetic construct
  misc_feature 1..23: note = Synthetic Construct
  source 1..23: mol_type = other DNA
ctggaatggctgttaggcacctt

SEQ ID NO: 1451 - DNA, 27 bp, synthetic construct
  misc_feature 1..27: note = Synthetic Construct
  source 1..27: mol_type = other DNA
gcacataactgtacctcctaagccata

SEQ ID NO: 1452 - DNA, 25 bp, synthetic construct
  misc_feature 1..25: note = Synthetic Construct
  source 1..25: mol_type = other DNA
gggaaagcaatgctgtgtgtttatg

SEQ ID NO: 1453 - DNA, 21 bp, synthetic construct
  misc_feature 1..21: note = Synthetic Construct
  source 1..21: mol_type = other DNA
tcccacagtcaggccaaccat

SEQ ID NO: 1454 - DNA, 21 bp, synthetic construct
  misc_feature 1..21: note = Synthetic Construct
  source 1..21: mol_type = other DNA
acagctggacccagggaagtt

SEQ ID NO: 1455 - DNA, 22 bp, synthetic construct
  misc_feature 1..22: note = Synthetic Construct
  source 1..22: mol_type = other DNA
cctggtggcataagggatgctt

SEQ ID NO: 1456 - DNA, 23 bp, synthetic construct
  misc_feature 1..23: note = Synthetic Construct
  source 1..23: mol_type = other DNA
gatgttggtactcgcttctcagt

SEQ ID NO: 1457 - DNA, 25 bp, synthetic construct
  misc_feature 1..25: note = Synthetic Construct
  source 1..25: mol_type = other DNA
gggttactaaagggcagttctgttc

SEQ ID NO: 1458 - DNA, 21 bp, synthetic construct
  misc_feature 1..21: note = Synthetic Construct
  source 1..21: mol_type = other DNA
tcctaggctgaccagtgtcat

SEQ ID NO: 1459 - DNA, 21 bp, synthetic construct
  misc_feature 1..21: note = Synthetic Construct
  source 1..21: mol_type = other DNA
gcctttccccagtccatttct

SEQ ID NO: 1460 - DNA, 21 bp, synthetic construct
  misc_feature 1..21: note = Synthetic Construct
  source 1..21: mol_type = other DNA
tgtctttcaccagcccagact

SEQ ID NO: 1461 - DNA, 26 bp, synthetic construct
  misc_feature 1..26: note = Synthetic Construct
  source 1..26: mol_type = other DNA
cgtgtgagaaaaacctctcctactac

SEQ ID NO: 1462 - DNA, 25 bp, synthetic construct
  misc_feature 1..25: note = Synthetic Construct
  source 1..25: mol_type = other DNA
tgtccaacagctttacatagcacat

SEQ ID NO: 1463 - DNA, 21 bp, synthetic construct
  misc_feature 1..21: note = Synthetic Construct
  source 1..21: mol_type = other DNA
cagaagcagtgagctgtggtt

SEQ ID NO: 1464 - DNA, 20 bp, synthetic construct
  misc_feature 1..20: note = Synthetic Construct
  source 1..20: mol_type = other DNA
ctgggcctgcagaaatgcta

SEQ ID NO: 1465 - DNA, 22 bp, synthetic construct
  misc_feature 1..22: note = Synthetic Construct
  source 1..22: mol_type = other DNA
cactgaggcgatgctctgatct

SEQ ID NO: 1466 - DNA, 24 bp, synthetic construct
  misc_feature 1..24: note = Synthetic Construct
  source 1..24: mol_type = other DNA
tggcctccttctctaaaagcattc

SEQ ID NO: 1467 - DNA, 23 bp, synthetic construct
  misc_feature 1..23: note = Synthetic Construct
  source 1..23: mol_type = other DNA
cactcacaactcctttcccaagt

SEQ ID NO: 1468 - DNA, 19 bp, synthetic construct
  misc_feature 1..19: note = Synthetic Construct
  source 1..19: mol_type = other DNA
gcgtgggcaaagcctccat

SEQ ID NO: 1469 - DNA, 20 bp, synthetic construct
  misc_feature 1..20: note = Synthetic Construct
  source 1..20: mol_type = other DNA
atccactgccctgaccttgt

SEQ ID NO: 1470 - DNA, 20 bp, synthetic construct
  misc_feature 1..20: note = Synthetic Construct
  source 1..20: mol_type = other DNA
actccaaaccccacctgcta

SEQ ID NO: 1471 - DNA, 22 bp, synthetic construct
  misc_feature 1..22: note = Synthetic Construct
  source 1..22: mol_type = other DNA
gggtcctaaccctcagtcttgt

SEQ ID NO: 1472 - DNA, 21 bp, synthetic construct
  misc_feature 1..21: note = Synthetic Construct
  source 1..21: mol_type = other DNA
acagggctcctggttctaact

SEQ ID NO: 1473 - DNA, 23 bp, synthetic construct
  misc_feature 1..23: note = Synthetic Construct
  source 1..23: mol_type = other DNA
ctctaggagcatgggtcaccaaa

SEQ ID NO: 1474 - DNA, 18 bp, synthetic construct
  misc_feature 1..18: note = Synthetic Construct
  source 1..18: mol_type = other DNA
aagccggcaggctgagtt

SEQ ID NO: 1475 - DNA, 22 bp, synthetic construct
  misc_feature 1..22: note = Synthetic Construct
  source 1..22: mol_type = other DNA
ggagccacaaggaatgcagagt

SEQ ID NO: 1476 - DNA, 20 bp, synthetic construct
  misc_feature 1..20: note = Synthetic Construct
  source 1..20: mol_type = other DNA
caagaccctgccacctctct

SEQ ID NO: 1477 - DNA, 18 bp, synthetic construct
  misc_feature 1..18: note = Synthetic Construct
  source 1..18: mol_type = other DNA
ggtgcagccttgctcact

SEQ ID NO: 1478 - DNA, 21 bp, synthetic construct
  misc_feature 1..21: note = Synthetic Construct
  source 1..21: mol_type = other DNA
gcggaaggtggaagaaccttt

SEQ ID NO: 1479 - DNA, 24 bp, synthetic construct
  misc_feature 1..24: note = Synthetic Construct
  source 1..24: mol_type = other DNA
gggcacactgaagtctagaagcaa

SEQ ID NO: 1480 - DNA, 21 bp, synthetic construct
  misc_feature 1..21: note = Synthetic Construct
  source 1..21: mol_type = other DNA
tgggcccatctcttgactttc

SEQ ID NO: 1481 - DNA, 22 bp, synthetic construct
  misc_feature 1..22: note = Synthetic Construct
  source 1..22: mol_type = other DNA
gaaggatgagcggatggctcta

SEQ ID NO: 1482 - DNA, 25 bp, synthetic construct
  misc_feature 1..25: note = Synthetic Construct
  source 1..25: mol_type = other DNA
gcagtacttggggtcgtatatctgt

SEQ ID NO: 1483 - DNA, 21 bp, synthetic construct
  misc_feature 1..21: note = Synthetic Construct
  source 1..21: mol_type = other DNA
tccacctacctgtgggcaatc

SEQ ID NO: 1484 - DNA, 21 bp, synthetic construct
  misc_feature 1..21: note = Synthetic Construct
  source 1..21: mol_type = other DNA
cccgggtacaacagtgacctt

SEQ ID NO: 1485 - DNA, 22 bp, synthetic construct
  misc_feature 1..22: note = Synthetic Construct
  source 1..22: mol_type = other DNA
tctcccggaaagtccggttcta

SEQ ID NO: 1486 - DNA, 22 bp, synthetic construct
  misc_feature 1..22: note = Synthetic Construct
  source 1..22: mol_type = other DNA
cacccaagctctcactgttact

SEQ ID NO: 1487 - DNA, 19 bp, synthetic construct
  misc_feature 1..19: note = Synthetic Construct
  source 1..19: mol_type = other DNA
gggccagctgaccaactac

SEQ ID NO: 1488 - DNA, 20 bp, synthetic construct
  misc_feature 1..20: note = Synthetic Construct
  source 1..20: mol_type = other DNA
ctccctgaagcagcagcaaa

SEQ ID NO: 1489 - DNA, 22 bp, synthetic construct
  misc_feature 1..22: note = Synthetic Construct
  source 1..22: mol_type = other DNA
gctgtcacactgaccctggatt

SEQ ID NO: 1490 - DNA, 20 bp, synthetic construct
  misc_feature 1..20: note = Synthetic Construct
  source 1..20: mol_type = other DNA
gccatgctgagagcctctgt

SEQ ID NO: 1491 - DNA, 24 bp, synthetic construct
  misc_feature 1..24: note = Synthetic Construct
  source 1..24: mol_type = other DNA
gtccacgtgtggaacatgtttatt

SEQ ID NO: 1492 - DNA, 24 bp, synthetic construct
  misc_feature 1..24: note = Synthetic Construct
  source 1..24: mol_type = other DNA
gcaaggagctgatctcatctgtgt

SEQ ID NO: 1493 - DNA, 22 bp, synthetic construct
  misc_feature 1..22: note = Synthetic Construct
  source 1..22: mol_type = other DNA
caaagggctccttccccacaaa

SEQ ID NO: 1494 - DNA, 20 bp, synthetic construct
  misc_feature 1..20: note = Synthetic Construct
  source 1..20: mol_type = other DNA
gggaagcctttgagggttgt

SEQ ID NO: 1495 - DNA, 20 bp, synthetic construct
  misc_feature 1..20: note = Synthetic Construct
  source 1..20: mol_type = other DNA
tctgcacccctgccctgtgt

SEQ ID NO: 1496 - DNA, 22 bp, synthetic construct
  misc_feature 1..22: note = Synthetic Construct
  source 1..22: mol_type = other DNA
tccccagagtgcacaactcctt

SEQ ID NO: 1497 - DNA, 23 bp, synthetic construct
  misc_feature 1..23: note = Synthetic Construct
  source 1..23: mol_type = other DNA
gtttggctgcacgtagagaaaag

SEQ ID NO: 1498 - DNA, 19 bp, synthetic construct
  misc_feature 1..19: note = Synthetic Construct
  source 1..19: mol_type = other DNA
gttggcactggggccttct

SEQ ID NO: 1499 - DNA, 24 bp, synthetic construct
  misc_feature 1..24: note = Synthetic Construct
  source 1..24: mol_type = other DNA
gactcagtcagtagagagggagaa

SEQ ID NO: 1500 - DNA, 20 bp, synthetic construct
  misc_feature 1..20: note = Synthetic Construct
  source 1..20: mol_type = other DNA
cgtggggagggagaccactt

SEQ ID NO: 1501 - DNA, 25 bp, synthetic construct
  misc_feature 1..25: note = Synthetic Construct
  source 1..25: mol_type = other DNA
tcttcttttgacagactgggaacat

SEQ ID NO: 1502 - DNA, 22 bp, synthetic construct
  misc_feature 1..22: note = Synthetic Construct
  source 1..22: mol_type = other DNA
accttctgaggtttggggtaga

SEQ ID NO: 1503 - DNA, 22 bp, synthetic construct
  misc_feature 1..22: note = Synthetic Construct
  source 1..22: mol_type = other DNA
tgtaaggctaagccgcattttg

SEQ ID NO: 1504 - DNA, 22 bp, synthetic construct
  misc_feature 1..22: note = Synthetic Construct
  source 1..22: mol_type = other DNA
tgaccagaaccactcggacaga

SEQ ID NO: 1505 - DNA, 20 bp, synthetic construct
  misc_feature 1..20: note = Synthetic Construct
  source 1..20: mol_type = other DNA
acaggcccactgccctgtct

SEQ ID NO: 1506 - DNA, 20 bp, synthetic construct
  misc_feature 1..20: note = Synthetic Construct
  source 1..20: mol_type = other DNA
gctgacggctggaatcatct

SEQ ID NO: 1507 - DNA, 24 bp, synthetic construct
  misc_feature 1..24: note = Synthetic Construct
  source 1..24: mol_type = other DNA
agctcaggtaaaaggtcaaagaca

SEQ ID NO: 1508 - DNA, 21 bp, synthetic construct
  misc_feature 1..21: note = Synthetic Construct
  source 1..21: mol_type = other DNA
gcaggccagtaacgtcaattc

SEQ ID NO: 1509 - DNA, 22 bp, synthetic construct
  misc_feature 1..22: note = Synthetic Construct
  source 1..22: mol_type = other DNA
agtgcttcaagcctgagattgt

SEQ ID NO: 1510 - DNA, 21 bp, synthetic construct
  misc_feature 1..21: note = Synthetic Construct
  source 1..21: mol_type = other DNA
cccggttccctccttctccat

SEQ ID NO: 1511 - DNA, 22 bp, synthetic construct
  misc_feature 1..22: note = Synthetic Construct
  source 1..22: mol_type = other DNA
ggtgaccgatggcactgaatgt

SEQ ID NO: 1512 - DNA, 22 bp, synthetic construct
  misc_feature 1..22: note = Synthetic Construct
  source 1..22: mol_type = other DNA
caccctgatcacctgggaaaag

SEQ ID NO: 1513 - DNA, 21 bp, synthetic construct
  misc_feature 1..21: note = Synthetic Construct
  source 1..21: mol_type = other DNA
tgctgtcagccactctacaca

SEQ ID NO: 1514 - DNA, 24 bp, synthetic construct
  misc_feature 1..24: note = Synthetic Construct
  source 1..24: mol_type = other DNA
ttcccttaatgcaatggaggtcaa

SEQ ID NO: 1515 - DNA, 20 bp, synthetic construct
  misc_feature 1..20: note = Synthetic Construct
  source 1..20: mol_type = other DNA
caagcttgctccctgacact

SEQ ID NO: 1516 - DNA, 20 bp, synthetic construct
  misc_feature 1..20: note = Synthetic Construct
  source 1..20: mol_type = other DNA
aggcagtgccaggtcctgaa

SEQ ID NO: 1517 - DNA, 22 bp, synthetic construct
  misc_feature 1..22: note = Synthetic Construct
  source 1..22: mol_type = other DNA
tccttccagggttcgtttgttt

SEQ ID NO: 1518 - DNA, 24 bp, synthetic construct
  misc_feature 1..24: note = Synthetic Construct
  source 1..24: mol_type = other DNA
gcagttaccagggacattactgaa

SEQ ID NO: 1519 - DNA, 24 bp, synthetic construct
  misc_feature 1..24: note = Synthetic Construct
  source 1..24: mol_type = other DNA
ggacctgaagtggatgagctttgt

SEQ ID NO: 1520 - DNA, 20 bp, synthetic construct
  misc_feature 1..20: note = Synthetic Construct
  source 1..20: mol_type = other DNA
agccctggaccagattgaga

SEQ ID NO: 1521 - DNA, 24 bp, synthetic construct
  misc_feature 1..24: note = Synthetic Construct
  source 1..24: mol_type = other DNA
gcagaaggagcacctctctccata

SEQ ID NO: 1522 - DNA, 20 bp, synthetic construct
  misc_feature 1..20: note = Synthetic Construct
  source 1..20: mol_type = other DNA
gtcacagccatccagtgcaa

SEQ ID NO: 1523 - DNA, 20 bp, synthetic construct
  misc_feature 1..20: note = Synthetic Construct
  source 1..20: mol_type = other DNA
gagcgagccttgccttgtta

SEQ ID NO: 1524 - DNA, 22 bp, synthetic construct
  misc_feature 1..22: note = Synthetic Construct
  source 1..22: mol_type = other DNA
aaggctagagtgggaactgact

SEQ ID NO: 1525 - DNA, 23 bp, synthetic construct
  misc_feature 1..23: note = Synthetic Construct
  source 1..23: mol_type = other DNA
acattgttcatggaggagtgcaa

SEQ ID NO: 1526 - DNA, 24 bp, synthetic construct
  misc_feature 1..24: note = Synthetic Construct
  source 1..24: mol_type = other DNA
gagggaaactgaagatggagcttt

SEQ ID NO: 1527 - DNA, 19 bp, synthetic construct
  misc_feature 1..19: note = Synthetic Construct
  source 1..19: mol_type = other DNA
caagggctggggctcacat

SEQ ID NO: 1528 - DNA, 20 bp, synthetic construct
  misc_feature 1..20: note = Synthetic Construct
  source 1..20: mol_type = other DNA
cagacacagtcagcgtccat

SEQ ID NO: 1529 - DNA, 23 bp, synthetic construct
  misc_feature 1..23: note = Synthetic Construct
  source 1..23: mol_type = other DNA
tgttcttcagaatgtgccgtttc

SEQ ID NO: 1530 - DNA, 23 bp, synthetic construct
  misc_feature 1..23: note = Synthetic Construct
  source 1..23: mol_type = other DNA
ctgcaaaaatcctgacccagtct

SEQ ID NO: 1531 - DNA, 20 bp, synthetic construct
  misc_feature 1..20: note = Synthetic Construct
  source 1..20: mol_type = other DNA
ccaccttgttggctctgagt

SEQ ID NO: 1532 - DNA, 20 bp, synthetic construct
  misc_feature 1..20: note = Synthetic Construct
  source 1..20: mol_type = other DNA
cctggagcggctgtctcata

SEQ ID NO: 1533 - DNA, 27 bp, synthetic construct
  misc_feature 1..27: note = Synthetic Construct
  source 1..27: mol_type = other DNA
cagtctgtctgaacccatttacaccaa

SEQ ID NO: 1534 - DNA, 24 bp, synthetic construct
  misc_feature 1..24: note = Synthetic Construct
  source 1..24: mol_type = other DNA
cagtgtgagtgctgagaaacaaag

SEQ ID NO: 1535 - DNA, 22 bp, synthetic construct
  misc_feature 1..22: note = Synthetic Construct
  source 1..22: mol_type = other DNA
cacccctgggaaggatggaaat

SEQ ID NO: 1536 - DNA, 18 bp, synthetic construct
  misc_feature 1..18: note = Synthetic Construct
  source 1..18: mol_type = other DNA
agggctgcatgccacaga

SEQ ID NO: 1537 - DNA, 23 bp, synthetic construct
  misc_feature 1..23: note = Synthetic Construct
  source 1..23: mol_type = other DNA
cctgtactcccttccctggtatc

SEQ ID NO: 1538 - DNA, 19 bp, synthetic construct
  misc_feature 1..19: note = Synthetic Construct
  source 1..19: mol_type = other DNA
tctctgtgccaggctgtgt

SEQ ID NO: 1539 - DNA, 22 bp, synthetic construct
  misc_feature 1..22: note = Synthetic Construct
  source 1..22: mol_type = other DNA
tctgagacttcctcccttgtga

SEQ ID NO: 1540 - DNA, 24 bp, synthetic construct
  misc_feature 1..24: note = Synthetic Construct
  source 1..24: mol_type = other DNA
cctcatggtcggtcttggtgactt

SEQ ID NO: 1541 - DNA, 19 bp, synthetic construct
  misc_feature 1..19: note = Synthetic Construct
  source 1..19: mol_type = other DNA
agacggagagcccctgttg

SEQ ID NO: 1542 - DNA, 24 bp, synthetic construct
  misc_feature 1..24: note = Synthetic Construct
  source 1..24: mol_type = other DNA
catgggtacaagctccaattcctt

SEQ ID NO: 1543 - DNA, 24 bp, synthetic construct
  misc_feature 1..24: note = Synthetic Construct
  source 1..24: mol_type = other DNA
gagggaaagggttggggaaaaatc

SEQ ID NO: 1544 - DNA, 24 bp, synthetic construct
  misc_feature 1..24: note = Synthetic Construct
  source 1..24: mol_type = other DNA
gcactagaaagggaaggaactaca

SEQ ID NO: 1545 - DNA, 22 bp, synthetic construct
  misc_feature 1..22: note = Synthetic Construct
  source 1..22: mol_type = other DNA
gaggtaagccttgggcatttct

SEQ ID NO: 1546 - DNA, 21 bp, synthetic construct
  misc_feature 1..21: note = Synthetic Construct
  source 1..21: mol_type = other DNA
gtgaggtgatgggcagactac

SEQ ID NO: 1547 - DNA, 22 bp, synthetic construct
  misc_feature 1..22: note = Synthetic Construct
  source 1..22: mol_type = other DNA
ccttaccagcaggccttcacaa

SEQ ID NO: 1548 - DNA, 22 bp, synthetic construct
  misc_feature 1..22: note = Synthetic Construct
  source 1..22: mol_type = other DNA
tacccacccacccagtcccatt

SEQ ID NO: 1549 - DNA, 23 bp, synthetic construct
  misc_feature 1..23: note = Synthetic Construct
  source 1..23: mol_type = other DNA
cgaacttgctgggagtgtagaac

SEQ ID NO: 1550 - DNA, 22 bp, synthetic construct
  misc_feature 1..22: note = Synthetic Construct
  source 1..22: mol_type = other DNA
ctgtggtccttggtgtcagaga

SEQ ID NO: 1551 - DNA, 22 bp, synthetic construct
  misc_feature 1..22: note = Synthetic Construct
  source 1..22: mol_type = other DNA
ccaaggggctacagtgacaaca

SEQ ID NO: 1552 - DNA, 22 bp, synthetic construct
  misc_feature 1..22: note = Synthetic Construct
  source 1..22: mol_type = other DNA
cagcagtgtggcctttctctac

SEQ ID NO: 1553 - DNA, 20 bp, synthetic construct
  misc_feature 1..20: note = Synthetic Construct
  source 1..20: mol_type = other DNA
tgccacacggagcttgtttc

SEQ ID NO: 1554 - DNA, 25 bp, synthetic construct
  misc_feature 1..25: note = Synthetic Construct
  source 1..25: mol_type = other DNA
caccatgtacttgcactctcagaaa

SEQ ID NO: 1555 - DNA, 20 bp, synthetic construct
  misc_feature 1..20: note = Synthetic Construct
  source 1..20: mol_type = other DNA
cgccaacgtggctgatgttt

SEQ ID NO: 1556 - DNA, 22 bp, synthetic construct
  misc_feature 1..22: note = Synthetic Construct
  source 1..22: mol_type = other DNA
cctggccttactcttcctgagt

SEQ ID NO: 1557 - DNA, 23 bp, synthetic construct
  misc_feature 1..23: note = Synthetic Construct
  source 1..23: mol_type = other DNA
gacttcctgcaagcatttcaaca

SEQ ID NO: 1558 - DNA, 21 bp, synthetic construct
  misc_feature 1..21: note = Synthetic Construct
  source 1..21: mol_type = other DNA
tcaagccaggagacccataca

SEQ ID NO: 1559 - DNA, 22 bp, synthetic construct
  misc_feature 1..22: note = Synthetic Construct
  source 1..22: mol_type = other DNA
cccggaagcactagctcgtaag

SEQ ID NO: 1560 - DNA, 21 bp, synthetic construct
  misc_feature 1..21: note = Synthetic Construct
  source 1..21: mol_type = other DNA
cgctcgcagctttgactgtag

SEQ ID NO: 1561 - DNA, 22 bp, synthetic construct
  misc_feature 1..22: note = Synthetic Construct
  source 1..22: mol_type = other DNA
gcgtctggtctgtgagggtaga

SEQ ID NO: 1562 - DNA, 23 bp, synthetic construct
  misc_feature 1..23: note = Synthetic Construct
  source 1..23: mol_type = other DNA
gagcgtggagagaaaagcaatgt

SEQ ID NO: 1563 - DNA, 21 bp, synthetic construct
  misc_feature 1..21: note = Synthetic Construct
  source 1..21: mol_type = other DNA
cgataagcccgtgttcctgtt

SEQ ID NO: 1564 - DNA, 21 bp, synthetic construct
  misc_feature 1..21: note = Synthetic Construct
  source 1..21: mol_type = other DNA
acgctggatctccaggacact

SEQ ID NO: 1565 - DNA, 24 bp, synthetic construct
  misc_feature 1..24: note = Synthetic Construct
  source 1..24: mol_type = other DNA
caccctcttccctgttaaaggatt

SEQ ID NO: 1566 - DNA, 25 bp, synthetic construct
  misc_feature 1..25: note = Synthetic Construct
  source 1..25: mol_type = other DNA
gctgattctgtgcaaagtccagtgt

SEQ ID NO: 1567 - DNA, 22 bp, synthetic construct
  misc_feature 1..22: note = Synthetic Construct
  source 1..22: mol_type = other DNA
cgatgaaaggctgggagctgaa

SEQ ID NO: 1568 - DNA, 20 bp, synthetic construct
  misc_feature 1..20: note = Synthetic Construct
  source 1..20: mol_type = other DNA
ccggccactggctgctatac

SEQ ID NO: 1569 - DNA, 22 bp, synthetic construct
  misc_feature 1..22: note = Synthetic Construct
  source 1..22: mol_type = other DNA
ctctgcatgtggagcaaaccaa

SEQ ID NO: 1570 - DNA, 21 bp, synthetic construct
  misc_feature 1..21: note = Synthetic Construct
  source 1..21: mol_type = other DNA
aggtaaggggaggctgcagaa

SEQ ID NO: 1571 - DNA, 23 bp, synthetic construct
  misc_feature 1..23: note = Synthetic Construct
  source 1..23: mol_type = other DNA
gctagataatgctgcctgctttg

SEQ ID NO: 1572 - DNA, 26 bp, synthetic construct
  misc_feature 1..26: note = Synthetic Construct
  source 1..26: mol_type = other DNA
ctgaaaagatcactaccaggatgcta

SEQ ID NO: 1573 - DNA, 22 bp, synthetic construct
  misc_feature 1..22: note = Synthetic Construct
  source 1..22: mol_type = other DNA
agacaacagcgttgcttgagta

SEQ ID NO: 1574 - DNA, 23 bp, synthetic construct
  misc_feature 1..23: note = Synthetic Construct
  source 1..23: mol_type = other DNA
agggagagcctctgatgaaaagt

SEQ ID NO: 1575 - DNA, 22 bp, synthetic construct
  misc_feature 1..22: note = Synthetic Construct
  source 1..22: mol_type = other DNA
ccagtgtaggctcacattctgt

SEQ ID NO: 1576 - DNA, 22 bp, synthetic construct
  misc_feature 1..22: note = Synthetic Construct
  source 1..22: mol_type = other DNA
cccaggagtctctgtccattgt

SEQ ID NO: 1577 - DNA, 22 bp, synthetic construct
  misc_feature 1..22: note = Synthetic Construct
  source 1..22: mol_type = other DNA
tcctggtgtggacgtgtctcat

SEQ ID NO: 1578 - DNA, 22 bp, synthetic construct
  misc_feature 1..22: note = Synthetic Construct
  source 1..22: mol_type = other DNA
cgtcaggggtcccttctttttg

SEQ ID NO: 1579 - DNA, 24 bp, synthetic construct
  misc_feature 1..24: note = Synthetic Construct
  source 1..24: mol_type = other DNA
gccagagccttcatttgggagaaa

SEQ ID NO: 1580 - DNA, 19 bp, synthetic construct
  misc_feature 1..19: note = Synthetic Construct
  source 1..19: mol_type = other DNA
tgggcctcctccagccttt

SEQ ID NO: 1581 - DNA, 23 bp, synthetic construct
  misc_feature 1..23: note = Synthetic Construct
  source 1..23: mol_type = other DNA
gttttcccaggcctctcttcttc

SEQ ID NO: 1582 - DNA, 23 bp, synthetic construct
  misc_feature 1..23: note = Synthetic Construct
  source 1..23: mol_type = other DNA
gggatgtacccaaaggcttctct

SEQ ID NO: 1583 - DNA, 22 bp, synthetic construct
  misc_feature 1..22: note = Synthetic Construct
  source 1..22: mol_type = other DNA
ggtgcttcacagggttcacagt

SEQ ID NO: 1584 - DNA, 20 bp, synthetic construct
  misc_feature 1..20: note = Synthetic Construct
  source 1..20: mol_type = other DNA
agccagcaggtgccattcat

SEQ ID NO: 1585 - DNA, 23 bp, synthetic construct
  misc_feature 1..23: note = Synthetic Construct
  source 1..23: mol_type = other DNA
gggaagtaaacatcccagcttca

SEQ ID NO: 1586 - DNA, 21 bp, synthetic construct
  misc_feature 1..21: note = Synthetic Construct
  source 1..21: mol_type = other DNA
gcagttctccctgcaggcttt

SEQ ID NO: 1587 - DNA, 27 bp, synthetic construct
  misc_feature 1..27: note = Synthetic Construct
  source 1..27: mol_type = other DNA
cttcccgtattgctaaggaactattct

SEQ ID NO: 1588 - DNA, 22 bp, synthetic construct
  misc_feature 1..22: note = Synthetic Construct
  source 1..22: mol_type = other DNA
ctgtgcagcagaggcagttatg

SEQ ID NO: 1589 - DNA, 21 bp, synthetic construct
  misc_feature 1..21: note = Synthetic Construct
  source 1..21: mol_type = other DNA
gggcctcgaaaggcagaaatc

SEQ ID NO: 1590 - DNA, 22 bp, synthetic construct
  misc_feature 1..22: note = Synthetic Construct
  source 1..22: mol_type = other DNA
gcatccatccgggcagttttca

SEQ ID NO: 1591 - DNA, 26 bp, synthetic construct
  misc_feature 1..26: note = Synthetic Construct
  source 1..26: mol_type = other DNA
gaagagcaggagctacttctatccat

SEQ ID NO: 1592 - DNA, 24 bp, synthetic construct
  misc_feature 1..24: note = Synthetic Construct
  source 1..24: mol_type = other DNA
gaccccagactcagtcagtagatg

SEQ ID NO: 1593 - DNA, 24 bp, synthetic construct
  misc_feature 1..24: note = Synthetic Construct
  source 1..24: mol_type = other DNA
caaactggaaaccatacccacttc

SEQ ID NO: 1594 - DNA, 20 bp, synthetic construct
  misc_feature 1..20: note = Synthetic Construct
  source 1..20: mol_type = other DNA
tggggctccaccagccagaa

SEQ ID NO: 1595 - DNA, 22 bp, synthetic construct
  misc_feature 1..22: note = Synthetic Construct
  source 1..22: mol_type = other DNA
gcgtctaacagcctcacccaat

SEQ ID NO: 1596 - DNA, 21 bp, synthetic construct
  misc_feature 1..21: note = Synthetic Construct
  source 1..21: mol_type = other DNA
ctggtgggagtgggcttattt

SEQ ID NO: 1597 - DNA, 28 bp, synthetic construct
  misc_feature 1..28: note = Synthetic Construct
  source 1..28: mol_type = other DNA
gcaagtgttatcagaagtccaccttagt

SEQ ID NO: 1598 - DNA, 24 bp, synthetic construct
  misc_feature 1..24: note = Synthetic Construct
  source 1..24: mol_type = other DNA
tgagccaaagactttccctgtatt

SEQ ID NO: 1599 - DNA, 20 bp, synthetic construct
  misc_feature 1..20: note = Synthetic Construct
  source 1..20: mol_type = other DNA
gccagacgcaggcctagtaa

SEQ ID NO: 1600 - DNA, 20 bp, synthetic construct
  misc_feature 1..20: note = Synthetic Construct
  source 1..20: mol_type = other DNA
tggccacgtcctctccacta

SEQ ID NO: 1601 - DNA, 24 bp, synthetic construct
  misc_feature 1..24: note = Synthetic Construct
  source 1..24: mol_type = other DNA
acagcaggcttaatcctagaggta

SEQ ID NO: 1602 - DNA, 24 bp, synthetic construct
  misc_feature 1..24: note = Synthetic Construct
  source 1..24: mol_type = other DNA
cccagagttgcagtaggacacagt

SEQ ID NO: 1603 - DNA, 19 bp, synthetic construct
  misc_feature 1..19: note = Synthetic Construct
  source 1..19: mol_type = other DNA
ctgcttgccccgacctctt

SEQ ID NO: 1604 - DNA, 19 bp, synthetic construct
  misc_feature 1..19: note = Synthetic Construct
  source 1..19: mol_type = other DNA
tgcccggctcagtttgaat

SEQ ID NO: 1605 - DNA, 23 bp, synthetic construct
  misc_feature 1..23: note = Synthetic Construct
  source 1..23: mol_type = other DNA
ctgccttagggatctgggtgatg

SEQ ID NO: 1606 - DNA, 22 bp, synthetic construct
  misc_feature 1..22: note = Synthetic Construct
  source 1..22: mol_type = other DNA
ggctttggaaggagccatctgt

SEQ ID NO: 1607 - DNA, 20 bp, synthetic construct
  misc_feature 1..20: note = Synthetic Construct
  source 1..20: mol_type = other DNA
ccagcttcagtgtgcaccaa

SEQ ID NO: 1608 - DNA, 25 bp, synthetic construct
  misc_feature 1..25: note = Synthetic Construct
  source 1..25: mol_type = other DNA
cctgagagctgtactgttgctcgaa

SEQ ID NO: 1609 - DNA, 21 bp, synthetic construct
  misc_feature 1..21: note = Synthetic Construct
  source 1..21: mol_type = other DNA
tttcctcactgggtgggatct

SEQ ID NO: 1610 - DNA, 20 bp, synthetic construct
  misc_feature 1..20: note = Synthetic Construct
  source 1..20: mol_type = other DNA
gcgggcaattccacatctga

SEQ ID NO: 1611 - DNA, 22 bp, synthetic construct
  misc_feature 1..22: note = Synthetic Construct
  source 1..22: mol_type = other DNA
ccaactcagggcaagtggttct

SEQ ID NO: 1612 - DNA, 26 bp, synthetic construct
  misc_feature 1..26: note = Synthetic Construct
  source 1..26: mol_type = other DNA
ggttgcaaagtactgtgggaataaag

SEQ ID NO: 1613 - DNA, 22 bp, synthetic construct
  misc_feature 1..22: note = Synthetic Construct
  source 1..22: mol_type = other DNA
gaggacttgggcctttcctatc

SEQ ID NO: 1614 - DNA, 19 bp, synthetic construct
  misc_feature 1..19: note = Synthetic Construct
  source 1..19: mol_type = other DNA
tctgcgatgcgttcctgtt

SEQ ID NO: 1615 - DNA, 20 bp, synthetic construct
  misc_feature 1..20: note = Synthetic Construct
  source 1..20: mol_type = other DNA
gtgaagcttgggctggtttg

SEQ ID NO: 1616 - DNA, 24 bp, synthetic construct
  misc_feature 1..24: note = Synthetic Construct
  source 1..24: mol_type = other DNA
ccatacaaagcaagagtgggaagt

SEQ ID NO: 1617 - DNA, 22 bp, synthetic construct
  misc_feature 1..22: note = Synthetic Construct
  source 1..22: mol_type = other DNA
gggaggggtttccccactaaga

SEQ ID NO: 1618 - DNA, 23 bp, synthetic construct
  misc_feature 1..23: note = Synthetic Construct
  source 1..23: mol_type = other DNA
catcttccaatgtggagctgtca

SEQ ID NO: 1619 - DNA, 19 bp, synthetic construct
  misc_feature 1..19: note = Synthetic Construct
  source 1..19: mol_type = other DNA
cagccgctgactgcctcat

SEQ ID NO: 1620 - DNA, 21 bp, synthetic construct
  misc_feature 1..21: note = Synthetic Construct
  source 1..21: mol_type = other DNA
cgaaaaggggatggtgctttc

SEQ ID NO: 1621 - DNA, 20 bp, synthetic construct
  misc_feature 1..20: note = Synthetic Construct
  source 1..20: mol_type = other DNA
cccctgctggtggtctgttc

SEQ ID NO: 1622 - DNA, 19 bp, synthetic construct
  misc_feature 1..19: note = Synthetic Construct
  source 1..19: mol_type = other DNA
gggcctgggttctccttct

SEQ ID NO: 1623 - DNA, 22 bp, synthetic construct
  misc_feature 1..22: note = Synthetic Construct
  source 1..22: mol_type = other DNA
cagtgcctgtggttctcacact

SEQ ID NO: 1624 - DNA, 23 bp, synthetic construct
  misc_feature 1..23: note = Synthetic Construct
  source 1..23: mol_type = other DNA
gcttacactgacgctgcaactga

SEQ ID NO: 1625 - DNA, 19 bp, synthetic construct
  misc_feature 1..19: note = Synthetic Construct
  source 1..19: mol_type = other DNA
tgccctgcacctctgatct

SEQ ID NO: 1626 - DNA, 20 bp, synthetic construct
  misc_feature 1..20: note = Synthetic Construct
  source 1..20: mol_type = other DNA
ggaggccaccacacctccta

SEQ ID NO: 1627 - DNA, 21 bp, synthetic construct
  misc_feature 1..21: note = Synthetic Construct
  source 1..21: mol_type = other DNA
tctcagccgactcagatcact

SEQ ID NO: 1628 - DNA, 22 bp, synthetic construct
  misc_feature 1..22: note = Synthetic Construct
  source 1..22: mol_type = other DNA
cattctggagtgtgggtggatt

SEQ ID NO: 1629 - DNA, 22 bp, synthetic construct
  misc_feature 1..22: note = Synthetic Construct
  source 1..22: mol_type = other DNA
acggtgaaaaatgaggctgtgt

SEQ ID NO: 1630 - DNA, 19 bp, synthetic construct
  misc_feature 1..19: note = Synthetic Construct
  source 1..19: mol_type = other DNA
ggggacaggaggcatgaga

SEQ ID NO: 1631 - DNA, 20 bp, synthetic construct
  misc_feature 1..20: note = Synthetic Construct
  source 1..20: mol_type = other DNA
tgccactgcgtcatctgtga

SEQ ID NO: 1632 - DNA, 19 bp, synthetic construct
  misc_feature 1..19: note = Synthetic Construct
  source 1..19: mol_type = other DNA
ggcgcctggggacttcatt

SEQ ID NO: 1633 - DNA, 22 bp, synthetic construct
  misc_feature 1..22: note = Synthetic Construct
  source 1..22: mol_type = other DNA
ctctggccccacaaatcaatgt

SEQ ID NO: 1634 - DNA, 24 bp, synthetic construct
  misc_feature 1..24: note = Synthetic Construct
  source 1..24: mol_type = other DNA
accctgtccccaataccctgtatc

SEQ ID NO: 1635 - DNA, 24 bp, synthetic construct
  misc_feature 1..24: note = Synthetic Construct
  source 1..24: mol_type = other DNA
gcctgacctatgaccttcagtaac

SEQ ID NO: 1636 - DNA, 20 bp, synthetic construct
  misc_feature 1..20: note = Synthetic Construct
  source 1..20: mol_type = other DNA
ggagccaccatgacgactgt

SEQ ID NO: 1637 - DNA, 24 bp, synthetic construct
  misc_feature 1..24: note = Synthetic Construct
  source 1..24: mol_type = other DNA
cctgagccctaacaatgatccaaa

SEQ ID NO: 1638 - DNA, 18 bp, synthetic construct
  misc_feature 1..18: note = Synthetic Construct
  source 1..18: mol_type = other DNA
tgagcctcctgcctgcta

SEQ ID NO: 1639 - DNA, 18 bp, synthetic construct
  misc_feature 1..18: note = Synthetic Construct
  source 1..18: mol_type = other DNA
gtgccctttggccaccat

SEQ ID NO: 1640 - DNA, 21 bp, synthetic construct
  misc_feature 1..21: note = Synthetic Construct
  source 1..21: mol_type = other DNA
gctggatgggcagacaggaaa

SEQ ID NO: 1641 - DNA, 19 bp, synthetic construct
  misc_feature 1..19: note = Synthetic Construct
  source 1..19: mol_type = other DNA
acacggccgtccagtcagt

SEQ ID NO: 1642 - DNA, 20 bp, synthetic construct
  misc_feature 1..20: note = Synthetic Construct
  source 1..20: mol_type = other DNA
tgcgtgacaaggggcaagat

SEQ ID NO: 1643 - DNA, 21 bp, synthetic construct
  misc_feature 1..21: note = Synthetic Construct
  source 1..21: mol_type = other DNA
ccaccaggactcgggtcttct

SEQ ID NO: 1644 - DNA, 24 bp, synthetic construct
  misc_feature 1..24: note = Synthetic Construct
  source 1..24: mol_type = other DNA
ggacctccctggatgaagatgaga

SEQ ID NO: 1645 - DNA, 20 bp, synthetic construct
  misc_feature 1..20: note = Synthetic Construct
  source 1..20: mol_type = other DNA
ggggacaccgatgggagaca

SEQ ID NO: 1646 - DNA, 21 bp, synthetic construct
  misc_feature 1..21: note = Synthetic Construct
  source 1..21: mol_type = other DNA
gtggaatgcaggactgtgtct

SEQ ID NO: 1647 - DNA, 23 bp, synthetic construct
  misc_feature 1..23: note = Synthetic Construct
  source 1..23: mol_type = other DNA
ccagaccccttgactctatccaa

SEQ ID NO: 1648 - DNA, 20 bp, synthetic construct
  misc_feature 1..20: note = Synthetic Construct
  source 1..20: mol_type = other DNA
tccacttcagctgcgccaaa

SEQ ID NO: 1649 - DNA, 22 bp, synthetic construct
  misc_feature 1..22: note = Synthetic Construct
  source 1..22: mol_type = other DNA
gtgtgtgatttggcccggatct

SEQ ID NO: 1650 - DNA, 20 bp, synthetic construct
  misc_feature 1..20: note = Synthetic Construct
  source 1..20: mol_type = other DNA
agaagggatcaccccacctt

SEQ ID NO: 1651 - DNA, 24 bp, synthetic construct
  misc_feature 1..24: note = Synthetic Construct
  source 1..24: mol_type = other DNA
ctccgcctcaagtaccttgaattt

SEQ ID NO: 1652 - DNA, 22 bp, synthetic construct
  misc_feature 1..22: note = Synthetic Construct
  source 1..22: mol_type = other DNA
gcttggactcatggtacacgtt

SEQ ID NO: 1653 - DNA, 25 bp, synthetic construct
  misc_feature 1..25: note = Synthetic Construct
  source 1..25: mol_type = other DNA
catcgccactacaattcacctctga

SEQ ID NO: 1654 - DNA, 22 bp, synthetic construct
  misc_feature 1..22: note = Synthetic Construct
  source 1..22: mol_type = other DNA
ctcccttgccactttcctctga

SEQ ID NO: 1655 - DNA, 22 bp, synthetic construct
  misc_feature 1..22: note = Synthetic Construct
  source 1..22: mol_type = other DNA
gccaacaccttgatggcaggtt

SEQ ID NO: 1656 - DNA, 23 bp, synthetic construct
  misc_feature 1..23: note = Synthetic Construct
  source 1..23: mol_type = other DNA
gttatcccatcgattccctgcat

SEQ ID NO: 1657 - DNA, 18 bp, synthetic construct
  misc_feature 1..18: note = Synthetic Construct
  source 1..18: mol_type = other DNA
tgcgaggcagagcacgtt

SEQ ID NO: 1658 - DNA, 24 bp, synthetic construct
  misc_feature 1..24: note = Synthetic Construct
  source 1..24: mol_type = other DNA
ggggatgggttacaatgtatgtct

SEQ ID NO: 1659 - DNA, 23 bp, synthetic construct
  misc_feature 1..23: note = Synthetic Construct
  source 1..23: mol_type = other DNA
gattggggaatgcagcttacaga

SEQ ID NO: 1660 - DNA, 21 bp, synthetic construct
  misc_feature 1..21: note = Synthetic Construct
  source 1..21: mol_type = other DNA
caggctttggggcaacagaga

SEQ ID NO: 1661 - DNA, 21 bp, synthetic construct
  misc_feature 1..21: note = Synthetic Construct
  source 1..21: mol_type = other DNA
ggggcatctgccttctggaat

SEQ ID NO: 1662 - DNA, 22 bp, synthetic construct
  misc_feature 1..22: note = Synthetic Construct
  source 1..22: mol_type = other DNA
cactagagccagctcggaatac

SEQ ID NO: 1663 - DNA, 24 bp, synthetic construct
  misc_feature 1..24: note = Synthetic Construct
  source 1..24: mol_type = other DNA
cggattctcagagagcaagcgtaa

SEQ ID NO: 1664 - DNA, 18 bp, synthetic construct
  misc_feature 1..18: note = Synthetic Construct
  source 1..18: mol_type = other DNA
gctgcacccttggagcat

SEQ ID NO: 1665 - DNA, 21 bp, synthetic construct
  misc_feature 1..21: note = Synthetic Construct
  source 1..21: mol_type = other DNA
tttccgtgccctgaccactct

SEQ ID NO: 1666 - DNA, 22 bp, synthetic construct
  misc_feature 1..22: note = Synthetic Construct
  source 1..22: mol_type = other DNA
gctttcagggtggtgagtgagt

SEQ ID NO: 1667 - DNA, 26 bp, synthetic construct
  misc_feature 1..26: note = Synthetic Construct
  source 1..26: mol_type = other DNA
gccagaggacatatttccaagcaatc

SEQ ID NO: 1668 - DNA, 22 bp, synthetic construct
  misc_feature 1..22: note = Synthetic Construct
  source 1..22: mol_type = other DNA
cacagactcacacgggtgttca

SEQ ID NO: 1669 - DNA, 22 bp, synthetic construct
  misc_feature 1..22: note = Synthetic Construct
  source 1..22: mol_type = other DNA
ccctcaggcaaaatcccataca

SEQ ID NO: 1670 - DNA, 24 bp, synthetic construct
  misc_feature 1..24: note = Synthetic Construct
  source 1..24: mol_type = other DNA
ctctctgtccctctggagtaagaa

SEQ ID NO: 1671 - DNA, 24 bp, synthetic construct
  misc_feature 1..24: note = Synthetic Construct
  source 1..24: mol_type = other DNA
tctctgactaccatcttccactgt

SEQ ID NO: 1672 - DNA, 22 bp, synthetic construct
  misc_feature 1..22: note = Synthetic Construct
  source 1..22: mol_type = other DNA
cgcagcaccatagtcacagcaa

SEQ ID NO: 1673 - DNA, 21 bp, synthetic construct
  misc_feature 1..21: note = Synthetic Construct
  source 1..21: mol_type = other DNA
gccttggatgatggagcaagt

SEQ ID NO: 1674 - DNA, 24 bp, synthetic construct
  misc_feature 1..24: note = Synthetic Construct
  source 1..24: mol_type = other DNA
gtctccaaactgtcctttcctcaa

SEQ ID NO: 1675 - DNA, 22 bp, synthetic construct
  misc_feature 1..22: note = Synthetic Construct
  source 1..22: mol_type = other DNA
aagtgagggctgcaaggagtca

SEQ ID NO: 1676 - DNA, 20 bp, synthetic construct
  misc_feature 1..20: note = Synthetic Construct
  source 1..20: mol_type = other DNA
acgtggtgatctgggagaga

SEQ ID NO: 1677 - DNA, 19 bp, synthetic construct
  misc_feature 1..19: note = Synthetic Construct
  source 1..19: mol_type = other DNA
aggccgaggagctggactt

SEQ ID NO: 1678 - DNA, 24 bp, synthetic construct
  misc_feature 1..24: note = Synthetic Construct
  source 1..24: mol_type = other DNA
caaggtgtgcccaatccaactatc

SEQ ID NO: 1679 - DNA, 19 bp, synthetic construct
  misc_feature 1..19: note = Synthetic Construct
  source 1..19: mol_type = other DNA
ggtggtggtccctcagtct

SEQ ID NO: 1680 - DNA, 19 bp, synthetic construct
  misc_feature 1..19: note = Synthetic Construct
  source 1..19: mol_type = other DNA
aagggcacggccagtaaac

SEQ ID NO: 1681 - DNA, 20 bp, synthetic construct
  misc_feature 1..20: note = Synthetic Construct
  source 1..20: mol_type = other DNA
agcctggggcctgggaatta

SEQ ID NO: 1682 - DNA, 20 bp, synthetic construct
  misc_feature 1..20: note = Synthetic Construct
  source 1..20: mol_type = other DNA
caccgtggctgtgtggagat

SEQ ID NO: 1683 - DNA, 22 bp, synthetic construct
  misc_feature 1..22: note = Synthetic Construct
  source 1..22: mol_type = other DNA
tggagagatgggctctccttag

SEQ ID NO: 1684 - DNA, 24 bp, synthetic construct
  misc_feature 1..24: note = Synthetic Construct
  source 1..24: mol_type = other DNA
ctgcattacctgccctacctatct

SEQ ID NO: 1685 - DNA, 20 bp, synthetic construct
  misc_feature 1..20: note = Synthetic Construct
  source 1..20: mol_type = other DNA
ccctgcgggacttgtggtaa

SEQ ID NO: 1686 - DNA, 23 bp, synthetic construct
  misc_feature 1..23: note = Synthetic Construct
  source 1..23: mol_type = other DNA
cagtggtgtccctaaagcactct

SEQ ID NO: 1687 - DNA, 23 bp, synthetic construct
  misc_feature 1..23: note = Synthetic Construct
  source 1..23: mol_type = other DNA
acggggctgctataaggattaag

SEQ ID NO: 1688 - DNA, 24 bp, synthetic construct
  misc_feature 1..24: note = Synthetic Construct
  source 1..24: mol_type = other DNA
cgacagaggctgtgaatccccaaa

SEQ ID NO: 1689 - DNA, 22 bp, synthetic construct
  misc_feature 1..22: note = Synthetic Construct
  source 1..22: mol_type = other DNA
gccactgatccaggtgacttct

SEQ ID NO: 1690 - DNA, 22 bp, synthetic construct
  misc_feature 1..22: note = Synthetic Construct
  source 1..22: mol_type = other DNA
gccagctcgacagtttcttaca

SEQ ID NO: 1691 - DNA, 20 bp, synthetic construct
  misc_feature 1..20: note = Synthetic Construct
  source 1..20: mol_type = other DNA
agtgggatggggctgctgtt

SEQ ID NO: 1692 - DNA, 23 bp, synthetic construct
  misc_feature 1..23: note = Synthetic Construct
  source 1..23: mol_type = other DNA
gcagagtcccttggtggtgtaag

SEQ ID NO: 1693 - DNA, 21 bp, synthetic construct
  misc_feature 1..21: note = Synthetic Construct
  source 1..21: mol_type = other DNA
caggcccacattctccacaga

SEQ ID NO: 1694 - DNA, 22 bp, synthetic construct
  misc_feature 1..22: note = Synthetic Construct
  source 1..22: mol_type = other DNA
tgcaaacatggacgggtttgat

SEQ ID NO: 1695 - DNA, 24 bp, synthetic construct
  misc_feature 1..24: note = Synthetic Construct
  source 1..24: mol_type = other DNA
gtgttgcagcactaaaacatcaca

SEQ ID NO: 1696 - DNA, 24 bp, synthetic construct
  misc_feature 1..24: note = Synthetic Construct
  source 1..24: mol_type = other DNA
acaaagggaaatccaatggtcact

SEQ ID NO: 1697 - DNA, 20 bp, synthetic construct
  misc_feature 1..20: note = Synthetic Construct
  source 1..20: mol_type = other DNA
gctgggaagctctgcctcaa

SEQ ID NO: 1698 - DNA, 21 bp, synthetic construct
  misc_feature 1..21: note = Synthetic Construct
  source 1..21: mol_type = other DNA
tgggaagtccacccactccaa

SEQ ID NO: 1699 - DNA, 22 bp, synthetic construct
  misc_feature 1..22: note = Synthetic Construct
  source 1..22: mol_type = other DNA
ccacggaggaagaaccagaagt

SEQ ID NO: 1700 - DNA, 20 bp, synthetic construct
  misc_feature 1..20: note = Synthetic Construct
  source 1..20: mol_type = other DNA
atcacccggaggacccatgt

SEQ ID NO: 1701 - DNA, 21 bp, synthetic construct
  misc_feature 1..21: note = Synthetic Construct
  source 1..21: mol_type = other DNA
aggggcctaagtgggctcttc

SEQ ID NO: 1702 - DNA, 22 bp, synthetic construct
  misc_feature 1..22: note = Synthetic Construct
  source 1..22: mol_type = other DNA
gaaaaacgggttagggcagaga

SEQ ID NO: 1703 - DNA, 20 bp, synthetic construct
  misc_feature 1..20: note = Synthetic Construct
  source 1..20: mol_type = other DNA
cggaatgggatgccttggaa

SEQ ID NO: 1704 - DNA, 18 bp, synthetic construct
  misc_feature 1..18: note = Synthetic Construct
  source 1..18: mol_type = other DNA
cactgtcccgctgcagat

SEQ ID NO: 1705 - DNA, 24 bp, synthetic construct
  misc_feature 1..24: note = Synthetic Construct
  source 1..24: mol_type = other DNA
tgtcacagatcagttggtgaatgt

SEQ ID NO: 1706 - DNA, 21 bp, synthetic construct
  misc_feature 1..21: note = Synthetic Construct
  source 1..21: mol_type = other DNA
ccaggacccgagatggtctgt

SEQ ID NO: 1707 - DNA, 23 bp, synthetic construct
  misc_feature 1..23: note = Synthetic Construct
  source 1..23: mol_type = other DNA
agagaccaagggcttctctctaa

SEQ ID NO: 1708 - DNA, 23 bp, synthetic construct
  misc_feature 1..23: note = Synthetic Construct
  source 1..23: mol_type = other DNA
gagggaggtgaatccacgagaga

SEQ ID NO: 1709 - DNA, 20 bp, synthetic construct
  misc_feature 1..20: note = Synthetic Construct
  source 1..20: mol_type = other DNA
agggccaccacggtgagaaa

SEQ ID NO: 1710 - DNA, 22 bp, synthetic construct
  misc_feature 1..22: note = Synthetic Construct
  source 1..22: mol_type = other DNA
agagagccatcctcccttccaa

SEQ ID NO: 1711 - DNA, 23 bp, synthetic construct
  misc_feature 1..23: note = Synthetic Construct
  source 1..23: mol_type = other DNA
acttctgagcaagtgtgatgtga

SEQ ID NO: 1712 - DNA, 22 bp, synthetic construct
  misc_feature 1..22: note = Synthetic Construct
  source 1..22: mol_type = other DNA
ggcgacagttcctctggactta

SEQ ID NO: 1713 - DNA, 22 bp, synthetic construct
  misc_feature 1..22: note = Synthetic Construct
  source 1..22: mol_type = other DNA
cagattggcgacccacccttat

SEQ ID NO: 1714 - DNA, 24 bp, synthetic construct
  misc_feature 1..24: note = Synthetic Construct
  source 1..24: mol_type = other DNA
ggcctttcctaagctgatggttga

SEQ ID NO: 1715 - DNA, 24 bp, synthetic construct
  misc_feature 1..24: note = Synthetic Construct
  source 1..24: mol_type = other DNA
gctggcatctaatgctgccatgtt

SEQ ID NO: 1716 - DNA, 22 bp, synthetic construct
  misc_feature 1..22: note = Synthetic Construct
  source 1..22: mol_type = other DNA
gctgctcagagagaaactgcat

SEQ ID NO: 1717 - DNA, 22 bp, synthetic construct
  misc_feature 1..22: note = Synthetic Construct
  source 1..22: mol_type = other DNA
gatccgcctgagaaggaacaag

SEQ ID NO: 1718 - DNA, 22 bp, synthetic construct
  misc_feature 1..22: note = Synthetic Construct
  source 1..22: mol_type = other DNA
atgccctcgagaccagctagaa

SEQ ID NO: 1719 - DNA, 21 bp, synthetic construct
  misc_feature 1..21: note = Synthetic Construct
  source 1..21: mol_type = other DNA
gaggtttggggtgcgaatgat

SEQ ID NO: 1720 - DNA, 22 bp, synthetic construct
  misc_feature 1..22: note = Synthetic Construct
  source 1..22: mol_type = other DNA
gcagaagttgctggttctgttt

SEQ ID NO: 1721 - DNA, 20 bp, synthetic construct
  misc_feature 1..20: note = Synthetic Construct
  source 1..20: mol_type = other DNA
gggcagaggcaggaccattg

SEQ ID NO: 1722 - DNA, 24 bp, synthetic construct
  misc_feature 1..24: note = Synthetic Construct
  source 1..24: mol_type = other DNA
gctggtattttcgtttctgcatgt

SEQ ID NO: 1723 - DNA, 19 bp, synthetic construct
  misc_feature 1..19: note = Synthetic Construct
  source 1..19: mol_type = other DNA
ttgcccctcctcccctcaa

SEQ ID NO: 1724 - DNA, 23 bp, synthetic construct
  misc_feature 1..23: note = Synthetic Construct
  source 1..23: mol_type = other DNA
acatgcctacacccaaagtcatc

SEQ ID NO: 1725 - DNA, 20 bp, synthetic construct
  misc_feature 1..20: note = Synthetic Construct
  source 1..20: mol_type = other DNA
tgcctggaggaaggaagtca

SEQ ID NO: 1726 - DNA, 23 bp, synthetic construct
  misc_feature 1..23: note = Synthetic Construct
  source 1..23: mol_type = other DNA
ccttccctctggattttgggttt

SEQ ID NO: 1727 - DNA, 20 bp, synthetic construct
  misc_feature 1..20: note = Synthetic Construct
  source 1..20: mol_type = other DNA
agctcctcacccagcctcaa

SEQ ID NO: 1728 - DNA, 21 bp, synthetic construct
  misc_feature 1..21: note = Synthetic Construct
  source 1..21: mol_type = other DNA
acacctgtggaccatgtctga

SEQ ID NO: 1729 - DNA, 22 bp, synthetic construct
  misc_feature 1..22: note = Synthetic Construct
  source 1..22: mol_type = other DNA
gccccaggtatgcttgaccatt

SEQ ID NO: 1730 - DNA, 20 bp, synthetic construct
  misc_feature 1..20: note = Synthetic Construct
  source 1..20: mol_type = other DNA
acccagcaacccacgaaatc

SEQ ID NO: 1731 - DNA, 25 bp, synthetic construct
  misc_feature 1..25: note = Synthetic Construct
  source 1..25: mol_type = other DNA
ggagaccagaacatgacactccaat

SEQ ID NO: 1732 - DNA, 20 bp, synthetic construct
  misc_feature 1..20: note = Synthetic Construct
  source 1..20: mol_type = other DNA
ctgggcaccttgcagctttt

SEQ ID NO: 1733 - DNA, 21 bp, synthetic construct
  misc_feature 1..21: note = Synthetic Construct
  source 1..21: mol_type = other DNA
aggccctgtttccctggaatg

SEQ ID NO: 1734 - DNA, 21 bp, synthetic construct
  misc_feature 1..21: note = Synthetic Construct
  source 1..21: mol_type = other DNA
atctgccgagccaggtcactt

SEQ ID NO: 1735 - DNA, 21 bp, synthetic construct
  misc_feature 1..21: note = Synthetic Construct
  source 1..21: mol_type = other DNA
ggttttgcccaccacctctga

SEQ ID NO: 1736 - DNA, 23 bp, synthetic construct
  misc_feature 1..23: note = Synthetic Construct
  source 1..23: mol_type = other DNA
aaggttgtgctttctctcgctat

SEQ ID NO: 1737 - DNA, 22 bp, synthetic construct
  misc_feature 1..22: note = Synthetic Construct
  source 1..22: mol_type = other DNA
ccttagctcggtcgcctaaact

SEQ ID NO: 1738 - DNA, 23 bp, synthetic construct
  misc_feature 1..23: note = Synthetic Construct
  source 1..23: mol_type = other DNA
cccactatggcaaagatccatca

SEQ ID NO: 1739 - DNA, 20 bp, synthetic construct
  misc_feature 1..20: note = Synthetic Construct
  source 1..20: mol_type = other DNA
tggcacccagtcatctgcta

SEQ ID NO: 1740 - DNA, 23 bp, synthetic construct
  misc_feature 1..23: note = Synthetic Construct
  source 1..23: mol_type = other DNA
catccccgtgtttcaaaggaaag

SEQ ID NO: 1741 - DNA, 23 bp, synthetic construct
  misc_feature 1..23: note = Synthetic Construct
  source 1..23: mol_type = other DNA
aaggacgtacaatttcggagtca

SEQ ID NO: 1742 - DNA, 21 bp, synthetic construct
  misc_feature 1..21: note = Synthetic Construct
  source 1..21: mol_type = other DNA
tccttccctagctgggccttt

SEQ ID NO: 1743 - DNA, 19 bp, synthetic construct
  misc_feature 1..19: note = Synthetic Construct
  source 1..19: mol_type = other DNA
ggggcgataggcacacaca

SEQ ID NO: 1744 - DNA, 22 bp, synthetic construct
  misc_feature 1..22: note = Synthetic Construct
  source 1..22: mol_type = other DNA
ctgacataggtggctggagtga

SEQ ID NO: 1745 - DNA, 22 bp, synthetic construct
  misc_feature 1..22: note = Synthetic Construct
  source 1..22: mol_type = other DNA
ccgcagacagagaagcagtcta

SEQ ID NO: 1746 - DNA, 20 bp, synthetic construct
  misc_feature 1..20: note = Synthetic Construct
  source 1..20: mol_type = other DNA
gactgccgcagctcttgtaa

SEQ ID NO: 1747 - DNA, 22 bp, synthetic construct
  misc_feature 1..22: note = Synthetic Construct
  source 1..22: mol_type = other DNA
gccatggtttagggtcctggat

SEQ ID NO: 1748 - DNA, 20 bp, synthetic construct
  misc_feature 1..20: note = Synthetic Construct
  source 1..20: mol_type = other DNA
ctccccgggtagagcagtga

SEQ ID NO: 1749 - DNA, 22 bp, synthetic construct
  misc_feature 1..22: note = Synthetic Construct
  source 1..22: mol_type = other DNA
cactggggcttccctttacgat

SEQ ID NO: 1750 - DNA, 22 bp, synthetic construct
  misc_feature 1..22: note = Synthetic Construct
  source 1..22: mol_type = other DNA
ccgatggccaaaggctctcaaa

SEQ ID NO: 1751 - DNA, 21 bp, synthetic construct
  misc_feature 1..21: note = Synthetic Construct
  source 1..21: mol_type = other DNA
acacacttcatcacgccttgt

SEQ ID NO: 1752 - DNA, 24 bp, synthetic construct
  misc_feature 1..24: note = Synthetic Construct
  source 1..24: mol_type = other DNA
tccttgatctcccactccattttc

SEQ ID NO: 1753 - DNA, 20 bp, synthetic construct
  misc_feature 1..20: note = Synthetic Construct
  source 1..20: mol_type = other DNA
acctggctggccacttctca

SEQ ID NO: 1754 - DNA, 19 bp, synthetic construct
  misc_feature 1..19: note = Synthetic Construct
  source 1..19: mol_type = other DNA
acctgcctgcctcgtgttc

SEQ ID NO: 1755 - DNA, 20 bp, synthetic construct
  misc_feature 1..20: note = Synthetic Construct
  source 1..20: mol_type = other DNA
aagtctcagggccactccat

SEQ ID NO: 1756 - DNA, 21 bp, synthetic construct
  misc_feature 1..21: note = Synthetic Construct
  source 1..21: mol_type = other DNA
atcaggcccagagagacatga

SEQ ID NO: 1757 - DNA, 22 bp, synthetic construct
  misc_feature 1..22: note = Synthetic Construct
  source 1..22: mol_type = other DNA
ggatgaggggctggcttcatac

SEQ ID NO: 1758 - DNA, 19 bp, synthetic construct
  misc_feature 1..19: note = Synthetic Construct
  source 1..19: mol_type = other DNA
accccagggaagcaagcat

SEQ ID NO: 1759 - DNA, 18 bp, synthetic construct
  misc_feature 1..18: note = Synthetic Construct
  source 1..18: mol_type = other DNA
cgcgtggctgcttgagaa

SEQ ID NO: 1760 - DNA, 23 bp, synthetic construct
  misc_feature 1..23: note = Synthetic Construct
  source 1..23: mol_type = other DNA
agctcaagggaagatgtctccta

SEQ ID NO: 1761 - DNA, 23 bp, synthetic construct
  misc_feature 1..23: note = Synthetic Construct
  source 1..23: mol_type = other DNA
gccctcctcaaagttaggactga

SEQ ID NO: 1762 - DNA, 22 bp, synthetic construct
  misc_feature 1..22: note = Synthetic Construct
  source 1..22: mol_type = other DNA
tcgccctagccctggaaattca

SEQ ID NO: 1763 - DNA, 20 bp, synthetic construct
  misc_feature 1..20: note = Synthetic Construct
  source 1..20: mol_type = other DNA
gggcagtgtccgcaaagttc

SEQ ID NO: 1764 - DNA, 22 bp, synthetic construct
  misc_feature 1..22: note = Synthetic Construct
  source 1..22: mol_type = other DNA
agactccgtcaccctccacaat

SEQ ID NO: 1765 - DNA, 21 bp, synthetic construct
  misc_feature 1..21: note = Synthetic Construct
  source 1..21: mol_type = other DNA
ttgtagccgttccaagagcaa

SEQ ID NO: 1766 - DNA, 24 bp, synthetic construct
  misc_feature 1..24: note = Synthetic Construct
  source 1..24: mol_type = other DNA
ccagaaaacctgtaggcaagatgt

SEQ ID NO: 1767 - DNA, 20 bp, synthetic construct
  misc_feature 1..20: note = Synthetic Construct
  source 1..20: mol_type = other DNA
cgactcacccgctcagcaaa

SEQ ID NO: 1768 - DNA, 19 bp, synthetic construct
  misc_feature 1..19: note = Synthetic Construct
  source 1..19: mol_type = other DNA
ctgccaggcctctctcaca

SEQ ID NO: 1769 - DNA, 20 bp, synthetic construct
  misc_feature 1..20: note = Synthetic Construct
  source 1..20: mol_type = other DNA
cctgtccctgagccctctgt

SEQ ID NO: 1770 - DNA, 20 bp, synthetic construct
  misc_feature 1..20: note = Synthetic Construct
  source 1..20: mol_type = other DNA
acggctggtccttccagtca

SEQ ID NO: 1771 - DNA, 21 bp, synthetic construct
  misc_feature 1..21: note = Synthetic Construct
  source 1..21: mol_type = other DNA
ctcgagcctttgtggacatct

SEQ ID NO: 1772 - DNA, 20 bp, synthetic construct
  misc_feature 1..20: note = Synthetic Construct
  source 1..20: mol_type = other DNA
catgcacactctgcctcgaa

SEQ ID NO: 1773 - DNA, 24 bp, synthetic construct
  misc_feature 1..24: note = Synthetic Construct
  source 1..24: mol_type = other DNA
gccaaatcacctccatcactcaag

SEQ ID NO: 1774 - DNA, 23 bp, synthetic construct
  misc_feature 1..23: note = Synthetic Construct
  source 1..23: mol_type = other DNA
cggacaccaactgtcttgttttg

SEQ ID NO: 1775 - DNA, 20 bp, synthetic construct
  misc_feature 1..20: note = Synthetic Construct
  source 1..20: mol_type = other DNA
ccaccatgcctgttctcact

SEQ ID NO: 1776 - DNA, 25 bp, synthetic construct
  misc_feature 1..25: note = Synthetic Construct
  source 1..25: mol_type = other DNA
gatttagttgcacctttcccaagtt

SEQ ID NO: 1777 - DNA, 20 bp, synthetic construct
  misc_feature 1..20: note = Synthetic Construct
  source 1..20: mol_type = other DNA
tgtgctgccagctgtggtta

SEQ ID NO: 1778 - DNA, 20 bp, synthetic construct
  misc_feature 1..20: note = Synthetic Construct
  source 1..20: mol_type = other DNA
cagcccctcgtttctgttct

SEQ ID NO: 1779 - DNA, 21 bp, synthetic construct
  misc_feature 1..21: note = Synthetic Construct
  source 1..21: mol_type = other DNA
ttcctcttccgccccaacact

SEQ ID NO: 1780 - DNA, 23 bp, synthetic construct
  misc_feature 1..23: note = Synthetic Construct
  source 1..23: mol_type = other DNA
cctctgagacctgaatggtgtga

SEQ ID NO: 1781 - DNA, 21 bp, synthetic construct
  misc_feature 1..21: note = Synthetic Construct
  source 1..21: mol_type = other DNA
ggaagagccgtctccccttga

SEQ ID NO: 1782 - DNA, 19 bp, synthetic construct
  misc_feature 1..19: note = Synthetic Construct
  source 1..19: mol_type = other DNA
acgtggccccagtgtgact

SEQ ID NO: 1783 - DNA, 21 bp, synthetic construct
  misc_feature 1..21: note = Synthetic Construct
  source 1..21: mol_type = other DNA
ggctgcagcagagactgcttt

SEQ ID NO: 1784 - DNA, 23 bp, synthetic construct
  misc_feature 1..23: note = Synthetic Construct
  source 1..23: mol_type = other DNA
ctcaatgagaccgatgcaagttc

SEQ ID NO: 1785 - DNA, 22 bp, synthetic construct
  misc_feature 1..22: note = Synthetic Construct
  source 1..22: mol_type = other DNA
tggacacagaggcagaagagat

SEQ ID NO: 1786 - DNA, 22 bp, synthetic construct
  misc_feature 1..22: note = Synthetic Construct
  source 1..22: mol_type = other DNA
cctcgctagccaactcttctga

SEQ ID NO: 1787 - DNA, 22 bp, synthetic construct
  misc_feature 1..22: note = Synthetic Construct
  source 1..22: mol_type = other DNA
aaggctcccctgcatcctaaag

SEQ ID NO: 1788 - DNA, 26 bp, synthetic construct
  misc_feature 1..26: note = Synthetic Construct
  source 1..26: mol_type = other DNA
ccaggctagacacagaggatgtttac

SEQ ID NO: 1789 - DNA, 23 bp, synthetic construct
  misc_feature 1..23: note = Synthetic Construct
  source 1..23: mol_type = other DNA
agaagcagcatatggtggaaact

SEQ ID NO: 1790 - DNA, 18 bp, synthetic construct
  misc_feature 1..18: note = Synthetic Construct
  source 1..18: mol_type = other DNA
gcgtggtgctggttggaa

SEQ ID NO: 1791 - DNA, 23 bp, synthetic construct
  misc_feature 1..23: note = Synthetic Construct
  source 1..23: mol_type = other DNA
tgctttgctggggatcttttctt

SEQ ID NO: 1792 - DNA, 22 bp, synthetic construct
  misc_feature 1..22: note = Synthetic Construct
  source 1..22: mol_type = other DNA
cctgacccgaatgccaacttca

SEQ ID NO: 1793 - DNA, 19 bp, synthetic construct
  misc_feature 1..19: note = Synthetic Construct
  source 1..19: mol_type = other DNA
ctgatgcccagtgccacat

SEQ ID NO: 1794 - DNA, 21 bp, synthetic construct
  misc_feature 1..21: note = Synthetic Construct
  source 1..21: mol_type = other DNA
acgctggcaggctctcaatag

SEQ ID NO: 1795 - DNA, 20 bp, synthetic construct
  misc_feature 1..20: note = Synthetic Construct
  source 1..20: mol_type = other DNA
gccttggcccctcaaacaag

SEQ ID NO: 1796 - DNA, 21 bp, synthetic construct
  misc_feature 1..21: note = Synthetic Construct
  source 1..21: mol_type = other DNA
tgctacctttggcagggtgta

SEQ ID NO: 1797 - DNA, 22 bp, synthetic construct
  misc_feature 1..22: note = Synthetic Construct
  source 1..22: mol_type = other DNA
agaaggaacggctccagtgatg

SEQ ID NO: 1798 - DNA, 27 bp, synthetic construct
  misc_feature 1..27: note = Synthetic Construct
  source 1..27: mol_type = other DNA
gcctaaggtttttcttaggtcttggta

SEQ ID NO: 1799 - DNA, 24 bp, synthetic construct
  misc_feature 1..24: note = Synthetic Construct
  source 1..24: mol_type = other DNA
ccagaggaagcttgtttgatgaga

SEQ ID NO: 1800 - DNA, 20 bp, synthetic construct
  misc_feature 1..20: note = Synthetic Construct
  source 1..20: mol_type = other DNA
tctccccacacttgcccttt

SEQ ID NO: 1801 - DNA, 19 bp, synthetic construct
  misc_feature 1..19: note = Synthetic Construct
  source 1..19: mol_type = other DNA
gcaggcacctgcagtcaca

SEQ ID NO: 1802 - DNA, 22 bp, synthetic construct
  misc_feature 1..22: note = Synthetic Construct
  source 1..22: mol_type = other DNA
ccagcaaaggctccttccttct

SEQ ID NO: 1803 - DNA, 23 bp, synthetic construct
  misc_feature 1..23: note = Synthetic Construct
  source 1..23: mol_type = other DNA
ccgccaaaatctactgggacttt

SEQ ID NO: 1804 - DNA, 19 bp, synthetic construct
  misc_feature 1..19: note = Synthetic Construct
  source 1..19: mol_type = other DNA
agccctgccgagtgacgat

SEQ ID NO: 1805 - DNA, 23 bp, synthetic construct
  misc_feature 1..23: note = Synthetic Construct
  source 1..23: mol_type = other DNA
ctcccaccacccttcctagaaca

SEQ ID NO: 1806 - DNA, 20 bp, synthetic construct
  misc_feature 1..20: note = Synthetic Construct
  source 1..20: mol_type = other DNA
aggttagagcccctgtgcaa

SEQ ID NO: 1807 - DNA, 23 bp, synthetic construct
  misc_feature 1..23: note = Synthetic Construct
  source 1..23: mol_type = other DNA
ggaaaatgcacggtggaaagaga

SEQ ID NO: 1808 - DNA, 21 bp, synthetic construct
  misc_feature 1..21: note = Synthetic Construct
  source 1..21: mol_type = other DNA
aggtacatgggctcagagaca

SEQ ID NO: 1809 - DNA, 20 bp, synthetic construct
  misc_feature 1..20: note = Synthetic Construct
  source 1..20: mol_type = other DNA
gaggtgggtttgcagtggtt

SEQ ID NO: 1810 - DNA, 23 bp, synthetic construct
  misc_feature 1..23: note = Synthetic Construct
  source 1..23: mol_type = other DNA
tccaccctttcctagcctttctt

SEQ ID NO: 1811 - DNA, 25 bp, synthetic construct
  misc_feature 1..25: note = Synthetic Construct
  source 1..25: mol_type = other DNA
gcaacatagaagcaaggcagttttt

SEQ ID NO: 1812 - DNA, 24 bp, synthetic construct
  misc_feature 1..24: note = Synthetic Construct
  source 1..24: mol_type = other DNA
cacagggcatgatttcctggctta

SEQ ID NO: 1813 - DNA, 20 bp, synthetic construct
  misc_feature 1..20: note = Synthetic Construct
  source 1..20: mol_type = other DNA
atgggcggagttgtgttcaa

SEQ ID NO: 1814 - DNA, 26 bp, synthetic construct
  misc_feature 1..26: note = Synthetic Construct
  source 1..26: mol_type = other DNA
gctacttcccaatttggtttgacaca

SEQ ID NO: 1815 - DNA, 19 bp, synthetic construct
  misc_feature 1..19: note = Synthetic Construct
  source 1..19: mol_type = other DNA
tgctggggcaaggctcaaa

SEQ ID NO: 1816 - DNA, 20 bp, synthetic construct
  misc_feature 1..20: note = Synthetic Construct
  source 1..20: mol_type = other DNA
acatgtgaccccagggatgt

SEQ ID NO: 1817 - DNA, 20 bp, synthetic construct
  misc_feature 1..20: note = Synthetic Construct
  source 1..20: mol_type = other DNA
tggtccctgtcttgcagtct

SEQ ID NO: 1818 - DNA, 23 bp, synthetic construct
  misc_feature 1..23: note = Synthetic Construct
  source 1..23: mol_type = other DNA
cccagaccctggaataggacttg

SEQ ID NO: 1819 - DNA, 19 bp, synthetic construct
  misc_feature 1..19: note = Synthetic Construct
  source 1..19: mol_type = other DNA
agggctgccccttcacctt

SEQ ID NO: 1820 - DNA, 22 bp, synthetic construct
  misc_feature 1..22: note = Synthetic Construct
  source 1..22: mol_type = other DNA
ggctgaggcaaggtttttgcat

SEQ ID NO: 1821 - DNA, 21 bp, synthetic construct
  misc_feature 1..21: note = Synthetic Construct
  source 1..21: mol_type = other DNA
cctccccttctctccactgat

SEQ ID NO: 1822 - DNA, 21 bp, synthetic construct
  misc_feature 1..21: note = Synthetic Construct
  source 1..21: mol_type = other DNA
agtgaccacaggtgcaagaag

SEQ ID NO: 1823 - DNA, 24 bp, synthetic construct
  misc_feature 1..24: note = Synthetic Construct
  source 1..24: mol_type = other DNA
tgtgtatccttgggatctggtaca

SEQ ID NO: 1824 - DNA, 23 bp, synthetic construct
  misc_feature 1..23: note = Synthetic Construct
  source 1..23: mol_type = other DNA
gagctttcctgatgccttacact

SEQ ID NO: 1825 - DNA, 19 bp, synthetic construct
  misc_feature 1..19: note = Synthetic Construct
  source 1..19: mol_type = other DNA
cgcaggcttctgctgttga

SEQ ID NO: 1826 - DNA, 24 bp, synthetic construct
  misc_feature 1..24: note = Synthetic Construct
  source 1..24: mol_type = other DNA
tgacctgaaagctctttgttccat

SEQ ID NO: 1827 - DNA, 22 bp, synthetic construct
  misc_feature 1..22: note = Synthetic Construct
  source 1..22: mol_type = other DNA
cctctggaggccccactgtaat

SEQ ID NO: 1828 - DNA, 25 bp, synthetic construct
  misc_feature 1..25: note = Synthetic Construct
  source 1..25: mol_type = other DNA
ttctagtacatgccttttggtggat

SEQ ID NO: 1829 - DNA, 21 bp, synthetic construct
  misc_feature 1..21: note = Synthetic Construct
  source 1..21: mol_type = other DNA
gcatggaaccagggcatgact

SEQ ID NO: 1830 - DNA, 21 bp, synthetic construct
  misc_feature 1..21: note = Synthetic Construct
  source 1..21: mol_type = other DNA
cgctttgtccccactcttaca

SEQ ID NO: 1831 - DNA, 23 bp, synthetic construct
  misc_feature 1..23: note = Synthetic Construct
  source 1..23: mol_type = other DNA
cactctgtgcaaaccagttgtag

SEQ ID NO: 1832 - DNA, 21 bp, synthetic construct
  misc_feature 1..21: note = Synthetic Construct
  source 1..21: mol_type = other DNA
tcagcacccatcttgctcatc

SEQ ID NO: 1833 - DNA, 20 bp, synthetic construct
  misc_feature 1..20: note = Synthetic Construct
  source 1..20: mol_type = other DNA
ggagactcctaccccagctt

SEQ ID NO: 1834 - DNA, 23 bp, synthetic construct
  misc_feature 1..23: note = Synthetic Construct
  source 1..23: mol_type = other DNA
ggggattgttaatggccgagact

SEQ ID NO: 1835 - DNA, 21 bp, synthetic construct
  misc_feature 1..21: note = Synthetic Construct
  source 1..21: mol_type = other DNA
acccaccacttgcacagttac

SEQ ID NO: 1836 - DNA, 23 bp, synthetic construct
  misc_feature 1..23: note = Synthetic Construct
  source 1..23: mol_type = other DNA
gggtccctaagcactgtgagaag

SEQ ID NO: 1837 - DNA, 20 bp, synthetic construct
  misc_feature 1..20: note = Synthetic Construct
  source 1..20: mol_type = other DNA
aaccaggccttgcggtaaag

SEQ ID NO: 1838 - DNA, 24 bp, synthetic construct
  misc_feature 1..24: note = Synthetic Construct
  source 1..24: mol_type = other DNA
cctagggaacagtccactgagaga

SEQ ID NO: 1839 - DNA, 24 bp, synthetic construct
  misc_feature 1..24: note = Synthetic Construct
  source 1..24: mol_type = other DNA
gcccgtgttttgaagctactgtct

SEQ ID NO: 1840 - DNA, 24 bp, synthetic construct
  misc_feature 1..24: note = Synthetic Construct
  source 1..24: mol_type = other DNA
gccaaccagttcagttgggagtca

SEQ ID NO: 1841 - DNA, 24 bp, synthetic construct
  misc_feature 1..24: note = Synthetic Construct
  source 1..24: mol_type = other DNA
gccagctagtggctttaaccaagt

SEQ ID NO: 1842 - DNA, 20 bp, synthetic construct
  misc_feature 1..20: note = Synthetic Construct
  source 1..20: mol_type = other DNA
gcttcgcccatggctgtctt

SEQ ID NO: 1843 - DNA, 22 bp, synthetic construct
  misc_feature 1..22: note = Synthetic Construct
  source 1..22: mol_type = other DNA
cgtgatctaccccactgagaca

SEQ ID NO: 1844 - DNA, 20 bp, synthetic construct
  misc_feature 1..20: note = Synthetic Construct
  source 1..20: mol_type = other DNA
agttgggcatggaggcatgt

SEQ ID NO: 1845 - DNA, 21 bp, synthetic construct
  misc_feature 1..21: note = Synthetic Construct
  source 1..21: mol_type = other DNA
aggccttgcaggagagaaatg

SEQ ID NO: 1846 - DNA, 25 bp, synthetic construct
  misc_feature 1..25: note = Synthetic Construct
  source 1..25: mol_type = other DNA
cacctctgctttaggtctcaggttt

SEQ ID NO: 1847 - DNA, 25 bp, synthetic construct
  misc_feature 1..25: note = Synthetic Construct
  source 1..25: mol_type = other DNA
cgatgctgagactaaggagcctaaa

SEQ ID NO: 1848 - DNA, 24 bp, synthetic construct
  misc_feature 1..24: note = Synthetic Construct
  source 1..24: mol_type = other DNA
gtcactcattctgctctacccaaa

SEQ ID NO: 1849 - DNA, 25 bp, synthetic construct
  misc_feature 1..25: note = Synthetic Construct
  source 1..25: mol_type = other DNA
gagcatcctcgagaattgcatttga

SEQ ID NO: 1850 - DNA, 25 bp, synthetic construct
  misc_feature 1..25: note = Synthetic Construct
  source 1..25: mol_type = other DNA
gacaagtcagctggtgaagagtgaa

SEQ ID NO: 1851 - DNA, 23 bp, synthetic construct
  misc_feature 1..23: note = Synthetic Construct
  source 1..23: mol_type = other DNA
gcctgtggcaaacttgaacatga

SEQ ID NO: 1852 - DNA, 23 bp, synthetic construct
  misc_feature 1..23: note = Synthetic Construct
  source 1..23: mol_type = other DNA
tccactgtggtttgagtggaaag

SEQ ID NO: 1853 - DNA, 24 bp, synthetic construct
  misc_feature 1..24: note = Synthetic Construct
  source 1..24: mol_type = other DNA
agactcgctcattcactctcattt

SEQ ID NO: 1854 - DNA, 22 bp, synthetic construct
  misc_feature 1..22: note = Synthetic Construct
  source 1..22: mol_type = other DNA
gaatccagctcagccccttcta

SEQ ID NO: 1855 - DNA, 23 bp, synthetic construct
  misc_feature 1..23: note = Synthetic Construct
  source 1..23: mol_type = other DNA
tcaagcagaacaggactgacaat

SEQ ID NO: 1856 - DNA, 20 bp, synthetic construct
  misc_feature 1..20: note = Synthetic Construct
  source 1..20: mol_type = other DNA
tctcagccttcccgcttcat

SEQ ID NO: 1857 - DNA, 19 bp, synthetic construct
  misc_feature 1..19: note = Synthetic Construct
  source 1..19: mol_type = other DNA
agggcccaggttccttctt

SEQ ID NO: 1858 - DNA, 22 bp, synthetic construct
  misc_feature 1..22: note = Synthetic Construct
  source 1..22: mol_type = other DNA
tcccttccaggatgaccattga

SEQ ID NO: 1859 - DNA, 19 bp, synthetic construct
  misc_feature 1..19: note = Synthetic Construct
  source 1..19: mol_type = other DNA
agccaggaagcctcagagt

SEQ ID NO: 1860 - DNA, 22 bp, synthetic construct
  misc_feature 1..22: note = Synthetic Construct
  source 1..22: mol_type = other DNA
ttgctctaccctcctccagctt

SEQ ID NO: 1861 - DNA, 25 bp, synthetic construct
  misc_feature 1..25: note = Synthetic Construct
  source 1..25: mol_type = other DNA
cccctgccctattttaaccacaaag

SEQ ID NO: 1862 - DNA, 20 bp, synthetic construct
  misc_feature 1..20: note = Synthetic Construct
  source 1..20: mol_type = other DNA
ccactgcacccagccaatct

SEQ ID NO: 1863 - DNA, 20 bp, synthetic construct
  misc_feature 1..20: note = Synthetic Construct
  source 1..20: mol_type = other DNA
aggcaggaagcctgttcaga

SEQ ID NO: 1864 - DNA, 25 bp, synthetic construct
  misc_feature 1..25: note = Synthetic Construct
  source 1..25: mol_type = other DNA
tgtgcaaactctgtgatggaatgta

SEQ ID NO: 1865 - DNA, 20 bp, synthetic construct
  misc_feature 1..20: note = Synthetic Construct
  source 1..20: mol_type = other DNA
aggggcccttctggaggttt

SEQ ID NO: 1866 - DNA, 22 bp, synthetic construct
  misc_feature 1..22: note = Synthetic Construct
  source 1..22: mol_type = other DNA
tcgttccaccatgcttttcctt

SEQ ID NO: 1867 - DNA, 22 bp, synthetic construct
  misc_feature 1..22: note = Synthetic Construct
  source 1..22: mol_type = other DNA
tgcttaaacgaacagggctttg

SEQ ID NO: 1868 - DNA, 21 bp, synthetic construct
  misc_feature 1..21: note = Synthetic Construct
  source 1..21: mol_type = other DNA
tctgcaggggtgtggtatttc

SEQ ID NO: 1869 - DNA, 22 bp, synthetic construct
  misc_feature 1..22: note = Synthetic Construct
  source 1..22: mol_type = other DNA
ccacctatgccacccaaggtat

SEQ ID NO: 1870 - DNA, 23 bp, synthetic construct
  misc_feature 1..23: note = Synthetic Construct
  source 1..23: mol_type = other DNA
cccctccctcgcagaagtataag

SEQ ID NO: 1871 - DNA, 24 bp, synthetic construct
  misc_feature 1..24: note = Synthetic Construct
  source 1..24: mol_type = other DNA
gccttcctaatgccacccagatca

SEQ ID NO: 1872 - DNA, 22 bp, synthetic construct
  misc_feature 1..22: note = Synthetic Construct
  source 1..22: mol_type = other DNA
gcctcagtctcggttagcttca

SEQ ID NO: 1873 - DNA, 20 bp, synthetic construct
  misc_feature 1..20: note = Synthetic Construct
  source 1..20: mol_type = other DNA
tgccctgtgccctcaattct

SEQ ID NO: 1874 - DNA, 23 bp, synthetic construct
  misc_feature 1..23: note = Synthetic Construct
  source 1..23: mol_type = other DNA
accctgtactcctctcattcaca

SEQ ID NO: 1875 - DNA, 19 bp, synthetic construct
  misc_feature 1..19: note = Synthetic Construct
  source 1..19: mol_type = other DNA
ccgcgtctggtcgcttctt

SEQ ID NO: 1876 - DNA, 20 bp, synthetic construct
  misc_feature 1..20: note = Synthetic Construct
  source 1..20: mol_type = other DNA
ctggaggagagggcagtcat

SEQ ID NO: 1877 - DNA, 23 bp, synthetic construct
  misc_feature 1..23: note = Synthetic Construct
  source 1..23: mol_type = other DNA
gggattacaaagttgcgcgtttc

SEQ ID NO: 1878 - DNA, 20 bp, synthetic construct
  misc_feature 1..20: note = Synthetic Construct
  source 1..20: mol_type = other DNA
ggatggagacggcaggaatg

SEQ ID NO: 1879 - DNA, 24 bp, synthetic construct
  misc_feature 1..24: note = Synthetic Construct
  source 1..24: mol_type = other DNA
ggacagagaatcaggtcacggtat

SEQ ID NO: 1880 - DNA, 20 bp, synthetic construct
  misc_feature 1..20: note = Synthetic Construct
  source 1..20: mol_type = other DNA
acctcggcctcaggacttct

SEQ ID NO: 1881 - DNA, 22 bp, synthetic construct
  misc_feature 1..22: note = Synthetic Construct
  source 1..22: mol_type = other DNA
tgctcacaggctcggagatagt

SEQ ID NO: 1882 - DNA, 21 bp, synthetic construct
  misc_feature 1..21: note = Synthetic Construct
  source 1..21: mol_type = other DNA
agcagtcaggtgctcctcctt

SEQ ID NO: 1883 - DNA, 19 bp, synthetic construct
  misc_feature 1..19: note = Synthetic Construct
  source 1..19: mol_type = other DNA
tggtatggggcggcagtga

SEQ ID NO: 1884 - DNA, 20 bp, synthetic construct
  misc_feature 1..20: note = Synthetic Construct
  source 1..20: mol_type = other DNA
cccagctgacacaggctcat

SEQ ID NO: 1885 - DNA, 25 bp, synthetic construct
  misc_feature 1..25: note = Synthetic Construct
  source 1..25: mol_type = other DNA
gtgtccagtctccttgagtcatttg

SEQ ID NO: 1886 - DNA, 19 bp, synthetic construct
  misc_feature 1..19: note = Synthetic Construct
  source 1..19: mol_type = other DNA
ggaggcatgccccatctca

SEQ ID NO: 1887 - DNA, 20 bp, synthetic construct
  misc_feature 1..20: note = Synthetic Construct
  source 1..20: mol_type = other DNA
gtggtgcttgttgccactgt

SEQ ID NO: 1888 - DNA, 24 bp, synthetic construct
  misc_feature 1..24: note = Synthetic Construct
  source 1..24: mol_type = other DNA
gggcagtgatagaactgacatttg

SEQ ID NO: 1889 - DNA, 20 bp, synthetic construct
  misc_feature 1..20: note = Synthetic Construct
  source 1..20: mol_type = other DNA
ggaacgtcagtggtcagctt

SEQ ID NO: 1890 - DNA, 23 bp, synthetic construct
  misc_feature 1..23: note = Synthetic Construct
  source 1..23: mol_type = other DNA
tgtcaccctctctgctcataagt

SEQ ID NO: 1891 - DNA, 22 bp, synthetic construct
  misc_feature 1..22: note = Synthetic Construct
  source 1..22: mol_type = other DNA
gttccatccccaaggacacaga

SEQ ID NO: 1892 - DNA, 23 bp, synthetic construct
  misc_feature 1..23: note = Synthetic Construct
  source 1..23: mol_type = other DNA
gggactggaccaagaagggtatg

SEQ ID NO: 1893 - DNA, 22 bp, synthetic construct
  misc_feature 1..22: note = Synthetic Construct
  source 1..22: mol_type = other DNA
ccatggcagaagctcaggaaac

SEQ ID NO: 1894 - DNA, 22 bp, synthetic construct
  misc_feature 1..22: note = Synthetic Construct
  source 1..22: mol_type = other DNA
ggtctcgctctgtgacaccatt

SEQ ID NO: 1895 - DNA, 23 bp, synthetic construct
  misc_feature 1..23: note = Synthetic Construct
  source 1..23: mol_type = other DNA
gcttccccgtgactgtctcctat

SEQ ID NO: 1896 - DNA, 25 bp, synthetic construct
  misc_feature 1..25: note = Synthetic Construct
  source 1..25: mol_type = other DNA
gagagggtactggtagaagcatttc

SEQ ID NO: 1897 - DNA, 20 bp, synthetic construct
  misc_feature 1..20: note = Synthetic Construct
  source 1..20: mol_type = other DNA
aagtgtggggccctcctaag

SEQ ID NO: 1898 - DNA, 22 bp, synthetic construct
  misc_feature 1..22: note = Synthetic Construct
  source 1..22: mol_type = other DNA
gcagctgctgtctctgcaattc

SEQ ID NO: 1899 - DNA, 21 bp, synthetic construct
  misc_feature 1..21: note = Synthetic Construct
  source 1..21: mol_type = other DNA
ccttgtcctgtgcatctctgt

SEQ ID NO: 1900 - DNA, 23 bp, synthetic construct
  misc_feature 1..23: note = Synthetic Construct
  source 1..23: mol_type = other DNA
caaaggcaaaaagtggcatctgt

SEQ ID NO: 1901 - DNA, 22 bp, synthetic construct
  misc_feature 1..22: note = Synthetic Construct
  source 1..22: mol_type = other DNA
gagcctacctctgtggacttca

SEQ ID NO: 1902 - DNA, 24 bp, synthetic construct
  misc_feature 1..24: note = Synthetic Construct
  source 1..24: mol_type = other DNA
ggaaaaccctctgagcctcacatt

SEQ ID NO: 1903 - DNA, 22 bp, synthetic construct
  misc_feature 1..22: note = Synthetic Construct
  source 1..22: mol_type = other DNA
cggccccttagcttgagttagt

SEQ ID NO: 1904 - DNA, 21 bp, synthetic construct
  misc_feature 1..21: note = Synthetic Construct
  source 1..21: mol_type = other DNA
gaggctgcctagagagacaga

SEQ ID NO: 1905 - DNA, 19 bp, synthetic construct
  misc_feature 1..19: note = Synthetic Construct
  source 1..19: mol_type = other DNA
ggccacgcatgggcatttg

SEQ ID NO: 1906 - DNA, 19 bp, synthetic construct
  misc_feature 1..19: note = Synthetic Construct
  source 1..19: mol_type = other DNA
ggggctcgcgtctctgttt

SEQ ID NO: 1907 - DNA, 22 bp, synthetic construct
  misc_feature 1..22: note = Synthetic Construct
  source 1..22: mol_type = other DNA
ctgtgggatgtcctggaactac

SEQ ID NO: 1908 - DNA, 24 bp, synthetic construct
  misc_feature 1..24: note = Synthetic Construct
  source 1..24: mol_type = other DNA
cttcgagaaaggcttggagatact

SEQ ID NO: 1909 - DNA, 19 bp, synthetic construct
  misc_feature 1..19: note = Synthetic Construct
  source 1..19: mol_type = other DNA
tggccctcaaggagctgta

SEQ ID NO: 1910 - DNA, 22 bp, synthetic construct
  misc_feature 1..22: note = Synthetic Construct
  source 1..22: mol_type = other DNA
gcacccagccagcaattggata

SEQ ID NO: 1911 - DNA, 20 bp, synthetic construct
  misc_feature 1..20: note = Synthetic Construct
  source 1..20: mol_type = other DNA
ccccgattctgcgtttgctt

SEQ ID NO: 1912 - DNA, 22 bp, synthetic construct
  misc_feature 1..22: note = Synthetic Construct
  source 1..22: mol_type = other DNA
agaacccggtccacatgctaac

SEQ ID NO: 1913 - DNA, 22 bp, synthetic construct
  misc_feature 1..22: note = Synthetic Construct
  source 1..22: mol_type = other DNA
ccaaggccctcctctctctaag

SEQ ID NO: 1914 - DNA, 23 bp, synthetic construct
  misc_feature 1..23: note = Synthetic Construct
  source 1..23: mol_type = other DNA
cacaggcagttagggtaggttct

SEQ ID NO: 1915 - DNA, 21 bp, synthetic construct
  misc_feature 1..21: note = Synthetic Construct
  source 1..21: mol_type = other DNA
tccccacgatggcagtgagtt

SEQ ID NO: 1916 - DNA, 22 bp, synthetic construct
  misc_feature 1..22: note = Synthetic Construct
  source 1..22: mol_type = other DNA
tggagcaatatggtgcactgtt

SEQ ID NO: 1917 - DNA, 24 bp, synthetic construct
  misc_feature 1..24: note = Synthetic Construct
  source 1..24: mol_type = other DNA
cactctgtcaagttttgccgtctt

SEQ ID NO: 1918 - DNA, 22 bp, synthetic construct
  misc_feature 1..22: note = Synthetic Construct
  source 1..22: mol_type = other DNA
gcaggcatgacagactttcctt

SEQ ID NO: 1919 - DNA, 23 bp, synthetic construct
  misc_feature 1..23: note = Synthetic Construct
  source 1..23: mol_type = other DNA
gcgttccccatggcatgtctaaa

SEQ ID NO: 1920 - DNA, 24 bp, synthetic construct
  misc_feature 1..24: note = Synthetic Construct
  source 1..24: mol_type = other DNA
ttggagtggacgtcttcctatttc

SEQ ID NO: 1921 - DNA, 20 bp, synthetic construct
  misc_feature 1..20: note = Synthetic Construct
  source 1..20: mol_type = other DNA
cagggctccctcctccattt

SEQ ID NO: 1922 - DNA, 26 bp, synthetic construct
  misc_feature 1..26: note = Synthetic Construct
  source 1..26: mol_type = other DNA
cagcactgagttcattgcctcaaaaa

SEQ ID NO: 1923 - DNA, 23 bp, synthetic construct
  misc_feature 1..23: note = Synthetic Construct
  source 1..23: mol_type = other DNA
gccataggagagaccctgaatct

SEQ ID NO: 1924 - DNA, 22 bp, synthetic construct
  misc_feature 1..22: note = Synthetic Construct
  source 1..22: mol_type = other DNA
gactgcaacagaggctgaccta

SEQ ID NO: 1925 - DNA, 18 bp, synthetic construct
  misc_feature 1..18: note = Synthetic Construct
  source 1..18: mol_type = other DNA
tgccctgggtggtcttgt

SEQ ID NO: 1926 - DNA, 25 bp, synthetic construct
  misc_feature 1..25: note = Synthetic Construct
  source 1..25: mol_type = other DNA
cagcagagacctgatagccctatgt

SEQ ID NO: 1927 - DNA, 23 bp, synthetic construct
  misc_feature 1..23: note = Synthetic Construct
  source 1..23: mol_type = other DNA
gcaacaggttttgtcctctggtt

SEQ ID NO: 1928 - DNA, 22 bp, synthetic construct
  misc_feature 1..22: note = Synthetic Construct
  source 1..22: mol_type = other DNA
cctcgtcctcctcccatccaaa

SEQ ID NO: 1929 - DNA, 19 bp, synthetic construct
  misc_feature 1..19: note = Synthetic Construct
  source 1..19: mol_type = other DNA
ctggaaacggccccagagt

SEQ ID NO: 1930 - DNA, 22 bp, synthetic construct
  misc_feature 1..22: note = Synthetic Construct
  source 1..22: mol_type = other DNA
tggtggggacattttcctgaag

SEQ ID NO: 1931 - DNA, 20 bp, synthetic construct
  misc_feature 1..20: note = Synthetic Construct
  source 1..20: mol_type = other DNA
ctggttgcagtgtggagcat

SEQ ID NO: 1932 - DNA, 21 bp, synthetic construct
  misc_feature 1..21: note = Synthetic Construct
  source 1..21: mol_type = other DNA
tcagatgtcaaccccgcctat

SEQ ID NO: 1933 - DNA, 20 bp, synthetic construct
  misc_feature 1..20: note = Synthetic Construct
  source 1..20: mol_type = other DNA
cggcgactactggaggcttt

SEQ ID NO: 1934 - DNA, 22 bp, synthetic construct
  misc_feature 1..22: note = Synthetic Construct
  source 1..22: mol_type = other DNA
aggtagcccagcagttctccat

SEQ ID NO: 1935 - DNA, 20 bp, synthetic construct
  misc_feature 1..20: note = Synthetic Construct
  source 1..20: mol_type = other DNA
tggcctgcctcacttgctta

SEQ ID NO: 1936 - DNA, 21 bp, synthetic construct
  misc_feature 1..21: note = Synthetic Construct
  source 1..21: mol_type = other DNA
tccggaagacacgagaggaaa

SEQ ID NO: 1937 - DNA, 23 bp, synthetic construct
  misc_feature 1..23: note = Synthetic Construct
  source 1..23: mol_type = other DNA
acatgggttttgagtcagccatt

SEQ ID NO: 1938 - DNA, 25 bp, synthetic construct
  misc_feature 1..25: note = Synthetic Construct
  source 1..25: mol_type = other DNA
gaaccttggctctttgcaagtcatc

SEQ ID NO: 1939 - DNA, 20 bp, synthetic construct
  misc_feature 1..20: note = Synthetic Construct
  source 1..20: mol_type = other DNA
tgactgactgggccttcaga

SEQ ID NO: 1940 - DNA, 25 bp, synthetic construct
  misc_feature 1..25: note = Synthetic Construct
  source 1..25: mol_type = other DNA
ggcaaggcagccaataaaggatgta

SEQ ID NO: 1941 - DNA, 21 bp, synthetic construct
  misc_feature 1..21: note = Synthetic Construct
  source 1..21: mol_type = other DNA
gggcctgttgggcttgttttg

SEQ ID NO: 1942 - DNA, 24 bp, synthetic construct
  misc_feature 1..24: note = Synthetic Construct
  source 1..24: mol_type = other DNA
caaagtggtgagttccttgggttt

SEQ ID NO: 1943 - DNA, 20 bp, synthetic construct
  misc_feature 1..20: note = Synthetic Construct
  source 1..20: mol_type = other DNA
ttgccctcccagtggcttca

SEQ ID NO: 1944 - DNA, 19 bp, synthetic construct
  misc_feature 1..19: note = Synthetic Construct
  source 1..19: mol_type = other DNA
ggtgctctagggcctcaca

SEQ ID NO: 1945 - DNA, 24 bp, synthetic construct
  misc_feature 1..24: note = Synthetic Construct
  source 1..24: mol_type = other DNA
cagtgaggaacgtattcagcctat

SEQ ID NO: 1946 - DNA, 19 bp, synthetic construct
  misc_feature 1..19: note = Synthetic Construct
  source 1..19: mol_type = other DNA
ggcatcgctccacccaagt

SEQ ID NO: 1947 - DNA, 23 bp, synthetic construct
  misc_feature 1..23: note = Synthetic Construct
  source 1..23: mol_type = other DNA
aaagaaagaggccatgtggtaca

SEQ ID NO: 1948 - DNA, 19 bp, synthetic construct
  misc_feature 1..19: note = Synthetic Construct
  source 1..19: mol_type = other DNA
tctggccacctggcgattt

SEQ ID NO: 1949 - DNA, 24 bp, synthetic construct
  misc_feature 1..24: note = Synthetic Construct
  source 1..24: mol_type = other DNA
gacatgacccacaaagccttcctt

SEQ ID NO: 1950 - DNA, 20 bp, synthetic construct
  misc_feature 1..20: note = Synthetic Construct
  source 1..20: mol_type = other DNA
tgcctgacctccatggaaac

SEQ ID NO: 1951 - DNA, 21 bp, synthetic construct
  misc_feature 1..21: note = Synthetic Construct
  source 1..21: mol_type = other DNA
gcccatgtgaggcatagactt

SEQ ID NO: 1952 - DNA, 20 bp, synthetic construct
  misc_feature 1..20: note = Synthetic Construct
  source 1..20: mol_type = other DNA
agaaagccgaggctcagaga

SEQ ID NO: 1953 - DNA, 24 bp, synthetic construct
  misc_feature 1..24: note = Synthetic Construct
  source 1..24: mol_type = other DNA
aggcaagctagctgatatcctttc

SEQ ID NO: 1954 - DNA, 22 bp, synthetic construct
  misc_feature 1..22: note = Synthetic Construct
  source 1..22: mol_type = other DNA
ggtggagtgacccaaaccttca

SEQ ID NO: 1955 - DNA, 27 bp, synthetic construct
  misc_feature 1..27: note = Synthetic Construct
  source 1..27: mol_type = other DNA
ggcatgctttcaatatatcctcctagt

SEQ ID NO: 1956 - DNA, 20 bp, synthetic construct
  misc_feature 1..20: note = Synthetic Construct
  source 1..20: mol_type = other DNA
ccgggaaacctgggaagtga

SEQ ID NO: 1957 - DNA, 22 bp, synthetic construct
  misc_feature 1..22: note = Synthetic Construct
  source 1..22: mol_type = other DNA
cctggtgagtaacggagagtca

SEQ ID NO: 1958 - DNA, 24 bp, synthetic construct
  misc_feature 1..24: note = Synthetic Construct
  source 1..24: mol_type = other DNA
caggcatgggcagtttcttttatc

SEQ ID NO: 1959 - DNA, 22 bp, synthetic construct
  misc_feature 1..22: note = Synthetic Construct
  source 1..22: mol_type = other DNA
accctctgcttctggtgtcagt

SEQ ID NO: 1960 - DNA, 20 bp, synthetic construct
  misc_feature 1..20: note = Synthetic Construct
  source 1..20: mol_type = other DNA
acgcctacagtgagcggaaa

SEQ ID NO: 1961 - DNA, 21 bp, synthetic construct
  misc_feature 1..21: note = Synthetic Construct
  source 1..21: mol_type = other DNA
ggggcatggaatcaggaactt

SEQ ID NO: 1962 - DNA, 22 bp, synthetic construct
  misc_feature 1..22: note = Synthetic Construct
  source 1..22: mol_type = other DNA
ttagagtgggagcggagacctt

SEQ ID NO: 1963 - DNA, 24 bp, synthetic construct
  misc_feature 1..24: note = Synthetic Construct
  source 1..24: mol_type = other DNA
gcaatgatcagtggcgttttcaga

SEQ ID NO: 1964 - DNA, 20 bp, synthetic construct
  misc_feature 1..20: note = Synthetic Construct
  source 1..20: mol_type = other DNA
accacagggttgggcaatga

SEQ ID NO: 1965 - DNA, 19 bp, synthetic construct
  misc_feature 1..19: note = Synthetic Construct
  source 1..19: mol_type = other DNA
acggtgcccggccatttct

SEQ ID NO: 1966 - DNA, 23 bp, synthetic construct
  misc_feature 1..23: note = Synthetic Construct
  source 1..23: mol_type = other DNA
gcatgtgcctgttttctaaccat

SEQ ID NO: 1967 - DNA, 24 bp, synthetic construct
  misc_feature 1..24: note = Synthetic Construct
  source 1..24: mol_type = other DNA
gcccaccttatacctcgctcaact

SEQ ID NO: 1968 - DNA, 22 bp, synthetic construct
  misc_feature 1..22: note = Synthetic Construct
  source 1..22: mol_type = other DNA
cctcctgccaccacatctatca

SEQ ID NO: 1969 - DNA, 21 bp, synthetic construct
  misc_feature 1..21: note = Synthetic Construct
  source 1..21: mol_type = other DNA
tggtgacggaggatggcagaa

SEQ ID NO: 1970 - DNA, 22 bp, synthetic construct
  misc_feature 1..22: note = Synthetic Construct
  source 1..22: mol_type = other DNA
tgcatcccacctgtctatgact

SEQ ID NO: 1971 - DNA, 21 bp, synthetic construct
  misc_feature 1..21: note = Synthetic Construct
  source 1..21: mol_type = other DNA
agccagagttctgccttcttg

SEQ ID NO: 1972 - DNA, 20 bp, synthetic construct
  misc_feature 1..20: note = Synthetic Construct
  source 1..20: mol_type = other DNA
aggctgcgagtttggcagat

SEQ ID NO: 1973 - DNA, 18 bp, synthetic construct
  misc_feature 1..18: note = Synthetic Construct
  source 1..18: mol_type = other DNA
gtccctgctggtgcactt

SEQ ID NO: 1974 - DNA, 23 bp, synthetic construct
  misc_feature 1..23: note = Synthetic Construct
  source 1..23: mol_type = other DNA
gcactatgcagcaggaacctaag

SEQ ID NO: 1975 - DNA, 20 bp, synthetic construct
  misc_feature 1..20: note = Synthetic Construct
  source 1..20: mol_type = other DNA
acaggcctggttggctttgt

SEQ ID NO: 1976 - DNA, 26 bp, synthetic construct
  misc_feature 1..26: note = Synthetic Construct
  source 1..26: mol_type = other DNA
ccaggtcagggtatattatggaaaca

SEQ ID NO: 1977 - DNA, 20 bp, synthetic construct
  misc_feature 1..20: note = Synthetic Construct
  source 1..20: mol_type = other DNA
ccgtggccactcattcaaga

SEQ ID NO: 1978 - DNA, 24 bp, synthetic construct
  misc_feature 1..24: note = Synthetic Construct
  source 1..24: mol_type = other DNA
gggctcacttggatggtcctaaag

SEQ ID NO: 1979 - DNA, 24 bp, synthetic construct
  misc_feature 1..24: note = Synthetic Construct
  source 1..24: mol_type = other DNA
ccaagtgtgacagtgtctttgttt

SEQ ID NO: 1980 - DNA, 26 bp, synthetic construct
  misc_feature 1..26: note = Synthetic Construct
  source 1..26: mol_type = other DNA
cgatacaagtggatggctcttcattc

SEQ ID NO: 1981 - DNA, 25 bp, synthetic construct
  misc_feature 1..25: note = Synthetic Construct
  source 1..25: mol_type = other DNA
catctcaccagatcttgagtgctaa

SEQ ID NO: 1982 - DNA, 20 bp, synthetic construct
  misc_feature 1..20: note = Synthetic Construct
  source 1..20: mol_type = other DNA
aggtggagctgccatcttga

SEQ ID NO: 1983 - DNA, 24 bp, synthetic construct
  misc_feature 1..24: note = Synthetic Construct
  source 1..24: mol_type = other DNA
agacacagttagccagacctattg

SEQ ID NO: 1984 - DNA, 26 bp, synthetic construct
  misc_feature 1..26: note = Synthetic Construct
  source 1..26: mol_type = other DNA
gacatgtcgggaggcttaatctgaac

SEQ ID NO: 1985 - DNA, 23 bp, synthetic construct
  misc_feature 1..23: note = Synthetic Construct
  source 1..23: mol_type = other DNA
cctgcctaaaggtttgcagacaa

SEQ ID NO: 1986 - DNA, 24 bp, synthetic construct
  misc_feature 1..24: note = Synthetic Construct
  source 1..24: mol_type = other DNA
ccacccagatggacctccctttta

SEQ ID NO: 1987 - DNA, 20 bp, synthetic construct
  misc_feature 1..20: note = Synthetic Construct
  source 1..20: mol_type = other DNA
tgcctgtgtgactgccctta

SEQ ID NO: 1988 - DNA, 23 bp, synthetic construct
  misc_feature 1..23: note = Synthetic Construct
  source 1..23: mol_type = other DNA
gaattctgccgtctggttctttc

SEQ ID NO: 1989 - DNA, 22 bp, synthetic construct
  misc_feature 1..22: note = Synthetic Construct
  source 1..22: mol_type = other DNA
acccaatgtcctttgccagtag

SEQ ID NO: 1990 - DNA, 20 bp, synthetic construct
  misc_feature 1..20: note = Synthetic Construct
  source 1..20: mol_type = other DNA
ggctgcagtacacccagact

SEQ ID NO: 1991 - DNA, 28 bp, synthetic construct
  misc_feature 1..28: note = Synthetic Construct
  source 1..28: mol_type = other DNA
gtctttggggtaatcacccacagttaaa

SEQ ID NO: 1992 - DNA, 22 bp, synthetic construct
  misc_feature 1..22: note = Synthetic Construct
  source 1..22: mol_type = other DNA
cacacaccttttggcccttttg

SEQ ID NO: 1993 - DNA, 23 bp, synthetic construct
  misc_feature 1..23: note = Synthetic Construct
  source 1..23: mol_type = other DNA
tctggaggggtaaaaagctgact

SEQ ID NO: 1994 - DNA, 24 bp, synthetic construct
  misc_feature 1..24: note = Synthetic Construct
  source 1..24: mol_type = other DNA
gtaggaccaaaacatggagactgt

SEQ ID NO: 1995 - DNA, 22 bp, synthetic construct
  misc_feature 1..22: note = Synthetic Construct
  source 1..22: mol_type = other DNA
cactaagtgcccgagtcaggtt

SEQ ID NO: 1996 - DNA, 21 bp, synthetic construct
  misc_feature 1..21: note = Synthetic Construct
  source 1..21: mol_type = other DNA
caaccattggtgcggcaaaac

SEQ ID NO: 1997 - DNA, 23 bp, synthetic construct
  misc_feature 1..23: note = Synthetic Construct
  source 1..23: mol_type = other DNA
gacagcacatgctatccctactt

SEQ ID NO: 1998 - DNA, 23 bp, synthetic construct
  misc_feature 1..23: note = Synthetic Construct
  source 1..23: mol_type = other DNA
agaaaccagactgtgagggaaga

SEQ ID NO: 1999 - DNA, 20 bp, synthetic construct
  misc_feature 1..20: note = Synthetic Construct
  source 1..20: mol_type = other DNA
aggggaagggtccctcattt

SEQ ID NO: 2000 - DNA, 22 bp, synthetic construct
  misc_feature 1..22: note = Synthetic Construct
  source 1..22: mol_type = other DNA
accttaggtaccagctcagaca

SEQ ID NO: 2001 - DNA, 20 bp, synthetic construct
  misc_feature 1..20: note = Synthetic Construct
  source 1..20: mol_type = other DNA
agggctcttgagaccagcaa

SEQ ID NO: 2002 - DNA, 22 bp, synthetic construct
  misc_feature 1..22: note = Synthetic Construct
  source 1..22: mol_type = other DNA
gtgtggattgttgcaggaggaa

SEQ ID NO: 2003 - DNA, 24 bp, synthetic construct
  misc_feature 1..24: note = Synthetic Construct
  source 1..24: mol_type = other DNA
cagcaaagactggattcctactca

SEQ ID NO: 2004 - DNA, 25 bp, synthetic construct
  misc_feature 1..25: note = Synthetic Construct
  source 1..25: mol_type = other DNA
ggcatcattgcattcaaagacattc

SEQ ID NO: 2005 - DNA, 20 bp, synthetic construct
  misc_feature 1..20: note = Synthetic Construct
  source 1..20: mol_type = other DNA
cacccatggccacctttctt

SEQ ID NO: 2006 - DNA, 25 bp, synthetic construct
  misc_feature 1..25: note = Synthetic Construct
  source 1..25: mol_type = other DNA
cctctctgatcatttggcaggaaga

SEQ ID NO: 2007 - DNA, 25 bp, synthetic construct
  misc_feature 1..25: note = Synthetic Construct
  source 1..25: mol_type = other DNA
tcattgtaactagggactccacgta

SEQ ID NO: 2008 - DNA, 25 bp, synthetic construct
  misc_feature 1..25: note = Synthetic Construct
  source 1..25: mol_type = other DNA
catattaccctgggaatcacagcaa

SEQ ID NO: 2009 - DNA, 21 bp, synthetic construct
  misc_feature 1..21: note = Synthetic Construct
  source 1..21: mol_type = other DNA
ttggcctgccacatcccctat

SEQ ID NO: 2010 - DNA, 21 bp, synthetic construct
  misc_feature 1..21: note = Synthetic Construct
  source 1..21: mol_type = other DNA
cccaaatggcagaggctgtgt

SEQ ID NO: 2011 - DNA, 24 bp, synthetic construct
  misc_feature 1..24: note = Synthetic Construct
  source 1..24: mol_type = other DNA
cctgattcccttcagttctgttct

SEQ ID NO: 2012 - DNA, 26 bp, synthetic construct
  misc_feature 1..26: note = Synthetic Construct
  source 1..26: mol_type = other DNA
tgcactaatgtcttagaggagctttc

SEQ ID NO: 2013 - DNA, 22 bp, synthetic construct
  misc_feature 1..22: note = Synthetic Construct
  source 1..22: mol_type = other DNA
caaggccacacaggatgtgtct

SEQ ID NO: 2014 - DNA, 23 bp, synthetic construct
  misc_feature 1..23: note = Synthetic Construct
  source 1..23: mol_type = other DNA
gggtccagggtataggtggaaga

SEQ ID NO: 2015 - DNA, 22 bp, synthetic construct
  misc_feature 1..22: note = Synthetic Construct
  source 1..22: mol_type = other DNA
gcgcctctggaaaggtgagatt

SEQ ID NO: 2016 - DNA, 27 bp, synthetic construct
  misc_feature 1..27: note = Synthetic Construct
  source 1..27: mol_type = other DNA
ggcctggtgtaaatttctacctacata

SEQ ID NO: 2017 - DNA, 23 bp, synthetic construct
  misc_feature 1..23: note = Synthetic Construct
  source 1..23: mol_type = other DNA
tgagtgaaatgcaaaggctgcta

SEQ ID NO: 2018 - DNA, 23 bp, synthetic construct
  misc_feature 1..23: note = Synthetic Construct
  source 1..23: mol_type = other DNA
cacctggatgattgccattgctt

SEQ ID NO: 2019 - DNA, 23 bp, synthetic construct
  misc_feature 1..23: note = Synthetic Construct
  source 1..23: mol_type = other DNA
ggtcagtgacagatccaggacta

SEQ ID NO: 2020 - DNA, 22 bp, synthetic construct
  misc_feature 1..22: note = Synthetic Construct
  source 1..22: mol_type = other DNA
tttcaggccctagctccaggat

SEQ ID NO: 2021 - DNA, 23 bp, synthetic construct
  misc_feature 1..23: note = Synthetic Construct
  source 1..23: mol_type = other DNA
cagcctctttcctagggttgtgt

SEQ ID NO: 2022 - DNA, 25 bp, synthetic construct
  misc_feature 1..25: note = Synthetic Construct
  source 1..25: mol_type = other DNA
ggcagttattgcagcaaggaaatct

SEQ ID NO: 2023 - DNA, 20 bp, synthetic construct
  misc_feature 1..20: note = Synthetic Construct
  source 1..20: mol_type = other DNA
gccaccctaagtgctcatgt

SEQ ID NO: 2024 - DNA, 23 bp, synthetic construct
  misc_feature 1..23: note = Synthetic Construct
  source 1..23: mol_type = other DNA
caggacaaggtgctcagagtttc

SEQ ID NO: 2025 - DNA, 20 bp, synthetic construct
  misc_feature 1..20: note = Synthetic Construct
  source 1..20: mol_type = other DNA
aagatggaggccggcagttc

SEQ ID NO: 2026 - DNA, 20 bp, synthetic construct
  misc_feature 1..20: note = Synthetic Construct
  source 1..20: mol_type = other DNA
gttgaggctgaagcccatga

SEQ ID NO: 2027 - DNA, 24 bp, synthetic construct
  misc_feature 1..24: note = Synthetic Construct
  source 1..24: mol_type = other DNA
ccacttagcattgcttgtcatcaa

SEQ ID NO: 2028 - DNA, 20 bp, synthetic construct
  misc_feature 1..20: note = Synthetic Construct
  source 1..20: mol_type = other DNA
tccaggaacaaccgcacagt

SEQ ID NO: 2029 - DNA, 22 bp, synthetic construct
  misc_feature 1..22: note = Synthetic Construct
  source 1..22: mol_type = other DNA
ggagccccaagaaccttggatt

SEQ ID NO: 2030 - DNA, 23 bp, synthetic construct
  misc_feature 1..23: note = Synthetic Construct
  source 1..23: mol_type = other DNA
ggctatcgaagccttcatgtcta

SEQ ID NO: 2031 - DNA, 22 bp, synthetic construct
  misc_feature 1..22: note = Synthetic Construct
  source 1..22: mol_type = other DNA
gtgacaactgtgtgggtgagta

SEQ ID NO: 2032 - DNA, 21 bp, synthetic construct
  misc_feature 1..21: note = Synthetic Construct
  source 1..21: mol_type = other DNA
tgggacacctgagtcatggat

SEQ ID NO: 2033 - DNA, 23 bp, synthetic construct
  misc_feature 1..23: note = Synthetic Construct
  source 1..23: mol_type = other DNA
agtactcattttggcagcacgta

SEQ ID NO: 2034 - DNA, 21 bp, synthetic construct
  misc_feature 1..21: note = Synthetic Construct
  source 1..21: mol_type = other DNA
caggctgctcaaggcattagt

SEQ ID NO: 2035 - DNA, 25 bp, synthetic construct
  misc_feature 1..25: note = Synthetic Construct
  source 1..25: mol_type = other DNA
ggttgttgttcccggactctgaata

SEQ ID NO: 2036 - DNA, 22 bp, synthetic construct
  misc_feature 1..22: note = Synthetic Construct
  source 1..22: mol_type = other DNA
ggattgaggaaggtagcgcttt

SEQ ID NO: 2037 - DNA, 24 bp, synthetic construct
  misc_feature 1..24: note = Synthetic Construct
  source 1..24: mol_type = other DNA
gtggtagtaaagctggtgatgaca

SEQ ID NO: 2038 - DNA, 20 bp, synthetic construct
  misc_feature 1..20: note = Synthetic Construct
  source 1..20: mol_type = other DNA
cccagcaccaatcccatgaa

SEQ ID NO: 2039 - DNA, 26 bp, synthetic construct
  misc_feature 1..26: note = Synthetic Construct
  source 1..26: mol_type = other DNA
caaattacaggcaatgacgcacatag

SEQ ID NO: 2040 - DNA, 23 bp, synthetic construct
  misc_feature 1..23: note = Synthetic Construct
  source 1..23: mol_type = other DNA
tctggccactttaacacctcatt

SEQ ID NO: 2041 - DNA, 24 bp, synthetic construct
  misc_feature 1..24: note = Synthetic Construct
  source 1..24: mol_type = other DNA
gggtcatgcttcgcttgatactgt

SEQ ID NO: 2042 - DNA, 22 bp, synthetic construct
  misc_feature 1..22: note = Synthetic Construct
  source 1..22: mol_type = other DNA
tctctaccccaccccagcaaat

SEQ ID NO: 2043 - DNA, 24 bp, synthetic construct
  misc_feature 1..24: note = Synthetic Construct
  source 1..24: mol_type = other DNA
caccagagccctccattcctaaac

SEQ ID NO: 2044 - DNA, 19 bp, synthetic construct
  misc_feature 1..19: note = Synthetic Construct
  source 1..19: mol_type = other DNA
ggagggcaagggcatctca

SEQ ID NO: 2045 - DNA, 22 bp, synthetic construct
  misc_feature 1..22: note = Synthetic Construct
  source 1..22: mol_type = other DNA
ctcccctgtgcactctttcact

SEQ ID NO: 2046 - DNA, 24 bp, synthetic construct
  misc_feature 1..24: note = Synthetic Construct
  source 1..24: mol_type = other DNA
gtggtagatagacccggctagact

SEQ ID NO: 2047 - DNA, 21 bp, synthetic construct
  misc_feature 1..21: note = Synthetic Construct
  source 1..21: mol_type = other DNA
ggtcctgagcaactgggtaaa

SEQ ID NO: 2048 - DNA, 20 bp, synthetic construct
  misc_feature 1..20: note = Synthetic Construct
  source 1..20: mol_type = other DNA
gaagatgggacaggcgttgt

SEQ ID NO: 2049 - DNA, 22 bp, synthetic construct
  misc_feature 1..22: note = Synthetic Construct
  source 1..22: mol_type = other DNA
gggtaaggtgtgcccttgttct

SEQ ID NO: 2050 - DNA, 20 bp, synthetic construct
  misc_feature 1..20: note = Synthetic Construct
  source 1..20: mol_type = other DNA
caagcggagcacagaactga

SEQ ID NO: 2051 - DNA, 24 bp, synthetic construct
  misc_feature 1..24: note = Synthetic Construct
  source 1..24: mol_type = other DNA
gcaagatcccaacctccaggagaa

SEQ ID NO: 2052 - DNA, 23 bp, synthetic construct
  misc_feature 1..23: note = Synthetic Construct
  source 1..23: mol_type = other DNA
ggagacatcctcgcctgaaccta

SEQ ID NO: 2053 - DNA, 27 bp, synthetic construct
  misc_feature 1..27: note = Synthetic Construct
  source 1..27: mol_type = other DNA
ggcctgagctaagctttttctttgcta

SEQ ID NO: 2054 - DNA, 19 bp, synthetic construct
  misc_feature 1..19: note = Synthetic Construct
  source 1..19: mol_type = other DNA
cgccagcattctgctgctt

SEQ ID NO: 2055 - DNA, 19 bp, synthetic construct
  misc_feature 1..19: note = Synthetic Construct
  source 1..19: mol_type = other DNA
acagtggtgcccagtgtga

SEQ ID NO: 2056 - DNA, 25 bp, synthetic construct
  misc_feature 1..25: note = Synthetic Construct
  source 1..25: mol_type = other DNA
gcagaataaacaggttcttgtgtca

SEQ ID NO: 2057 - DNA, 22 bp, synthetic construct
  misc_feature 1..22: note = Synthetic Construct
  source 1..22: mol_type = other DNA
cccaatcagccccagacatttg

SEQ ID NO: 2058 - DNA, 21 bp, synthetic construct
  misc_feature 1..21: note = Synthetic Construct
  source 1..21: mol_type = other DNA
tcgctctctctccacctctgt

SEQ ID NO: 2059 - DNA, 20 bp, synthetic construct
  misc_feature 1..20: note = Synthetic Construct
  source 1..20: mol_type = other DNA
gtgtgtggcaaggtgtgtct

SEQ ID NO: 2060 - DNA, 21 bp, synthetic construct
  misc_feature 1..21: note = Synthetic Construct
  source 1..21: mol_type = other DNA
aggtgggattggaggttggaa

SEQ ID NO: 2061 - DNA, 20 bp, synthetic construct
  misc_feature 1..20: note = Synthetic Construct
  source 1..20: mol_type = other DNA
caggcagagaggaagccaaa

SEQ ID NO: 2062 - DNA, 19 bp, synthetic construct
  misc_feature 1..19: note = Synthetic Construct
  source 1..19: mol_type = other DNA
cctgcctccccaacagtga

SEQ ID NO: 2063 - DNA, 23 bp, synthetic construct
  misc_feature 1..23: note = Synthetic Construct
  source 1..23: mol_type = other DNA
tcccttaacaagtcacccacttc

SEQ ID NO: 2064 - DNA, 21 bp, synthetic construct
  misc_feature 1..21: note = Synthetic Construct
  source 1..21: mol_type = other DNA
cccctcagcctgtatgtctct

SEQ ID NO: 2065 - DNA, 23 bp, synthetic construct
  misc_feature 1..23: note = Synthetic Construct
  source 1..23: mol_type = other DNA
cccttcctaagtgccagagaaac

SEQ ID NO: 2066 - DNA, 20 bp, synthetic construct
  misc_feature 1..20: note = Synthetic Construct
  source 1..20: mol_type = other DNA
aacctcactgttgcgtgagt

SEQ ID NO: 2067 - DNA, 22 bp, synthetic construct
  misc_feature 1..22: note = Synthetic Construct
  source 1..22: mol_type = other DNA
ccctgctcccacaaactcttta

SEQ ID NO: 2068 - DNA, 27 bp, synthetic construct
  misc_feature 1..27: note = Synthetic Construct
  source 1..27: mol_type = other DNA
cagagtaggattagccacttcagtaag

SEQ ID NO: 2069 - DNA, 23 bp, synthetic construct
  misc_feature 1..23: note = Synthetic Construct
  source 1..23: mol_type = other DNA
gctcggagactctgcctctctat

SEQ ID NO: 2070 - DNA, 22 bp, synthetic construct
  misc_feature 1..22: note = Synthetic Construct
  source 1..22: mol_type = other DNA
cctcaatgcaggggcagtctat

SEQ ID NO: 2071 - DNA, 22 bp, synthetic construct
  misc_feature 1..22: note = Synthetic Construct
  source 1..22: mol_type = other DNA
aaaattgtagccccacccatgt

SEQ ID NO: 2072 - DNA, 25 bp, synthetic construct
  misc_feature 1..25: note = Synthetic Construct
  source 1..25: mol_type = other DNA
gggagtttaccgctaagatgttttc

SEQ ID NO: 2073 - DNA, 21 bp, synthetic construct
  misc_feature 1..21: note = Synthetic Construct
  source 1..21: mol_type = other DNA
gcctgaggtccatgactttgt

SEQ ID NO: 2074 - DNA, 20 bp, synthetic construct
  misc_feature 1..20: note = Synthetic Construct
  source 1..20: mol_type = other DNA
aggcccactgtcacatggat

SEQ ID NO: 2075 - DNA, 19 bp, synthetic construct
  misc_feature 1..19: note = Synthetic Construct
  source 1..19: mol_type = other DNA
gcggtaggctgcctgaaca

SEQ ID NO: 2076 - DNA, 20 bp, synthetic construct
  misc_feature 1..20: note = Synthetic Construct
  source 1..20: mol_type = other DNA
tgggttccccgaggctctgt

SEQ ID NO: 2077 - DNA, 25 bp, synthetic construct
  misc_feature 1..25: note = Synthetic Construct
  source 1..25: mol_type = other DNA
catagcactgggatcaagaaagact

SEQ ID NO: 2078 - DNA, 23 bp, synthetic construct
  misc_feature 1..23: note = Synthetic Construct
  source 1..23: mol_type = other DNA
gtctgttcactccaaagcacaag

SEQ ID NO: 2079 - DNA, 22 bp, synthetic construct
  misc_feature 1..22: note = Synthetic Construct
  source 1..22: mol_type = other DNA
agggaccctagaggacaggaaa

SEQ ID NO: 2080 - DNA, 22 bp, synthetic construct
  misc_feature 1..22: note = Synthetic Construct
  source 1..22: mol_type = other DNA
ctgctgttggaccctaaacact

SEQ ID NO: 2081 - DNA, 21 bp, synthetic construct
  misc_feature 1..21: note = Synthetic Construct
  source 1..21: mol_type = other DNA
tcaggctttcctgtccctctt

SEQ ID NO: 2082 - DNA, 25 bp, synthetic construct
  misc_feature 1..25: note = Synthetic Construct
  source 1..25: mol_type = other DNA
ttggatattgtttgtcacccctaca

SEQ ID NO: 2083 - DNA, 19 bp, synthetic construct
  misc_feature 1..19: note = Synthetic Construct
  source 1..19: mol_type = other DNA
ggcccacctcgtcactatg

SEQ ID NO: 2084 - DNA, 22 bp, synthetic construct
  misc_feature 1..22: note = Synthetic Construct
  source 1..22: mol_type = other DNA
gcttacaacgcaacttcacaca

SEQ ID NO: 2085 - DNA, 21 bp, synthetic construct
  misc_feature 1..21: note = Synthetic Construct
  source 1..21: mol_type = other DNA
cccaccctgagccttcacttc

SEQ ID NO: 2086 - DNA, 20 bp, synthetic construct
  misc_feature 1..20: note = Synthetic Construct
  source 1..20: mol_type = other DNA
ttggtggcgcccatgagtct

SEQ ID NO: 2087 - DNA, 21 bp, synthetic construct
  misc_feature 1..21: note = Synthetic Construct
  source 1..21: mol_type = other DNA
ttgaaagcctcgtgccatttg

SEQ ID NO: 2088 - DNA, 24 bp, synthetic construct
  misc_feature 1..24: note = Synthetic Construct
  source 1..24: mol_type = other DNA
tttaggtgggatgtgaatgtgtca

SEQ ID NO: 2089 - DNA, 23 bp, synthetic construct
  misc_feature 1..23: note = Synthetic Construct
  source 1..23: mol_type = other DNA
cacataagggaacaagcgcacaa

SEQ ID NO: 2090 - DNA, 23 bp, synthetic construct
  misc_feature 1..23: note = Synthetic Construct
  source 1..23: mol_type = other DNA
cctccaacctagactggatgtca

SEQ ID NO: 2091 - DNA, 22 bp, synthetic construct
  misc_feature 1..22: note = Synthetic Construct
  source 1..22: mol_type = other DNA
gacttggtcgtgggttttgaga

SEQ ID NO: 2092 - DNA, 22 bp, synthetic construct
  misc_feature 1..22: note = Synthetic Construct
  source 1..22: mol_type = other DNA
tgactgctgacacgggaggaat

SEQ ID NO: 2093 - DNA, 20 bp, synthetic construct
  misc_feature 1..20: note = Synthetic Construct
  source 1..20: mol_type = other DNA
tggtggcgagggtagaagat

SEQ ID NO: 2094 - DNA, 24 bp, synthetic construct
  misc_feature 1..24: note = Synthetic Construct
  source 1..24: mol_type = other DNA
actcacagtaatccaggggaaaag

SEQ ID NO: 2095 - DNA, 24 bp, synthetic construct
  misc_feature 1..24: note = Synthetic Construct
  source 1..24: mol_type = other DNA
ctgcaaaaataccagggaggaact

SEQ ID NO: 2096 - DNA, 22 bp, synthetic construct
  misc_feature 1..22: note = Synthetic Construct
  source 1..22: mol_type = other DNA
actctcacacccttaggccttt

SEQ ID NO: 2097 - DNA, 20 bp, synthetic construct
  misc_feature 1..20: note = Synthetic Construct
  source 1..20: mol_type = other DNA
accgcgccccatcacttact

SEQ ID NO: 2098 - DNA, 22 bp, synthetic construct
  misc_feature 1..22: note = Synthetic Construct
  source 1..22: mol_type = other DNA
ctgaccctgggcaaatgactct

SEQ ID NO: 2099 - DNA, 20 bp, synthetic construct
  misc_feature 1..20: note = Synthetic Construct
  source 1..20: mol_type = other DNA
cgccacggactaatgctgtt

SEQ ID NO: 2100 - DNA, 23 bp, synthetic construct
  misc_feature 1..23: note = Synthetic Construct
  source 1..23: mol_type = other DNA
ttggctttgtatctccagcaact

SEQ ID NO: 2101 - DNA, 23 bp, synthetic construct
  misc_feature 1..23: note = Synthetic Construct
  source 1..23: mol_type = other DNA
catcgctaccgggttatgttttc

SEQ ID NO: 2102 - DNA, 21 bp, synthetic construct
  misc_feature 1..21: note = Synthetic Construct
  source 1..21: mol_type = other DNA
agaggcaaaatccgcacctaa

SEQ ID NO: 2103 - DNA, 22 bp, synthetic construct
  misc_feature 1..22: note = Synthetic Construct
  source 1..22: mol_type = other DNA
ccctgcccttctcactcacaaa

SEQ ID NO: 2104 - DNA, 22 bp, synthetic construct
  misc_feature 1..22: note = Synthetic Construct
  source 1..22: mol_type = other DNA
catgcatgaccctgctcacttt

SEQ ID NO: 2105 - DNA, 24 bp, synthetic construct
  misc_feature 1..24: note = Synthetic Construct
  source 1..24: mol_type = other DNA
ggcctgccttaagttctgctaaag

SEQ ID NO: 2106 - DNA, 23 bp, synthetic construct
  misc_feature 1..23: note = Synthetic Construct
  source 1..23: mol_type = other DNA
ggagttctgcacttgtgatgttc

SEQ ID NO: 2107 - DNA, 21 bp, synthetic construct
  misc_feature 1..21: note = Synthetic Construct
  source 1..21: mol_type = other DNA
gcgtccaaggctgggtaaaga

SEQ ID NO: 2108 - DNA, 20 bp, synthetic construct
  misc_feature 1..20: note = Synthetic Construct
  source 1..20: mol_type = other DNA
ggcagcctgggtatgtcttg

SEQ ID NO: 2109 - DNA, 25 bp, synthetic construct
  misc_feature 1..25: note = Synthetic Construct
  source 1..25: mol_type = other DNA
tcaacttgattgtctccacactgta

SEQ ID NO: 2110 - DNA, 23 bp, synthetic construct
  misc_feature 1..23: note = Synthetic Construct
  source 1..23: mol_type = other DNA
ggccggccatcccagtataattt

SEQ ID NO: 2111 - DNA, 18 bp, synthetic construct
  misc_feature 1..18: note = Synthetic Construct
  source 1..18: mol_type = other DNA
gtgcggggcttgaaggat

SEQ ID NO: 2112 - DNA, 25 bp, synthetic construct
  misc_feature 1..25: note = Synthetic Construct
  source 1..25: mol_type = other DNA
ttgttcctatcgattacccaccaaa

SEQ ID NO: 2113 - DNA, 26 bp, synthetic construct
  misc_feature 1..26: note = Synthetic Construct
  source 1..26: mol_type = other DNA
ctagtaccactttctccttgctcatt

SEQ ID NO: 2114 - DNA, 22 bp, synthetic construct
  misc_feature 1..22: note = Synthetic Construct
  source 1..22: mol_type = other DNA
ctgccagaccacaccaatctca

SEQ ID NO: 2115 - DNA, 19 bp, synthetic construct
  misc_feature 1..19: note = Synthetic Construct
  source 1..19: mol_type = other DNA
ccaggcaggacgcaactca

SEQ ID NO: 2116 - DNA, 23 bp, synthetic construct
  misc_feature 1..23: note = Synthetic Construct
  source 1..23: mol_type = other DNA
tggtatagccactctggcatttt

SEQ ID NO: 2117 - DNA, 24 bp, synthetic construct
  misc_feature 1..24: note = Synthetic Construct
  source 1..24: mol_type = other DNA
ggaggagtgcgtgcagaagtatca

SEQ ID NO: 2118 - DNA, 22 bp, synthetic construct
  misc_feature 1..22: note = Synthetic Construct
  source 1..22: mol_type = other DNA
gcctctgttttctcgggctaag

SEQ ID NO: 2119 - DNA, 22 bp, synthetic construct
  misc_feature 1..22: note = Synthetic Construct
  source 1..22: mol_type = other DNA
ccatctaccctgtgcccagaaa

SEQ ID NO: 2120 - DNA, 19 bp, synthetic construct
  misc_feature 1..19: note = Synthetic Construct
  source 1..19: mol_type = other DNA
gcccacgtcttggccttgt

SEQ ID NO: 2121 - DNA, 22 bp, synthetic construct
  misc_feature 1..22: note = Synthetic Construct
  source 1..22: mol_type = other DNA
tccgcttccacaacccaagaac

SEQ ID NO: 2122 - DNA, 25 bp, synthetic construct
  misc_feature 1..25: note = Synthetic Construct
  source 1..25: mol_type = other DNA
ccactttgccaaattccctttcatc

SEQ ID NO: 2123 - DNA, 19 bp, synthetic construct
  misc_feature 1..19: note = Synthetic Construct
  source 1..19: mol_type = other DNA
acgaggacccgcgatgtct

SEQ ID NO: 2124 - DNA, 21 bp, synthetic construct
  misc_feature 1..21: note = Synthetic Construct
  source 1..21: mol_type = other DNA
cggccagagactcactcagaa

SEQ ID NO: 2125 - DNA, 21 bp, synthetic construct
  misc_feature 1..21: note = Synthetic Construct
  source 1..21: mol_type = other DNA
acccaccaacaccacattgat

SEQ ID NO: 2126 - DNA, 22 bp, synthetic construct
  misc_feature 1..22: note = Synthetic Construct
  source 1..22: mol_type = other DNA
tcccttgagcctcctctgttct

SEQ ID NO: 2127 - DNA, 21 bp, synthetic construct
  misc_feature 1..21: note = Synthetic Construct
  source 1..21: mol_type = other DNA
ggggacagtgggaggatgtca

SEQ ID NO: 2128 - DNA, 21 bp, synthetic construct
  misc_feature 1..21: note = Synthetic Construct
  source 1..21: mol_type = other DNA
actggctagctcccagtgatg

SEQ ID NO: 2129 - DNA, 20 bp, synthetic construct
  misc_feature 1..20: note = Synthetic Construct
  source 1..20: mol_type = other DNA
cgccacctggacaggaaaca

SEQ ID NO: 2130 - DNA, 22 bp, synthetic construct
  misc_feature 1..22: note = Synthetic Construct
  source 1..22: mol_type = other DNA
agcaatcctcaggccaggaaag

SEQ ID NO: 2131 - DNA, 23 bp, synthetic construct
  misc_feature 1..23: note = Synthetic Construct
  source 1..23: mol_type = other DNA
gcctctgttacctttctcccatt

SEQ ID NO: 2132 - DNA, 19 bp, synthetic construct
  misc_feature 1..19: note = Synthetic Construct
  source 1..19: mol_type = other DNA
agctgctgggagtgggaaa

SEQ ID NO: 2133 - DNA, 21 bp, synthetic construct
  misc_feature 1..21: note = Synthetic Construct
  source 1..21: mol_type = other DNA
gcccagtgaaagggcaaaact

SEQ ID NO: 2134 - DNA, 21 bp, synthetic construct
  misc_feature 1..21: note = Synthetic Construct
  source 1..21: mol_type = other DNA
ggtccgtgcagactggacaat

SEQ ID NO: 2135 - DNA, 23 bp, synthetic construct
  misc_feature 1..23: note = Synthetic Construct
  source 1..23: mol_type = other DNA
tccatcacatgctggtgaaatgt

SEQ ID NO: 2136 - DNA, 22 bp, synthetic construct
  misc_feature 1..22: note = Synthetic Construct
  source 1..22: mol_type = other DNA
tctatgctcagggcctaacact

SEQ ID NO: 2137 - DNA, 20 bp, synthetic construct
  misc_feature 1..20: note = Synthetic Construct
  source 1..20: mol_type = other DNA
caccttcccacgttgcctat

SEQ ID NO: 2138 - DNA, 25 bp, synthetic construct
  misc_feature 1..25: note = Synthetic Construct
  source 1..25: mol_type = other DNA
tgagctacccatcagggttattttt

SEQ ID NO: 2139 - DNA, 24 bp, synthetic construct
  misc_feature 1..24: note = Synthetic Construct
  source 1..24: mol_type = other DNA
ccattgagtttcaactggggtaca

SEQ ID NO: 2140 - DNA, 22 bp, synthetic construct
  misc_feature 1..22: note = Synthetic Construct
  source 1..22: mol_type = other DNA
gcctcatcaacgacccgattca

SEQ ID NO: 2141 - DNA, 18 bp, synthetic construct
  misc_feature 1..18: note = Synthetic Construct
  source 1..18: mol_type = other DNA
accaggaccccactggtt

SEQ ID NO: 2142 - DNA, 20 bp, synthetic construct
  misc_feature 1..20: note = Synthetic Construct
  source 1..20: mol_type = other DNA
aggtctcagccctgactgtt

SEQ ID NO: 2143 - DNA, 24 bp, synthetic construct
  misc_feature 1..24: note = Synthetic Construct
  source 1..24: mol_type = other DNA
tggtttaccctgaatccactctga

SEQ ID NO: 2144 - DNA, 22 bp, synthetic construct
  misc_feature 1..22: note = Synthetic Construct
  source 1..22: mol_type = other DNA
accatatgaccgtcaggcttct

SEQ ID NO: 2145 - DNA, 19 bp, synthetic construct
  misc_feature 1..19: note = Synthetic Construct
  source 1..19: mol_type = other DNA
ccaggggttggcgtgaaag

SEQ ID NO: 2146 - DNA, 25 bp, synthetic construct
  misc_feature 1..25: note = Synthetic Construct
  source 1..25: mol_type = other DNA
caaaccaagtgcctggtagatttca

SEQ ID NO: 2147 - DNA, 19 bp, synthetic construct
  misc_feature 1..19: note = Synthetic Construct
  source 1..19: mol_type = other DNA
cctccacctgcccatcagt

SEQ ID NO: 2148 - DNA, 22 bp, synthetic construct
  misc_feature 1..22: note = Synthetic Construct
  source 1..22: mol_type = other DNA
gtagccaggcatgcatttttga

SEQ ID NO: 2149 - DNA, 22 bp, synthetic construct
  misc_feature 1..22: note = Synthetic Construct
  source 1..22: mol_type = other DNA
cccagctgtccaaaggacttca

SEQ ID NO: 2150 - DNA, 18 bp, synthetic construct
  misc_feature 1..18: note = Synthetic Construct
  source 1..18: mol_type = other DNA
ctgtcccgtgcgttccaa

SEQ ID NO: 2151 - DNA, 20 bp, synthetic construct
  misc_feature 1..20: note = Synthetic Construct
  source 1..20: mol_type = other DNA
gccacctccctcccagctaa

SEQ ID NO: 2152 - DNA, 26 bp, synthetic construct
  misc_feature 1..26: note = Synthetic Construct
  source 1..26: mol_type = other DNA
gcactttgcctttgatgcctgaaata

SEQ ID NO: 2153 - DNA, 23 bp, synthetic construct
  misc_feature 1..23: note = Synthetic Construct
  source 1..23: mol_type = other DNA
ccgcacagtagcacctctgtaag

SEQ ID NO: 2154 - DNA, 20 bp, synthetic construct
  misc_feature 1..20: note = Synthetic Construct
  source 1..20: mol_type = other DNA
ggcctcctcctctccccatt

SEQ ID NO: 2155 - DNA, 21 bp, synthetic construct
  misc_feature 1..21: note = Synthetic Construct
  source 1..21: mol_type = other DNA
tcccacccctcgatccccata

SEQ ID NO: 2156 - DNA, 21 bp, synthetic construct
  misc_feature 1..21: note = Synthetic Construct
  source 1..21: mol_type = other DNA
gaaggacatggccatcagcaa

SEQ ID NO: 2157 - DNA, 19 bp, synthetic construct
  misc_feature 1..19: note = Synthetic Construct
  source 1..19: mol_type = other DNA
aggcagagggcggtgtctt

SEQ ID NO: 2158 - DNA, 19 bp, synthetic construct
  misc_feature 1..19: note = Synthetic Construct
  source 1..19: mol_type = other DNA
cgtctgccttcctgggttt

SEQ ID NO: 2159 - DNA, 21 bp, synthetic construct
  misc_feature 1..21: note = Synthetic Construct
  source 1..21: mol_type = other DNA
aggtgaccatgtgaccacaga

SEQ ID NO: 2160 - DNA, 25 bp, synthetic construct
  misc_feature 1..25: note = Synthetic Construct
  source 1..25: mol_type = other DNA
gggtagcttattggggttcagttct

SEQ ID NO: 2161 - DNA, 22 bp, synthetic construct
  misc_feature 1..22: note = Synthetic Construct
  source 1..22: mol_type = other DNA
gccgttattgcaggcacaatct

SEQ ID NO: 2162 - DNA, 20 bp, synthetic construct
  misc_feature 1..20: note = Synthetic Construct
  source 1..20: mol_type = other DNA
aagcaggcaggaaggagaca

SEQ ID NO: 2163 - DNA, 22 bp, synthetic construct
  misc_feature 1..22: note = Synthetic Construct
  source 1..22: mol_type = other DNA
tggaccaactctcacagcagat

SEQ ID NO: 2164 - DNA, 23 bp, synthetic construct
  misc_feature 1..23: note = Synthetic Construct
  source 1..23: mol_type = other DNA
caggccaatggacagtgaagcta

SEQ ID NO: 2165 - DNA, 21 bp, synthetic construct
  misc_feature 1..21: note = Synthetic Construct
  source 1..21: mol_type = other DNA
ggtggcgaaggggtagtgaaa

SEQ ID NO: 2166 - DNA, 20 bp, synthetic construct
  misc_feature 1..20: note = Synthetic Construct
  source 1..20: mol_type = other DNA
acttcccgggcctggcttct

SEQ ID NO: 2167 - DNA, 24 bp, synthetic construct
  misc_feature 1..24: note = Synthetic Construct
  source 1..24: mol_type = other DNA
gctaggaaccttccaggcatttta

SEQ ID NO: 2168 - DNA, 27 bp, synthetic construct
  misc_feature 1..27: note = Synthetic Construct
  source 1..27: mol_type = other DNA
gttctgactttctagtaaccaccgatt

SEQ ID NO: 2169 - DNA, 19 bp, synthetic construct
  misc_feature 1..19: note = Synthetic Construct
  source 1..19: mol_type = other DNA
tccacagccgtgcatctga

SEQ ID NO: 2170 - DNA, 23 bp, synthetic construct
  misc_feature 1..23: note = Synthetic Construct
  source 1..23: mol_type = other DNA
gtgatgccaacttgggcctatga

SEQ ID NO: 2171 - DNA, 22 bp, synthetic construct
  misc_feature 1..22: note = Synthetic Construct
  source 1..22: mol_type = other DNA
gctgaaagctttgctggcttct

SEQ ID NO: 2172 - DNA, 27 bp, synthetic construct
  misc_feature 1..27: note = Synthetic Construct
  source 1..27: mol_type = other DNA
caatgggtaactaggcaagggaattat

SEQ ID NO: 2173 - DNA, 24 bp, synthetic construct
  misc_feature 1..24: note = Synthetic Construct
  source 1..24: mol_type = other DNA
cccggcctccttataatggaaaga

SEQ ID NO: 2174 - DNA, 21 bp, synthetic construct
  misc_feature 1..21: note = Synthetic Construct
  source 1..21: mol_type = other DNA
gccagttctggcgatggctaa

SEQ ID NO: 2175 - DNA, 22 bp, synthetic construct
  misc_feature 1..22: note = Synthetic Construct
  source 1..22: mol_type = other DNA
ttccctaccccttccccagaac

SEQ ID NO: 2176 - DNA, 23 bp, synthetic construct
  misc_feature 1..23: note = Synthetic Construct
  source 1..23: mol_type = other DNA
ggaagaaagccctctcgagacaa

SEQ ID NO: 2177 - DNA, 26 bp, synthetic construct
  misc_feature 1..26: note = Synthetic Construct
  source 1..26: mol_type = other DNA
gaactagccaccttgatgtcatctgt

SEQ ID NO: 2178 - DNA, 21 bp, synthetic construct
  misc_feature 1..21: note = Synthetic Construct
  source 1..21: mol_type = other DNA
tgcccaccagtgagactaaac

SEQ ID NO: 2179 - DNA, 22 bp, synthetic construct
  misc_feature 1..22: note = Synthetic Construct
  source 1..22: mol_type = other DNA
gcaggtgctaagtgtcctgctt

SEQ ID NO: 2180 - DNA, 25 bp, synthetic construct
  misc_feature 1..25: note = Synthetic Construct
  source 1..25: mol_type = other DNA
gagttcctttccctccagtttcttg

SEQ ID NO: 2181 - DNA, 20 bp, synthetic construct
  misc_feature 1..20: note = Synthetic Construct
  source 1..20: mol_type = other DNA
gccagctgaggactctcctt

SEQ ID NO: 2182 - DNA, 22 bp, synthetic construct
  misc_feature 1..22: note = Synthetic Construct
  source 1..22: mol_type = other DNA
cagtgccagtggaatcccagat

SEQ ID NO: 2183 - DNA, 22 bp, synthetic construct
  misc_feature 1..22: note = Synthetic Construct
  source 1..22: mol_type = other DNA
ctcagcctccctgagaacaaac

SEQ ID NO: 2184 - DNA, 20 bp, synthetic construct
  misc_feature 1..20: note = Synthetic Construct
  source 1..20: mol_type = other DNA
gccatgccctttccaacctt

SEQ ID NO: 2185 - DNA, 20 bp, synthetic construct
  misc_feature 1..20: note = Synthetic Construct
  source 1..20: mol_type = other DNA
acagactgcgtgtcctgcaa

SEQ ID NO: 2186 - DNA, 23 bp, synthetic construct
  misc_feature 1..23: note = Synthetic Construct
  source 1..23: mol_type = other DNA
gattacgaacgtagggcacaaac

SEQ ID NO: 2187 - DNA, 23 bp, synthetic construct
  misc_feature 1..23: note = Synthetic Construct
  source 1..23: mol_type = other DNA
cccaggggttcctgaagtgaaaa

SEQ ID NO: 2188 - DNA, 22 bp, synthetic construct
  misc_feature 1..22: note = Synthetic Construct
  source 1..22: mol_type = other DNA
gcccatccccaggagttaggat

SEQ ID NO: 2189 - DNA, 24 bp, synthetic construct
  misc_feature 1..24: note = Synthetic Construct
  source 1..24: mol_type = other DNA
aacttcctcaaacttccactccat

SEQ ID NO: 2190 - DNA, 21 bp, synthetic construct
  misc_feature 1..21: note = Synthetic Construct
  source 1..21: mol_type = other DNA
ggctttgagagcagggttgaa

SEQ ID NO: 2191 - DNA, 20 bp, synthetic construct
  misc_feature 1..20: note = Synthetic Construct
  source 1..20: mol_type = other DNA
ccacgttgggatgtgaggtt

SEQ ID NO: 2192 - DNA, 22 bp, synthetic construct
  misc_feature 1..22: note = Synthetic Construct
  source 1..22: mol_type = other DNA
ctggagccaggaagccaagaaa

SEQ ID NO: 2193 - DNA, 22 bp, synthetic construct
  misc_feature 1..22: note = Synthetic Construct
  source 1..22: mol_type = other DNA
ggatgtctgctgttgcctcttc

SEQ ID NO: 2194 - DNA, 21 bp, synthetic construct
  misc_feature 1..21: note = Synthetic Construct
  source 1..21: mol_type = other DNA
ttccagagggctccacccaaa

SEQ ID NO: 2195 - DNA, 22 bp, synthetic construct
  misc_feature 1..22: note = Synthetic Construct
  source 1..22: mol_type = other DNA
ctcggtctcctcgtacctactt

SEQ ID NO: 2196 - DNA, 22 bp, synthetic construct
  misc_feature 1..22: note = Synthetic Construct
  source 1..22: mol_type = other DNA
acgacccacttcctccttctgt

SEQ ID NO: 2197 - DNA, 25 bp, synthetic construct
  misc_feature 1..25: note = Synthetic Construct
  source 1..25: mol_type = other DNA
ccaagatgctcatccaagaatggaa

SEQ ID NO: 2198 - DNA, 21 bp, synthetic construct
  misc_feature 1..21: note = Synthetic Construct
  source 1..21: mol_type = other DNA
tgaaaaaccctggggagcaaa

SEQ ID NO: 2199 - DNA, 22 bp, synthetic construct
  misc_feature 1..22: note = Synthetic Construct
  source 1..22: mol_type = other DNA
gagagggccaagatgggaacat

SEQ ID NO: 2200 - DNA, 20 bp, synthetic construct
  misc_feature 1..20: note = Synthetic Construct
  source 1..20: mol_type = other DNA
ccccaacacactgcacagaa

SEQ ID NO: 2201 - DNA, 26 bp, synthetic construct
  misc_feature 1..26: note = Synthetic Construct
  source 1..26: mol_type = other DNA
ctgctctgctcaatccataccatttc

SEQ ID NO: 2202 - DNA, 20 bp, synthetic construct
  misc_feature 1..20: note = Synthetic Construct
  source 1..20: mol_type = other DNA
caagggcaagcccagtgtct

SEQ ID NO: 2203 - DNA, 19 bp, synthetic construct
  misc_feature 1..19: note = Synthetic Construct
  source 1..19: mol_type = other DNA
cggggaggccatcactgtt

SEQ ID NO: 2204 - DNA, 21 bp, synthetic construct
  misc_feature 1..21: note = Synthetic Construct
  source 1..21: mol_type = other DNA
gcccatggtcactagctcaaa

SEQ ID NO: 2205 - DNA, 22 bp, synthetic construct
  misc_feature 1..22: note = Synthetic Construct
  source 1..22: mol_type = other DNA
gctcccagatgtttcggatcaa

SEQ ID NO: 2206 - DNA, 20 bp, synthetic construct
  misc_feature 1..20: note = Synthetic Construct
  source 1..20: mol_type = other DNA
tccccaggtgtctgtggaaa

SEQ ID NO: 2207 - DNA, 21 bp, synthetic construct
  misc_feature 1..21: note = Synthetic Construct
  source 1..21: mol_type = other DNA
gttcagcccaacctggaaagt

SEQ ID NO: 2208 - DNA, 26 bp, synthetic construct
  misc_feature 1..26: note = Synthetic Construct
  source 1..26: mol_type = other DNA
gatttttcaaggacctactggacact

SEQ ID NO: 2209 - DNA, 22 bp, synthetic construct
  misc_feature 1..22: note = Synthetic Construct
  source 1..22: mol_type = other DNA
cccaaggcagtggtatttccaa

SEQ ID NO: 2210 - DNA, 21 bp, synthetic construct
  misc_feature 1..21: note = Synthetic Construct
  source 1..21: mol_type = other DNA
agggtggtggcctacaggatt

SEQ ID NO: 2211 - DNA, 20 bp, synthetic construct
  misc_feature 1..20: note = Synthetic Construct
  source 1..20: mol_type = other DNA
tacaacgcgccaggtgtaac

SEQ ID NO: 2212 - DNA, 20 bp, synthetic construct
  misc_feature 1..20: note = Synthetic Construct
  source 1..20: mol_type = other DNA
acagcggcctccttcctttt

SEQ ID NO: 2213 - DNA, 23 bp, synthetic construct
  misc_feature 1..23: note = Synthetic Construct
  source 1..23: mol_type = other DNA
ttgcatggttgaatgcactgtag

SEQ ID NO: 2214 - DNA, 21 bp, synthetic construct
  misc_feature 1..21: note = Synthetic Construct
  source 1..21: mol_type = other DNA
acctcaggatgctgccatttg

SEQ ID NO: 2215 - DNA, 19 bp, synthetic construct
  misc_feature 1..19: note = Synthetic Construct
  source 1..19: mol_type = other DNA
cagcagctggtgggcaaag

SEQ ID NO: 2216 - DNA, 22 bp, synthetic construct
  misc_feature 1..22: note = Synthetic Construct
  source 1..22: mol_type = other DNA
gagccacctgaaaccaccaaag

SEQ ID NO: 2217 - DNA, 20 bp, synthetic construct
  misc_feature 1..20: note = Synthetic Construct
  source 1..20: mol_type = other DNA
gcccttgcggctctacatta

SEQ ID NO: 2218 - DNA, 20 bp, synthetic construct
  misc_feature 1..20: note = Synthetic Construct
  source 1..20: mol_type = other DNA
tgaggcaggcattggacatt

SEQ ID NO: 2219 - DNA, 24 bp, synthetic construct
  misc_feature 1..24: note = Synthetic Construct
  source 1..24: mol_type = other DNA
tcttgctttgcctaacagggtatt

SEQ ID NO: 2220 - DNA, 23 bp, synthetic construct
  misc_feature 1..23: note = Synthetic Construct
  source 1..23: mol_type = other DNA
gcatttttggcccactgaacact

SEQ ID NO: 2221 - DNA, 24 bp, synthetic construct
  misc_feature 1..24: note = Synthetic Construct
  source 1..24: mol_type = other DNA
ggtgccaagctgagaaggtacttg

SEQ ID NO: 2222 - DNA, 20 bp, synthetic construct
  misc_feature 1..20: note = Synthetic Construct
  source 1..20: mol_type = other DNA
gcagaagagcctcacacact

SEQ ID NO: 2223 - DNA, 23 bp, synthetic construct
  misc_feature 1..23: note = Synthetic Construct
  source 1..23: mol_type = other DNA
ggaaatggctggcctgtaacctt

SEQ ID NO: 2224 - DNA, 23 bp, synthetic construct
  misc_feature 1..23: note = Synthetic Construct
  source 1..23: mol_type = other DNA
aatctcctggtcccacccctact

SEQ ID NO: 2225 - DNA, 19 bp, synthetic construct
  misc_feature 1..19: note = Synthetic Construct
  source 1..19: mol_type = other DNA
tggcaccctggctctctct

SEQ ID NO: 2226 - DNA, 21 bp, synthetic construct
  misc_feature 1..21: note = Synthetic Construct
  source 1..21: mol_type = other DNA
agctcagccagtgcttgattt

SEQ ID NO: 2227 - DNA, 18 bp, synthetic construct
  misc_feature 1..18: note = Synthetic Construct
  source 1..18: mol_type = other DNA
aaggggcggcaacattca

SEQ ID NO: 2228 - DNA, 20 bp, synthetic construct
  misc_feature 1..20: note = Synthetic Construct
  source 1..20: mol_type = other DNA
atgtactgtgcccgcgactt

SEQ ID NO: 2229 - DNA, 23 bp, synthetic construct
  misc_feature 1..23: note = Synthetic Construct
  source 1..23: mol_type = other DNA
gccactgacaaattgccgagttt

SEQ ID NO: 2230 - DNA, 23 bp, synthetic construct
  misc_feature 1..23: note = Synthetic Construct
  source 1..23: mol_type = other DNA
gggtagacatggtggacgtggat

SEQ ID NO: 2231 - DNA, 20 bp, synthetic construct
  misc_feature 1..20: note = Synthetic Construct
  source 1..20: mol_type = other DNA
cctcagcagtgccacaaatg

SEQ ID NO: 2232 - DNA, 23 bp, synthetic construct
  misc_feature 1..23: note = Synthetic Construct
  source 1..23: mol_type = other DNA
gctcatggggctgaagatagaca

SEQ ID NO: 2233 - DNA, 21 bp, synthetic construct
  misc_feature 1..21: note = Synthetic Construct
  source 1..21: mol_type = other DNA
aggtctgtggccctagcatgt

SEQ ID NO: 2234 - DNA, 22 bp, synthetic construct
  misc_feature 1..22: note = Synthetic Construct
  source 1..22: mol_type = other DNA
accctggtcattgctggaaaag

SEQ ID NO: 2235 - DNA, 22 bp, synthetic construct
  misc_feature 1..22: note = Synthetic Construct
  source 1..22: mol_type = other DNA
ccaacatcccagccaaatcaag

SEQ ID NO: 2236 - DNA, 21 bp, synthetic construct
  misc_feature 1..21: note = Synthetic Construct
  source 1..21: mol_type = other DNA
ggtgacggtgtcttcacttca

SEQ ID NO: 2237 - DNA, 22 bp, synthetic construct
  misc_feature 1..22: note = Synthetic Construct
  source 1..22: mol_type = other DNA
ggtatcagacagccctgcatct

SEQ ID NO: 2238 - DNA, 20 bp, synthetic construct
  misc_feature 1..20: note = Synthetic Construct
  source 1..20: mol_type = other DNA
agtcgcgtctggtagagcat

SEQ ID NO: 2239 - DNA, 19 bp, synthetic construct
  misc_feature 1..19: note = Synthetic Construct
  source 1..19: mol_type = other DNA
tgctgccgtggctctcaca

SEQ ID NO: 2240 - DNA, 22 bp, synthetic construct
  misc_feature 1..22: note = Synthetic Construct
  source 1..22: mol_type = other DNA
accctcatccagcactccacta

SEQ ID NO: 2241 - DNA, 21 bp, synthetic construct
  misc_feature 1..21: note = Synthetic Construct
  source 1..21: mol_type = other DNA
tgtttcagcctccaacgtgat

SEQ ID NO: 2242 - DNA, 20 bp, synthetic construct
  misc_feature 1..20: note = Synthetic Construct
  source 1..20: mol_type = other DNA
atctccagacgtcggcaatg

SEQ ID NO: 2243 - DNA, 21 bp, synthetic construct
  misc_feature 1..21: note = Synthetic Construct
  source 1..21: mol_type = other DNA
gcagggaagaggcagcattga

SEQ ID NO: 2244 - DNA, 20 bp, synthetic construct
  misc_feature 1..20: note = Synthetic Construct
  source 1..20: mol_type = other DNA
agcgtgtgcagggtaatgaa

SEQ ID NO: 2245 - DNA, 22 bp, synthetic construct
  misc_feature 1..22: note = Synthetic Construct
  source 1..22: mol_type = other DNA
gttctccactgcgtggtgacta

SEQ ID NO: 2246 - DNA, 24 bp, synthetic construct
  misc_feature 1..24: note = Synthetic Construct
  source 1..24: mol_type = other DNA
actgctgatttttctccagaccat

SEQ ID NO: 2247 - DNA, 20 bp, synthetic construct
  misc_feature 1..20: note = Synthetic Construct
  source 1..20: mol_type = other DNA
aatccggttcccacctccat

SEQ ID NO: 2248 - DNA, 23 bp, synthetic construct
  misc_feature 1..23: note = Synthetic Construct
  source 1..23: mol_type = other DNA
gggaggtggtggagtcagaatca

SEQ ID NO: 2249 - DNA, 25 bp, synthetic construct
  misc_feature 1..25: note = Synthetic Construct
  source 1..25: mol_type = other DNA
acacacagctaaaagaaagcagttg

SEQ ID NO: 2250 - DNA, 21 bp, synthetic construct
  misc_feature 1..21: note = Synthetic Construct
  source 1..21: mol_type = other DNA
acctttgtgcctgctgaatct

SEQ ID NO: 2251 - DNA, 20 bp, synthetic construct
  misc_feature 1..20: note = Synthetic Construct
  source 1..20: mol_type = other DNA
gactggctggcaccaagatt

SEQ ID NO: 2252 - DNA, 25 bp, synthetic construct
  misc_feature 1..25: note = Synthetic Construct
  source 1..25: mol_type = other DNA
ccttctacagacattgcaggtcatc

SEQ ID NO: 2253 - DNA, 26 bp, synthetic construct
  misc_feature 1..26: note = Synthetic Construct
  source 1..26: mol_type = other DNA
ggacaatgattttgagctacggtgta

SEQ ID NO: 2254 - DNA, 21 bp, synthetic construct
  misc_feature 1..21: note = Synthetic Construct
  source 1..21: mol_type = other DNA
aacccacagggtcccctaaca

SEQ ID NO: 2255 - DNA, 22 bp, synthetic construct
  misc_feature 1..22: note = Synthetic Construct
  source 1..22: mol_type = other DNA
cactgccaggggaagaaactga

SEQ ID NO: 2256 - DNA, 25 bp, synthetic construct
  misc_feature 1..25: note = Synthetic Construct
  source 1..25: mol_type = other DNA
gtctatgccagttgctagaggaaac

SEQ ID NO: 2257 - DNA, 20 bp, synthetic construct
  misc_feature 1..20: note = Synthetic Construct
  source 1..20: mol_type = other DNA
ggggaccatcagtgccatct

SEQ ID NO: 2258 - DNA, 19 bp, synthetic construct
  misc_feature 1..19: note = Synthetic Construct
  source 1..19: mol_type = other DNA
ccgccaggcttcagacctt

SEQ ID NO: 2259 - DNA, 18 bp, synthetic construct
  misc_feature 1..18: note = Synthetic Construct
  source 1..18: mol_type = other DNA
tgggcctcccctgaacaa

SEQ ID NO: 2260 - DNA, 24 bp, synthetic construct
  misc_feature 1..24: note = Synthetic Construct
  source 1..24: mol_type = other DNA
gaggagtcaaggaatcgaggatga

SEQ ID NO: 2261 - DNA, 25 bp, synthetic construct
  misc_feature 1..25: note = Synthetic Construct
  source 1..25: mol_type = other DNA
ggtaatgtgtagaccccacagttca

SEQ ID NO: 2262 - DNA, 21 bp, synthetic construct
  misc_feature 1..21: note = Synthetic Construct
  source 1..21: mol_type = other DNA
tgaacccacagccccatctca

SEQ ID NO: 2263 - DNA, 20 bp, synthetic construct
  misc_feature 1..20: note = Synthetic Construct
  source 1..20: mol_type = other DNA
acctgcggcaagatctcagt

SEQ ID NO: 2264 - DNA, 20 bp, synthetic construct
  misc_feature 1..20: note = Synthetic Construct
  source 1..20: mol_type = other DNA
tgctgggtccctggatggat

SEQ ID NO: 2265 - DNA, 22 bp, synthetic construct
  misc_feature 1..22: note = Synthetic Construct
  source 1..22: mol_type = other DNA
actctccaccaggcatgcagat

SEQ ID NO: 2266 - DNA, 22 bp, synthetic construct
  misc_feature 1..22: note = Synthetic Construct
  source 1..22: mol_type = other DNA
tctgagagaggctggctacctt

SEQ ID NO: 2267 - DNA, 21 bp, synthetic construct
  misc_feature 1..21: note = Synthetic Construct
  source 1..21: mol_type = other DNA
agcctgaggacttggcagtca

SEQ ID NO: 2268 - DNA, 20 bp, synthetic construct
  misc_feature 1..20: note = Synthetic Construct
  source 1..20: mol_type = other DNA
tcgggcaactgctcctctgt

SEQ ID NO: 2269 - DNA, 20 bp, synthetic construct
  misc_feature 1..20: note = Synthetic Construct
  source 1..20: mol_type = other DNA
gggacaactttggggcttga

SEQ ID NO: 2270 - DNA, 20 bp, synthetic construct
  misc_feature 1..20: note = Synthetic Construct
  source 1..20: mol_type = other DNA
ggccaagctttcagcctttc

SEQ ID NO: 2271 - DNA, 24 bp, synthetic construct
  misc_feature 1..24: note = Synthetic Construct
  source 1..24: mol_type = other DNA
ctggatgagaatggttggcctaat

SEQ ID NO: 2272 - DNA, 19 bp, synthetic construct
  misc_feature 1..19: note = Synthetic Construct
  source 1..19: mol_type = other DNA
agcgagccctgcagcaaga

SEQ ID NO: 2273 - DNA, 22 bp, synthetic construct
  misc_feature 1..22: note = Synthetic Construct
  source 1..22: mol_type = other DNA
cagagcagggctgtcattgtct

SEQ ID NO: 2274 - DNA, 24 bp, synthetic construct
  misc_feature 1..24: note = Synthetic Construct
  source 1..24: mol_type = other DNA
caggaaatccaggggacagaagaa

SEQ ID NO: 2275 - DNA, 22 bp, synthetic construct
  misc_feature 1..22: note = Synthetic Construct
  source 1..22: mol_type = other DNA
ggccaaacacatcagggagcaa

SEQ ID NO: 2276 - DNA, 20 bp, synthetic construct
  misc_feature 1..20: note = Synthetic Construct
  source 1..20: mol_type = other DNA
tggggctgctgggagaggaa

SEQ ID NO: 2277 - DNA, 20 bp, synthetic construct
  misc_feature 1..20: note = Synthetic Construct
  source 1..20: mol_type = other DNA
gggtggcaaccctcagattc

SEQ ID NO: 2278 - DNA, 24 bp, synthetic construct
  misc_feature 1..24: note = Synthetic Construct
  source 1..24: mol_type = other DNA
cttgtttgccagatttacctgtgt

SEQ ID NO: 2279 - DNA, 20 bp, synthetic construct
  misc_feature 1..20: note = Synthetic Construct
  source 1..20: mol_type = other DNA
gcttgtggtcctgggtgtca

SEQ ID NO: 2280 - DNA, 22 bp, synthetic construct
  misc_feature 1..22: note = Synthetic Construct
  source 1..22: mol_type = other DNA
aaggcgaggtcacctgagtaag

SEQ ID NO: 2281 - DNA, 23 bp, synthetic construct
  misc_feature 1..23: note = Synthetic Construct
  source 1..23: mol_type = other DNA
ccagaagaggtgtggcctgaaag

SEQ ID NO: 2282 - DNA, 21 bp, synthetic construct
  misc_feature 1..21: note = Synthetic Construct
  source 1..21: mol_type = other DNA
cagtcagtagagggcgctgtt

SEQ ID NO: 2283 - DNA, 24 bp, synthetic construct
  misc_feature 1..24: note = Synthetic Construct
  source 1..24: mol_type = other DNA
ggatgggaatgggtaaggcacaga

SEQ ID NO: 2284 - DNA, 23 bp, synthetic construct
  misc_feature 1..23: note = Synthetic Construct
  source 1..23: mol_type = other DNA
ggagcttttgactggggttcact

SEQ ID NO: 2285 - DNA, 22 bp, synthetic construct
  misc_feature 1..22: note = Synthetic Construct
  source 1..22: mol_type = other DNA
ccaaggtccctggtctggaagt

SEQ ID NO: 2286 - DNA, 20 bp, synthetic construct
  misc_feature 1..20: note = Synthetic Construct
  source 1..20: mol_type = other DNA
gggcagagcaatagccgaaa

SEQ ID NO: 2287 - DNA, 21 bp, synthetic construct
  misc_feature 1..21: note = Synthetic Construct
  source 1..21: mol_type = other DNA
ggcccacgtggtcagattgtt

SEQ ID NO: 2288 - DNA, 23 bp, synthetic construct
  misc_feature 1..23: note = Synthetic Construct
  source 1..23: mol_type = other DNA
cgagagcctgagcatgtacaaat

SEQ ID NO: 2289 - DNA, 28 bp, synthetic construct
  misc_feature 1..28: note = Synthetic Construct
  source 1..28: mol_type = other DNA
gttatcttctcactgtcctgttccttag

SEQ ID NO: 2290 - DNA, 22 bp, synthetic construct
  misc_feature 1..22: note = Synthetic Construct
  source 1..22: mol_type = other DNA
gcttctgcccagtgctcaagat

SEQ ID NO: 2291 - DNA, 25 bp, synthetic construct
  misc_feature 1..25: note = Synthetic Construct
  source 1..25: mol_type = other DNA
ggctctgtagggcttctagaatgtt

SEQ ID NO: 2292 - DNA, 22 bp, synthetic construct
  misc_feature 1..22: note = Synthetic Construct
  source 1..22: mol_type = other DNA
gggtgtagagcaggatgggtta

SEQ ID NO: 2293 - DNA, 24 bp, synthetic construct
  misc_feature 1..24: note = Synthetic Construct
  source 1..24: mol_type = other DNA
gtccccgaaacccacactgtattc

SEQ ID NO: 2294 - DNA, 21 bp, synthetic construct
  misc_feature 1..21: note = Synthetic Construct
  source 1..21: mol_type = other DNA
cccaaaactgaggtggagctt

SEQ ID NO: 2295 - DNA, 21 bp, synthetic construct
  misc_feature 1..21: note = Synthetic Construct
  source 1..21: mol_type = other DNA
gtgaccagtgctagctgacaa

SEQ ID NO: 2296 - DNA, 22 bp, synthetic construct
  misc_feature 1..22: note = Synthetic Construct
  source 1..22: mol_type = other DNA
ttccggaggtcagatcccaaga

SEQ ID NO: 2297 - DNA, 19 bp, synthetic construct
  misc_feature 1..19: note = Synthetic Construct
  source 1..19: mol_type = other DNA
cagctcatccgcccacaga

SEQ ID NO: 2298 - DNA, 19 bp, synthetic construct
  misc_feature 1..19: note = Synthetic Construct
  source 1..19: mol_type = other DNA
agggagcagcgcgactgaa

SEQ ID NO: 2299 - DNA, 23 bp, synthetic construct
  misc_feature 1..23: note = Synthetic Construct
  source 1..23: mol_type = other DNA
ggcagtggggtccatttgaaaca

SEQ ID NO: 2300 - DNA, 21 bp, synthetic construct
  misc_feature 1..21: note = Synthetic Construct
  source 1..21: mol_type = other DNA
tctccagaagcctcgccttga

SEQ ID NO: 2301 - DNA, 23 bp, synthetic construct
  misc_feature 1..23: note = Synthetic Construct
  source 1..23: mol_type = other DNA
gccgcatgtctctacttcttctt

SEQ ID NO: 2302 - DNA, 20 bp, synthetic construct
  misc_feature 1..20: note = Synthetic Construct
  source 1..20: mol_type = other DNA
aggccgagcagctttagtct

SEQ ID NO: 2303 - DNA, 23 bp, synthetic construct
  misc_feature 1..23: note = Synthetic Construct
  source 1..23: mol_type = other DNA
tcaagatggagcacaacaaccaa

SEQ ID NO: 2304 - DNA, 22 bp, synthetic construct
  misc_feature 1..22: note = Synthetic Construct
  source 1..22: mol_type = other DNA
gtgttgagcaggcaacttgtga

SEQ ID NO: 2305 - DNA, 21 bp, synthetic construct
  misc_feature 1..21: note = Synthetic Construct
  source 1..21: mol_type = other DNA
actcatcaccttggcatgctt

SEQ ID NO: 2306 - DNA, 25 bp, synthetic construct
  misc_feature 1..25: note = Synthetic Construct
  source 1..25: mol_type = other DNA
tcagccaagaaggtatttgttggaa

SEQ ID NO: 2307 - DNA, 23 bp, synthetic construct
  misc_feature 1..23: note = Synthetic Construct
  source 1..23: mol_type = other DNA
caatgcaggagcttctccacaaa

SEQ ID NO: 2308 - DNA, 22 bp, synthetic construct
  misc_feature 1..22: note = Synthetic Construct
  source 1..22: mol_type = other DNA
cccaccaaagggagccaattct

SEQ ID NO: 2309 - DNA, 21 bp, synthetic construct
  misc_feature 1..21: note = Synthetic Construct
  source 1..21: mol_type = other DNA
ctttgccctggcatctgaaac

SEQ ID NO: 2310 - DNA, 20 bp, synthetic construct
  misc_feature 1..20: note = Synthetic Construct
  source 1..20: mol_type = other DNA
ctctggcacctggaaacact

SEQ ID NO: 2311 - DNA, 24 bp, synthetic construct
  misc_feature 1..24: note = Synthetic Construct
  source 1..24: mol_type = other DNA
tcatccatcctgagccaaatttct

SEQ ID NO: 2312 - DNA, 24 bp, synthetic construct
  misc_feature 1..24: note = Synthetic Construct
  source 1..24: mol_type = other DNA
aaatccagccacaggatgatacaa

SEQ ID NO: 2313 - DNA, 23 bp, synthetic construct
  misc_feature 1..23: note = Synthetic Construct
  source 1..23: mol_type = other DNA
gcaccaaggaagcatcaggtact

SEQ ID NO: 2314 - DNA, 20 bp, synthetic construct
  misc_feature 1..20: note = Synthetic Construct
  source 1..20: mol_type = other DNA
ctgctcaggggccagacttc

SEQ ID NO: 2315 - DNA, 27 bp, synthetic construct
  misc_feature 1..27: note = Synthetic Construct
  source 1..27: mol_type = other DNA
gaagagcagtttcacttatctgtgtca

SEQ ID NO: 2316 - DNA, 23 bp, synthetic construct
  misc_feature 1..23: note = Synthetic Construct
  source 1..23: mol_type = other DNA
gcctccggatctgttgctagtga

SEQ ID NO: 2317 - DNA, 22 bp, synthetic construct
  misc_feature 1..22: note = Synthetic Construct
  source 1..22: mol_type = other DNA
aggggagcctcagcatcctaaa

SEQ ID NO: 2318 - DNA, 19 bp, synthetic construct
  misc_feature 1..19: note = Synthetic Construct
  source 1..19: mol_type = other DNA
cggctgactgcagttgtct

SEQ ID NO: 2319 - DNA, 20 bp, synthetic construct
  misc_feature 1..20: note = Synthetic Construct
  source 1..20: mol_type = other DNA
tcgcttcgggctttcagcaa

SEQ ID NO: 2320 - DNA, 23 bp, synthetic construct
  misc_feature 1..23: note = Synthetic Construct
  source 1..23: mol_type = other DNA
gatcagaactcctggcatgatga

SEQ ID NO: 2321 - DNA, 20 bp, synthetic construct
  misc_feature 1..20: note = Synthetic Construct
  source 1..20: mol_type = other DNA
gagagcccctcaggctcttg

SEQ ID NO: 2322 - DNA, 22 bp, synthetic construct
  misc_feature 1..22: note = Synthetic Construct
  source 1..22: mol_type = other DNA
ccccaggagagctggtgtatga

SEQ ID NO: 2323 - DNA, 21 bp, synthetic construct
  misc_feature 1..21: note = Synthetic Construct
  source 1..21: mol_type = other DNA
actgtcctgttccacccttca

SEQ ID NO: 2324 - DNA, 22 bp, synthetic construct
  misc_feature 1..22: note = Synthetic Construct
  source 1..22: mol_type = other DNA
agggcccctactaccactttag

SEQ ID NO: 2325 - DNA, 24 bp, synthetic construct
  misc_feature 1..24: note = Synthetic Construct
  source 1..24: mol_type = other DNA
gaccagggaagaaagacctctgaa

SEQ ID NO: 2326 - DNA, 22 bp, synthetic construct
  misc_feature 1..22: note = Synthetic Construct
  source 1..22: mol_type = other DNA
tggacactgccgtaaggtgaag

SEQ ID NO: 2327 - DNA, 22 bp, synthetic construct
  misc_feature 1..22: note = Synthetic Construct
  source 1..22: mol_type = other DNA
gcctttccacctcgatgtcttc

SEQ ID NO: 2328 - DNA, 20 bp, synthetic construct
  misc_feature 1..20: note = Synthetic Construct
  source 1..20: mol_type = other DNA
ttcccatggcagatgctgtt

SEQ ID NO: 2329 - DNA, 24 bp, synthetic construct
  misc_feature 1..24: note = Synthetic Construct
  source 1..24: mol_type = other DNA
ggggataaatgtcacaagctggat

SEQ ID NO: 2330 - DNA, 26 bp, synthetic construct
  misc_feature 1..26: note = Synthetic Construct
  source 1..26: mol_type = other DNA
ggcttactatgcctgctaaacattac

SEQ ID NO: 2331 - DNA, 23 bp, synthetic construct
  misc_feature 1..23: note = Synthetic Construct
  source 1..23: mol_type = other DNA
tggtacctgatatgcagccattg

SEQ ID NO: 2332 - DNA, 21 bp, synthetic construct
  misc_feature 1..21: note = Synthetic Construct
  source 1..21: mol_type = other DNA
aggcagggcaaatggtgtatc

SEQ ID NO: 2333 - DNA, 24 bp, synthetic construct
  misc_feature 1..24: note = Synthetic Construct
  source 1..24: mol_type = other DNA
gcagacctactgacccctttggtt

SEQ ID NO: 2334 - DNA, 25 bp, synthetic construct
  misc_feature 1..25: note = Synthetic Construct
  source 1..25: mol_type = other DNA
cagtactgagtcccttgtgtttttg

SEQ ID NO: 2335 - DNA, 21 bp, synthetic construct
  misc_feature 1..21: note = Synthetic Construct
  source 1..21: mol_type = other DNA
catcactcccctctgctgcta

SEQ ID NO: 2336 - DNA, 20 bp, synthetic construct
  misc_feature 1..20: note = Synthetic Construct
  source 1..20: mol_type = other DNA
aggccactgccttctacctt

SEQ ID NO: 2337 - DNA, 18 bp, synthetic construct
  misc_feature 1..18: note = Synthetic Construct
  source 1..18: mol_type = other DNA
acgagggctggcacgaaa

SEQ ID NO: 2338 - DNA, 24 bp, synthetic construct
  misc_feature 1..24: note = Synthetic Construct
  source 1..24: mol_type = other DNA
gacagcttgcagtcaagaccttct

SEQ ID NO: 2339 - DNA, 23 bp, synthetic construct
  misc_feature 1..23: note = Synthetic Construct
  source 1..23: mol_type = other DNA
catggggaatgggtcagtacagt

SEQ ID NO: 2340 - DNA, 24 bp, synthetic construct
  misc_feature 1..24: note = Synthetic Construct
  source 1..24: mol_type = other DNA
gccagtggaggtagtagcatttac

SEQ ID NO: 2341 - DNA, 23 bp, synthetic construct
  misc_feature 1..23: note = Synthetic Construct
  source 1..23: mol_type = other DNA
gttacagcatcaagtgcaacagt

SEQ ID NO: 2342 - DNA, 22 bp, synthetic construct
  misc_feature 1..22: note = Synthetic Construct
  source 1..22: mol_type = other DNA
tgaggatttcctgggacacaga

SEQ ID NO: 2343 - DNA, 20 bp, synthetic construct
  misc_feature 1..20: note = Synthetic Construct
  source 1..20: mol_type = other DNA
agcggctgtgtgcagaatca

SEQ ID NO: 2344 - DNA, 22 bp, synthetic construct
  misc_feature 1..22: note = Synthetic Construct
  source 1..22: mol_type = other DNA
actgcctccaatgacccaggat

SEQ ID NO: 2345 - DNA, 20 bp, synthetic construct
  misc_feature 1..20: note = Synthetic Construct
  source 1..20: mol_type = other DNA
tccctgcgttgcttctcact

SEQ ID NO: 2346 - DNA, 21 bp, synthetic construct
  misc_feature 1..21: note = Synthetic Construct
  source 1..21: mol_type = other DNA
ttggactccagtgctttgcat

SEQ ID NO: 2347 - DNA, 24 bp, synthetic construct
  misc_feature 1..24: note = Synthetic Construct
  source 1..24: mol_type = other DNA
tcttttggcactacgagctatgaa

SEQ ID NO: 2348 - DNA, 23 bp, synthetic construct
  misc_feature 1..23: note = Synthetic Construct
  source 1..23: mol_type = other DNA
ccaaagcacattagcctgtgatg

SEQ ID NO: 2349 - DNA, 19 bp, synthetic construct
  misc_feature 1..19: note = Synthetic Construct
  source 1..19: mol_type = other DNA
tggcccaggtccattctct

SEQ ID NO: 2350 - DNA, 25 bp, synthetic construct
  misc_feature 1..25: note = Synthetic Construct
  source 1..25: mol_type = other DNA
ggaaaacaacttgtccctcactttg

SEQ ID NO: 2351 - DNA, 21 bp, synthetic construct
  misc_feature 1..21: note = Synthetic Construct
  source 1..21: mol_type = other DNA
aggagggtacctccgtctcta

SEQ ID NO: 2352 - DNA, 24 bp, synthetic construct
  misc_feature 1..24: note = Synthetic Construct
  source 1..24: mol_type = other DNA
gtaggcttccaatgccaagaaatg

SEQ ID NO: 2353 - DNA, 23 bp, synthetic construct
  misc_feature 1..23: note = Synthetic Construct
  source 1..23: mol_type = other DNA
ctcaggcatggacacctatcttc

SEQ ID NO: 2354 - DNA, 20 bp, synthetic construct
  misc_feature 1..20: note = Synthetic Construct
  source 1..20: mol_type = other DNA
agctcccactccaactcaga

SEQ ID NO: 2355 - DNA, 20 bp, synthetic construct
  misc_feature 1..20: note = Synthetic Construct
  source 1..20: mol_type = other DNA
gcaggcgagactccccaaac

SEQ ID NO: 2356 - DNA, 20 bp, synthetic construct
  misc_feature 1..20: note = Synthetic Construct
  source 1..20: mol_type = other DNA
tgcactcttgcggaggaaaa

SEQ ID NO: 2357 - DNA, 19 bp, synthetic construct
  misc_feature 1..19: note = Synthetic Construct
  source 1..19: mol_type = other DNA
gctcaggctggcttgaaca

SEQ ID NO: 2358 - DNA, 22 bp, synthetic construct
  misc_feature 1..22: note = Synthetic Construct
  source 1..22: mol_type = other DNA
ggctggacagttggttgctgat

SEQ ID NO: 2359 - DNA, 20 bp, synthetic construct
  misc_feature 1..20: note = Synthetic Construct
  source 1..20: mol_type = other DNA
agatcagcgaccctgaggaa

SEQ ID NO: 2360 - DNA, 20 bp, synthetic construct
  misc_feature 1..20: note = Synthetic Construct
  source 1..20: mol_type = other DNA
aggcaccccttactgtgaga

SEQ ID NO: 2361 - DNA, 23 bp, synthetic construct
  misc_feature 1..23: note = Synthetic Construct
  source 1..23: mol_type = other DNA
ccaggatggagaatgcagacaca

SEQ ID NO: 2362 - DNA, 23 bp, synthetic construct
  misc_feature 1..23: note = Synthetic Construct
  source 1..23: mol_type = other DNA
agaccagaatggatggaggtgta

SEQ ID NO: 2363 - DNA, 22 bp, synthetic construct
  misc_feature 1..22: note = Synthetic Construct
  source 1..22: mol_type = other DNA
cgctacctcctcaagccagaaa

SEQ ID NO: 2364 - DNA, 20 bp, synthetic construct
  misc_feature 1..20: note = Synthetic Construct
  source 1..20: mol_type = other DNA
tggcagccctccaccatttt

SEQ ID NO: 2365 - DNA, 22 bp, synthetic construct
  misc_feature 1..22: note = Synthetic Construct
  source 1..22: mol_type = other DNA
tggcaggtgacaaggtgaattt

SEQ ID NO: 2366 - DNA, 24 bp, synthetic construct
  misc_feature 1..24: note = Synthetic Construct
  source 1..24: mol_type = other DNA
aattccctacggagtgaaacacaa

SEQ ID NO: 2367 - DNA, 25 bp, synthetic construct
  misc_feature 1..25: note = Synthetic Construct
  source 1..25: mol_type = other DNA
tgtgtaagggcaggataaaacaact

SEQ ID NO: 2368 - DNA, 22 bp, synthetic construct
  misc_feature 1..22: note = Synthetic Construct
  source 1..22: mol_type = other DNA
acctcaacctctgtgtgtgttc

SEQ ID NO: 2369 - DNA, 23 bp, synthetic construct
  misc_feature 1..23: note = Synthetic Construct
  source 1..23: mol_type = other DNA
ccacagtgagggtgaacaatcat

SEQ ID NO: 2370 - DNA, 20 bp, synthetic construct
  misc_feature 1..20: note = Synthetic Construct
  source 1..20: mol_type = other DNA
cctcactcccctcctgtctt

SEQ ID NO: 2371 - DNA, 27 bp, synthetic construct
  misc_feature 1..27: note = Synthetic Construct
  source 1..27: mol_type = other DNA
acagctagtctggataaaacctagaga

SEQ ID NO: 2372 - DNA, 25 bp, synthetic construct
  misc_feature 1..25: note = Synthetic Construct
  source 1..25: mol_type = other DNA
cattctctgtacattggagggaact

SEQ ID NO: 2373 - DNA, 23 bp, synthetic construct
  misc_feature 1..23: note = Synthetic Construct
  source 1..23: mol_type = other DNA
ggtgggacgagtcaatcactaag

SEQ ID NO: 2374 - DNA, 19 bp, synthetic construct
  misc_feature 1..19: note = Synthetic Construct
  source 1..19: mol_type = other DNA
caccgtgcccagcctgtaa

SEQ ID NO: 2375 - DNA, 23 bp, synthetic construct
  misc_feature 1..23: note = Synthetic Construct
  source 1..23: mol_type = other DNA
ggcatgttagcgagcattttaca

SEQ ID NO: 2376 - DNA, 23 bp, synthetic construct
  misc_feature 1..23: note = Synthetic Construct
  source 1..23: mol_type = other DNA
gttctcgttcagacagtggttct

SEQ ID NO: 2377 - DNA, 25 bp, synthetic construct
  misc_feature 1..25: note = Synthetic Construct
  source 1..25: mol_type = other DNA
caggaacctcatcctgagttgattt

SEQ ID NO: 2378 - DNA, 21 bp, synthetic construct
  misc_feature 1..21: note = Synthetic Construct
  source 1..21: mol_type = other DNA
tcttgctggaccagagtgtga

SEQ ID NO: 2379 - DNA, 21 bp, synthetic construct
  misc_feature 1..21: note = Synthetic Construct
  source 1..21: mol_type = other DNA
aggcccgagggagtttgtttg

SEQ ID NO: 2380 - DNA, 22 bp, synthetic construct
  misc_feature 1..22: note = Synthetic Construct
  source 1..22: mol_type = other DNA
ggccctcaaagtggtgaagagt

SEQ ID NO: 2381 - DNA, 22 bp, synthetic construct
  misc_feature 1..22: note = Synthetic Construct
  source 1..22: mol_type = other DNA
ccttgcctgagctggtatttct

SEQ ID NO: 2382 - DNA, 21 bp, synthetic construct
  misc_feature 1..21: note = Synthetic Construct
  source 1..21: mol_type = other DNA
tgtggctacaactcaggcaaa

SEQ ID NO: 2383 - DNA, 23 bp, synthetic construct
  misc_feature 1..23: note = Synthetic Construct
  source 1..23: mol_type = other DNA
gacattgcttgacttgggtgtgt

SEQ ID NO: 2384 - DNA, 23 bp, synthetic construct
  misc_feature 1..23: note = Synthetic Construct
  source 1..23: mol_type = other DNA
ctcaccgctcccatgaatgaatc

SEQ ID NO: 2385 - DNA, 21 bp, synthetic construct
  misc_feature 1..21: note = Synthetic Construct
  source 1..21: mol_type = other DNA
tgtgtgctgacaggtttgtga

SEQ ID NO: 2386 - DNA, 22 bp, synthetic construct
  misc_feature 1..22: note = Synthetic Construct
  source 1..22: mol_type = other DNA
gcaacaggagctacttgccaaa

SEQ ID NO: 2387 - DNA, 20 bp, synthetic construct
  misc_feature 1..20: note = Synthetic Construct
  source 1..20: mol_type = other DNA
gcccctgttgttgtgctgat

SEQ ID NO: 2388 - DNA, 22 bp, synthetic construct
  misc_feature 1..22: note = Synthetic Construct
  source 1..22: mol_type = other DNA
ggctgcagcataaggaatgtga

SEQ ID NO: 2389 - DNA, 24 bp, synthetic construct
  misc_feature 1..24: note = Synthetic Construct
  source 1..24: mol_type = other DNA
gcagaccattgcttggaggagata

SEQ ID NO: 2390 - DNA, 22 bp, synthetic construct
  misc_feature 1..22: note = Synthetic Construct
  source 1..22: mol_type = other DNA
ctgagctgggaagactcaaact

SEQ ID NO: 2391 - DNA, 22 bp, synthetic construct
  misc_feature 1..22: note = Synthetic Construct
  source 1..22: mol_type = other DNA
gcaactttaggccagctgagtt

SEQ ID NO: 2392 - DNA, 22 bp, synthetic construct
  misc_feature 1..22: note = Synthetic Construct
  source 1..22: mol_type = other DNA
aagacagggtgggagatgtagt

SEQ ID NO: 2393 - DNA, 22 bp, synthetic construct
  misc_feature 1..22: note = Synthetic Construct
  source 1..22: mol_type = other DNA
cctggatttgggcatacgtgaa

SEQ ID NO: 2394 - DNA, 22 bp, synthetic construct
  misc_feature 1..22: note = Synthetic Construct
  source 1..22: mol_type = other DNA
ttccctgaactcttgctggttt

SEQ ID NO: 2395 - DNA, 23 bp, synthetic construct
  misc_feature 1..23: note = Synthetic Construct
  source 1..23: mol_type = other DNA
gggttgaaactggaggcttgttc

SEQ ID NO: 2396 - DNA, 24 bp, synthetic construct
  misc_feature 1..24: note = Synthetic Construct
  source 1..24: mol_type = other DNA
actctgtaccgggtatttcacact

SEQ ID NO: 2397 - DNA, 23 bp, synthetic construct
  misc_feature 1..23: note = Synthetic Construct
  source 1..23: mol_type = other DNA
gcccatccagacccttctaattg

SEQ ID NO: 2398 - DNA, 19 bp, synthetic construct
  misc_feature 1..19: note = Synthetic Construct
  source 1..19: mol_type = other DNA
cagcctcgtgcagcagttg

SEQ ID NO: 2399 - DNA, 24 bp, synthetic construct
  misc_feature 1..24: note = Synthetic Construct
  source 1..24: mol_type = other DNA
agaaccccatacctgcattacaaa

SEQ ID NO: 2400 - DNA, 21 bp, synthetic construct
  misc_feature 1..21: note = Synthetic Construct
  source 1..21: mol_type = other DNA
tcccctggaacctccaaaact

SEQ ID NO: 2401 - DNA, 24 bp, synthetic construct
  misc_feature 1..24: note = Synthetic Construct
  source 1..24: mol_type = other DNA
gcttaagccacagaaaggcacaac

SEQ ID NO: 2402 - DNA, 21 bp, synthetic construct
  misc_feature 1..21: note = Synthetic Construct
  source 1..21: mol_type = other DNA
cgagtgccctggaacctgaaa

SEQ ID NO: 2403 - DNA, 21 bp, synthetic construct
  misc_feature 1..21: note = Synthetic Construct
  source 1..21: mol_type = other DNA
agccaccactcctgcttctga

SEQ ID NO: 2404 - DNA, 20 bp, synthetic construct
  misc_feature 1..20: note = Synthetic Construct
  source 1..20: mol_type = other DNA
ttggggacccctggactaag

SEQ ID NO: 2405 - DNA, 26 bp, synthetic construct
  misc_feature 1..26: note = Synthetic Construct
  source 1..26: mol_type = other DNA
cctccccagtatcttaccactacaac

SEQ ID NO: 2406 - DNA, 22 bp, synthetic construct
  misc_feature 1..22: note = Synthetic Construct
  source 1..22: mol_type = other DNA
caccaagccctcaactcctaaa

SEQ ID NO: 2407 - DNA, 25 bp, synthetic construct
  misc_feature 1..25: note = Synthetic Construct
  source 1..25: mol_type = other DNA
gaagtgaaagaaaatggcaggaact

SEQ ID NO: 2408 - DNA, 27 bp, synthetic construct
  misc_feature 1..27: note = Synthetic Construct
  source 1..27: mol_type = other DNA
gctggtattgttttggggatagaggtt

SEQ ID NO: 2409 - DNA, 26 bp, synthetic construct
  misc_feature 1..26: note = Synthetic Construct
  source 1..26: mol_type = other DNA
gtggaggaaattagatgtctgcttct

SEQ ID NO: 2410 - DNA, 21 bp, synthetic construct
  misc_feature 1..21: note = Synthetic Construct
  source 1..21: mol_type = other DNA
gggcaagtccctcacaccttt

SEQ ID NO: 2411 - DNA, 21 bp, synthetic construct
  misc_feature 1..21: note = Synthetic Construct
  source 1..21: mol_type = other DNA
tgaggtctggctgcaggagta

SEQ ID NO: 2412 - DNA, 22 bp, synthetic construct
  misc_feature 1..22: note = Synthetic Construct
  source 1..22: mol_type = other DNA
ctgaagcccaagtggcaagaag

SEQ ID NO: 2413 - DNA, 22 bp, synthetic construct
  misc_feature 1..22: note = Synthetic Construct
  source 1..22: mol_type = other DNA
aagtcctgagcctgagttcttg

SEQ ID NO: 2414 - DNA, 21 bp, synthetic construct
  misc_feature 1..21: note = Synthetic Construct
  source 1..21: mol_type = other DNA
tctcagggtgcctggaaaaag

SEQ ID NO: 2415 - DNA, 24 bp, synthetic construct
  misc_feature 1..24: note = Synthetic Construct
  source 1..24: mol_type = other DNA
gcactgcaaaagaagaggctattg

SEQ ID NO: 2416 - DNA, 20 bp, synthetic construct
  misc_feature 1..20: note = Synthetic Construct
  source 1..20: mol_type = other DNA
tgggaaccagccctttggaa

SEQ ID NO: 2417 - DNA, 29 bp, synthetic construct
  misc_feature 1..29: note = Synthetic Construct
  source 1..29: mol_type = other DNA
ggcttcactatcaagaagggccttgattt

SEQ ID NO: 2418 - DNA, 18 bp, synthetic construct
  misc_feature 1..18: note = Synthetic Construct
  source 1..18: mol_type = other DNA
aagaggccacccgcttct

SEQ ID NO: 2419 - DNA, 19 bp, synthetic construct
  misc_feature 1..19: note = Synthetic Construct
  source 1..19: mol_type = other DNA
tggagcaggctggcgctaa

SEQ ID NO: 2420 - DNA, 21 bp, synthetic construct
  misc_feature 1..21: note = Synthetic Construct
  source 1..21: mol_type = other DNA
ccgaaaaccttccccgcttct

SEQ ID NO: 2421 - DNA, 24 bp, synthetic construct
  misc_feature 1..24: note = Synthetic Construct
  source 1..24: mol_type = other DNA
ggaaggggaatttgtcagcgttta

SEQ ID NO: 2422 - DNA, 24 bp, synthetic construct
  misc_feature 1..24: note = Synthetic Construct
  source 1..24: mol_type = other DNA
gcagtctcagcctttcctttgcat

SEQ ID NO: 2423 - DNA, 24 bp, synthetic construct
  misc_feature 1..24: note = Synthetic Construct
  source 1..24: mol_type = other DNA
gttgggaagcatcttcctagacat

SEQ ID NO: 2424 - DNA, 24 bp, synthetic construct
  misc_feature 1..24: note = Synthetic Construct
  source 1..24: mol_type = other DNA
gcctattttggagtcccaagtcaa

SEQ ID NO: 2425 - DNA, 18 bp, synthetic construct
  misc_feature 1..18: note = Synthetic Construct
  source 1..18: mol_type = other DNA
tgggccacgttgcctact

SEQ ID NO: 2426 - DNA, 29 bp, synthetic construct
  misc_feature 1..29: note = Synthetic Construct
  source 1..29: mol_type = other DNA
caccttattactaccttcctctcacaatg

SEQ ID NO: 2427 - DNA, 21 bp, synthetic construct
  misc_feature 1..21: note = Synthetic Construct
  source 1..21: mol_type = other DNA
actggggtaaaggctggttgt

SEQ ID NO: 2428 - DNA, 21 bp, synthetic construct
  misc_feature 1..21: note = Synthetic Construct
  source 1..21: mol_type = other DNA
aagcctcgtggccgactcaat

SEQ ID NO: 2429 - DNA, 21 bp, synthetic construct
  misc_feature 1..21: note = Synthetic Construct
  source 1..21: mol_type = other DNA
aacagggcgtgagttttcctt

SEQ ID NO: 2430 - DNA, 23 bp, synthetic construct
  misc_feature 1..23: note = Synthetic Construct
  source 1..23: mol_type = other DNA
ggagaggccagggcatttctaag

SEQ ID NO: 2431 - DNA, 23 bp, synthetic construct
  misc_feature 1..23: note = Synthetic Construct
  source 1..23: mol_type = other DNA
cagcctgctaggaacacactgta

SEQ ID NO: 2432 - DNA, 23 bp, synthetic construct
  misc_feature 1..23: note = Synthetic Construct
  source 1..23: mol_type = other DNA
ggtgattctggccgaacttgtct

SEQ ID NO: 2433 - DNA, 22 bp, synthetic construct
  misc_feature 1..22: note = Synthetic Construct
  source 1..22: mol_type = other DNA
tggatcggaaacaccagactca

SEQ ID NO: 2434 - DNA, 26 bp, synthetic construct
  misc_feature 1..26: note = Synthetic Construct
  source 1..26: mol_type = other DNA
cctgagaccgttgctagagaaacaag

SEQ ID NO: 2435 - DNA, 19 bp, synthetic construct
  misc_feature 1..19: note = Synthetic Construct
  source 1..19: mol_type = other DNA
tgggatgcgggcatagaga

SEQ ID NO: 2436 - DNA, 20 bp, synthetic construct
  misc_feature 1..20: note = Synthetic Construct
  source 1..20: mol_type = other DNA
tctcccaggcttcagtcctt

SEQ ID NO: 2437 - DNA, 23 bp, synthetic construct
  misc_feature 1..23: note = Synthetic Construct
  source 1..23: mol_type = other DNA
ccaagttatgcctgctgctcaga

SEQ ID NO: 2438 - DNA, 24 bp, synthetic construct
  misc_feature 1..24: note = Synthetic Construct
  source 1..24: mol_type = other DNA
gggaacctggaaagacctttactt

SEQ ID NO: 2439 - DNA, 25 bp, synthetic construct
  misc_feature 1..25: note = Synthetic Construct
  source 1..25: mol_type = other DNA
ggtgggatagttgagaagggagtaa

SEQ ID NO: 2440 - DNA, 20 bp, synthetic construct
  misc_feature 1..20: note = Synthetic Construct
  source 1..20: mol_type = other DNA
cctcagctcccgcctctaaa

SEQ ID NO: 2441 - DNA, 23 bp, synthetic construct
  misc_feature 1..23: note = Synthetic Construct
  source 1..23: mol_type = other DNA
ggatgagcataagcagtggttca

SEQ ID NO: 2442 - DNA, 24 bp, synthetic construct
  misc_feature 1..24: note = Synthetic Construct
  source 1..24: mol_type = other DNA
aggagtgagaagggagactcaatc

SEQ ID NO: 2443 - DNA, 19 bp, synthetic construct
  misc_feature 1..19: note = Synthetic Construct
  source 1..19: mol_type = other DNA
tcaagtcccggctgccatt

SEQ ID NO: 2444 - DNA, 22 bp, synthetic construct
  misc_feature 1..22: note = Synthetic Construct
  source 1..22: mol_type = other DNA
gacagagagatgagggctgagt

SEQ ID NO: 2445 - DNA, 24 bp, synthetic construct
  misc_feature 1..24: note = Synthetic Construct
  source 1..24: mol_type = other DNA
aattgccagctgtattctccttct

SEQ ID NO: 2446 - DNA, 20 bp, synthetic construct
  misc_feature 1..20: note = Synthetic Construct
  source 1..20: mol_type = other DNA
acagaggatggggcaccaaa

SEQ ID NO: 2447 - DNA, 25 bp, synthetic construct
  misc_feature 1..25: note = Synthetic Construct
  source 1..25: mol_type = other DNA
gcatgaggatggaatggactcatca

SEQ ID NO: 2448 - DNA, 23 bp, synthetic construct
  misc_feature 1..23: note = Synthetic Construct
  source 1..23: mol_type = other DNA
gaccttcaaggggagctcagtat

SEQ ID NO: 2449 - DNA, 24 bp, synthetic construct
  misc_feature 1..24: note = Synthetic Construct
  source 1..24: mol_type = other DNA
tctgatatggaacccagggattgt

SEQ ID NO: 2450 - DNA, 20 bp, synthetic construct
  misc_feature 1..20: note = Synthetic Construct
  source 1..20: mol_type = other DNA
tgcaccatcgctaggccatt

SEQ ID NO: 2451 - DNA, 24 bp, synthetic construct
  misc_feature 1..24: note = Synthetic Construct
  source 1..24: mol_type = other DNA
gtcagttcacacgacacccttaga

SEQ ID NO: 2452 - DNA, 20 bp, synthetic construct
  misc_feature 1..20: note = Synthetic Construct
  source 1..20: mol_type = other DNA
agcctggaaagctggcacaa

SEQ ID NO: 2453 - DNA, 21 bp, synthetic construct
  misc_feature 1..21: note = Synthetic Construct
  source 1..21: mol_type = other DNA
ttcccagcctcctctgcatct

SEQ ID NO: 2454 - DNA, 22 bp, synthetic construct
  misc_feature 1..22: note = Synthetic Construct
  source 1..22: mol_type = other DNA
ctcaaaggggaagaacgtcagt

SEQ ID NO: 2455 - DNA, 21 bp, synthetic construct
  misc_feature 1..21: note = Synthetic Construct
  source 1..21: mol_type = other DNA
tctgcgtctcacttcctggta

SEQ ID NO: 2456 - DNA, 23 bp, synthetic construct
  misc_feature 1..23: note = Synthetic Construct
  source 1..23: mol_type = other DNA
aaggtgacagaggtcttccaaag

SEQ ID NO: 2457 - DNA, 21 bp, synthetic construct
  misc_feature 1..21: note = Synthetic Construct
  source 1..21: mol_type = other DNA
tcccaaatcctgagcctgtca

SEQ ID NO: 2458 - DNA, 22 bp, synthetic construct
  misc_feature 1..22: note = Synthetic Construct
  source 1..22: mol_type = other DNA
ggagaaagagtggagagcaaca

SEQ ID NO: 2459 - DNA, 29 bp, synthetic construct
  misc_feature 1..29: note = Synthetic Construct
  source 1..29: mol_type = other DNA
gactatacgataccaaatagccctacaag

SEQ ID NO: 2460 - DNA, 20 bp, synthetic construct
  misc_feature 1..20: note = Synthetic Construct
  source 1..20: mol_type = other DNA
gtcacaagggaggcacttca

SEQ ID NO: 2461 - DNA, 20 bp, synthetic construct
  misc_feature 1..20: note = Synthetic Construct
  source 1..20: mol_type = other DNA
agagctgccctggaactgaa

SEQ ID NO: 2462 - DNA, 24 bp, synthetic construct
  misc_feature 1..24: note = Synthetic Construct
  source 1..24: mol_type = other DNA
ggaaaggtaccccagaatgaggtt

SEQ ID NO: 2463 - DNA, 23 bp, synthetic construct
  misc_feature 1..23: note = Synthetic Construct
  source 1..23: mol_type = other DNA
ggtggtagaggctcatgtctctt

SEQ ID NO: 2464 - DNA, 22 bp, synthetic construct
  misc_feature 1..22: note = Synthetic Construct
  source 1..22: mol_type = other DNA
tccccaaatcctttggcaatgt

SEQ ID NO: 2465 - DNA, 22 bp, synthetic construct
  misc_feature 1..22: note = Synthetic Construct
  source 1..22: mol_type = other DNA
gtgtcaaagggcctgttcttgt

SEQ ID NO: 2466 - DNA, 24 bp, synthetic construct
  misc_feature 1..24: note = Synthetic Construct
  source 1..24: mol_type = other DNA
ctctcatcagctgtttgctgttac

SEQ ID NO: 2467 - DNA, 25 bp, synthetic construct
  misc_feature 1..25: note = Synthetic Construct
  source 1..25: mol_type = other DNA
gacctctttctccctgcacatgtaa

SEQ ID NO: 2468 - DNA, 24 bp, synthetic construct
  misc_feature 1..24: note = Synthetic Construct
  source 1..24: mol_type = other DNA
ccttccttgaacttgcctctggta

SEQ ID NO: 2469 - DNA, 23 bp, synthetic construct
  misc_feature 1..23: note = Synthetic Construct
  source 1..23: mol_type = other DNA
gctgtcaccaagactgagactga

SEQ ID NO: 2470 - DNA, 24 bp, synthetic construct
  misc_feature 1..24: note = Synthetic Construct
  source 1..24: mol_type = other DNA
tgaaagctattgggacaacaggat

SEQ ID NO: 2471 - DNA, 27 bp, synthetic construct
  misc_feature 1..27: note = Synthetic Construct
  source 1..27: mol_type = other DNA
caggaagataagtactgagccatgtgt

SEQ ID NO: 2472 - DNA, 23 bp, synthetic construct
  misc_feature 1..23: note = Synthetic Construct
  source 1..23: mol_type = other DNA
gcacatgtctgcgacctcacttt

SEQ ID NO: 2473 - DNA, 22 bp, synthetic construct
  misc_feature 1..22: note = Synthetic Construct
  source 1..22: mol_type = other DNA
cagcagagcagagtgctattgt

SEQ ID NO: 2474 - DNA, 21 bp, synthetic construct
  misc_feature 1..21: note = Synthetic Construct
  source 1..21: mol_type = other DNA
gctgttgcactgtgaacttgt

SEQ ID NO: 2475 - DNA, 22 bp, synthetic construct
  misc_feature 1..22: note = Synthetic Construct
  source 1..22: mol_type = other DNA
gcagcagacagctggagatgaa

SEQ ID NO: 2476 - DNA, 23 bp, synthetic construct
  misc_feature 1..23: note = Synthetic Construct
  source 1..23: mol_type = other DNA
ctctgctgttccctcacctgtaa

SEQ ID NO: 2477 - DNA, 20 bp, synthetic construct
  misc_feature 1..20: note = Synthetic Construct
  source 1..20: mol_type = other DNA
tctggcttctcagtgcgttt

SEQ ID NO: 2478 - DNA, 27 bp, synthetic construct
  misc_feature 1..27: note = Synthetic Construct
  source 1..27: mol_type = other DNA
tgtcaagggactaagtttctaggtttc

SEQ ID NO: 2479 - DNA, 24 bp, synthetic construct
  misc_feature 1..24: note = Synthetic Construct
  source 1..24: mol_type = other DNA
ggctcatgcttgtgataggagaca

SEQ ID NO: 2480 - DNA, 25 bp, synthetic construct
  misc_feature 1..25: note = Synthetic Construct
  source 1..25: mol_type = other DNA
gccgaggagaatatgggttggaaac

SEQ ID NO: 2481 - DNA, 24 bp, synthetic construct
  misc_feature 1..24: note = Synthetic Construct
  source 1..24: mol_type = other DNA
gcatcttgtggttgcccttagcaa

SEQ ID NO: 2482 - DNA, 19 bp, synthetic construct
  misc_feature 1..19: note = Synthetic Construct
  source 1..19: mol_type = other DNA
gtccattgggcagccttct

SEQ ID NO: 2483 - DNA, 22 bp, synthetic construct
  misc_feature 1..22: note = Synthetic Construct
  source 1..22: mol_type = other DNA
cctgatgctccctctgccaaaa

SEQ ID NO: 2484 - DNA, 25 bp, synthetic construct
  misc_feature 1..25: note = Synthetic Construct
  source 1..25: mol_type = other DNA
gcctcattctcgcacacatccaatc

SEQ ID NO: 2485 - DNA, 22 bp, synthetic construct
  misc_feature 1..22: note = Synthetic Construct
  source 1..22: mol_type = other DNA
gcccttcctcttgctgaacagt

SEQ ID NO: 2486 - DNA, 20 bp, synthetic construct
  misc_feature 1..20: note = Synthetic Construct
  source 1..20: mol_type = other DNA
acctgaagccaggcactttc

SEQ ID NO: 2487 - DNA, 20 bp, synthetic construct
  misc_feature 1..20: note = Synthetic Construct
  source 1..20: mol_type = other DNA
tgggagaaaaagcccacgtt

SEQ ID NO: 2488 - DNA, 23 bp, synthetic construct
  misc_feature 1..23: note = Synthetic Construct
  source 1..23: mol_type = other DNA
gcaaggctcagtagggtgaaaag

SEQ ID NO: 2489 - DNA, 24 bp, synthetic construct
  misc_feature 1..24: note = Synthetic Construct
  source 1..24: mol_type = other DNA
gccaaactgcttcttgctggatct

SEQ ID NO: 2490 - DNA, 23 bp, synthetic construct
  misc_feature 1..23: note = Synthetic Construct
  source 1..23: mol_type = other DNA
ggaaaggcggtggtaatgtggtt

SEQ ID NO: 2491 - DNA, 21 bp, synthetic construct
  misc_feature 1..21: note = Synthetic Construct
  source 1..21: mol_type = other DNA
tctgaccaagtccgcctctca

SEQ ID NO: 2492 - DNA, 24 bp, synthetic construct
  misc_feature 1..24: note = Synthetic Construct
  source 1..24: mol_type = other DNA
cctcacactttcctgtccttgact

SEQ ID NO: 2493 - DNA, 26 bp, synthetic construct
  misc_feature 1..26: note = Synthetic Construct
  source 1..26: mol_type = other DNA
cagctgatctatgcattggaggacat

SEQ ID NO: 2494 - DNA, 26 bp, synthetic construct
  misc_feature 1..26: note = Synthetic Construct
  source 1..26: mol_type = other DNA
gcatctacccaatcactacagttaga

SEQ ID NO: 2495 - DNA, 21 bp, synthetic construct
  misc_feature 1..21: note = Synthetic Construct
  source 1..21: mol_type = other DNA
ctcatcagacacaggcagctt

SEQ ID NO: 2496 - DNA, 23 bp, synthetic construct
  misc_feature 1..23: note = Synthetic Construct
  source 1..23: mol_type = other DNA
agggcaaaagctttccagagtag

SEQ ID NO: 2497 - DNA, 24 bp, synthetic construct
  misc_feature 1..24: note = Synthetic Construct
  source 1..24: mol_type = other DNA
gcaaagtttcatggccaagtgtca

SEQ ID NO: 2498 - DNA, 20 bp, synthetic construct
  misc_feature 1..20: note = Synthetic Construct
  source 1..20: mol_type = other DNA
tgctgccaggctgctgaaat

SEQ ID NO: 2499 - DNA, 20 bp, synthetic construct
  misc_feature 1..20: note = Synthetic Construct
  source 1..20: mol_type = other DNA
tccccaggcacctgctccaa

SEQ ID NO: 2500 - DNA, 27 bp, synthetic construct
  misc_feature 1..27: note = Synthetic Construct
  source 1..27: mol_type = other DNA
tcacctacctaggattaaaggtgaaag

SEQ ID NO: 2501 - DNA, 20 bp, synthetic construct
  misc_feature 1..20: note = Synthetic Construct
  source 1..20: mol_type = other DNA
ggacaggttggtgccagatt

SEQ ID NO: 2502 - DNA, 19 bp, synthetic construct
  misc_feature 1..19: note = Synthetic Construct
  source 1..19: mol_type = other DNA
aaggaggtcctggggcaat

SEQ ID NO: 2503 - DNA, 22 bp, synthetic construct
  misc_feature 1..22: note = Synthetic Construct
  source 1..22: mol_type = other DNA
cttgcctaggaagggcattaca

SEQ ID NO: 2504 - DNA, 20 bp, synthetic construct
  misc_feature 1..20: note = Synthetic Construct
  source 1..20: mol_type = other DNA
gttgcagcctggaggagaaa

SEQ ID NO: 2505 - DNA, 30 bp, synthetic construct
  misc_feature 1..30: note = Synthetic Construct
  source 1..30: mol_type = other DNA
gctggtcaattctgttaaatcaaggagaca

SEQ ID NO: 2506 - DNA, 19 bp, synthetic construct
  misc_feature 1..19: note = Synthetic Construct
  source 1..19: mol_type = other DNA
tgggtgagggcggatcttc

SEQ ID NO: 2507 - DNA, 24 bp, synthetic construct
  misc_feature 1..24: note = Synthetic Construct
  source 1..24: mol_type = other DNA
cccagagaggctggatactgtgta

SEQ ID NO: 2508 - DNA, 26 bp, synthetic construct
  misc_feature 1..26: note = Synthetic Construct
  source 1..26: mol_type = other DNA
cctgtggctcctgagagagaaatcaa

SEQ ID NO: 2509 - DNA, 20 bp, synthetic construct
  misc_feature 1..20: note = Synthetic Construct
  source 1..20: mol_type = other DNA
tgggacacttcaggccaaga

SEQ ID NO: 2510 - DNA, 22 bp, synthetic construct
  misc_feature 1..22: note = Synthetic Construct
  source 1..22: mol_type = other DNA
ggctagcattcggcgaaaatga

SEQ ID NO: 2511 - DNA, 28 bp, synthetic construct
  misc_feature 1..28: note = Synthetic Construct
  source 1..28: mol_type = other DNA
gctcagatgtgtaaaggaaggcagtaca

SEQ ID NO: 2512 - DNA, 20 bp, synthetic construct
  misc_feature 1..20: note = Synthetic Construct
  source 1..20: mol_type = other DNA
ttcccggtgttctggcgatt

SEQ ID NO: 2513 - DNA, 26 bp, synthetic construct
  misc_feature 1..26: note = Synthetic Construct
  source 1..26: mol_type = other DNA
ggcatgtaagggtgacaaaggagttg

SEQ ID NO: 2514 - DNA, 20 bp, synthetic construct
  misc_feature 1..20: note = Synthetic Construct
  source 1..20: mol_type = other DNA
ccctcccaggcttctcatct

SEQ ID NO: 2515 - DNA, 22 bp, synthetic construct
  misc_feature 1..22: note = Synthetic Construct
  source 1..22: mol_type = other DNA
cctgcctacggtcctaaagtgt

SEQ ID NO: 2516 - DNA, 21 bp, synthetic construct
  misc_feature 1..21: note = Synthetic Construct
  source 1..21: mol_type = other DNA
tccctcaaaccccagctcctt

SEQ ID NO: 2517 - DNA, 23 bp, synthetic construct
  misc_feature 1..23: note = Synthetic Construct
  source 1..23: mol_type = other DNA
ggcatgcttttcattgtgagtga

SEQ ID NO: 2518 - DNA, 25 bp, synthetic construct
  misc_feature 1..25: note = Synthetic Construct
  source 1..25: mol_type = other DNA
ggatcttccttctgggtcataaagt

SEQ ID NO: 2519 - DNA, 25 bp, synthetic construct
  misc_feature 1..25: note = Synthetic Construct
  source 1..25: mol_type = other DNA
gcttttaaaaacccagctgtgaatg

SEQ ID NO: 2520 - DNA, 20 bp, synthetic construct
  misc_feature 1..20: note = Synthetic Construct
  source 1..20: mol_type = other DNA
tcttcccgctccgtccctta

SEQ ID NO: 2521 - DNA, 20 bp, synthetic construct
  misc_feature 1..20: note = Synthetic Construct
  source 1..20: mol_type = other DNA
ctgtccgcagaagccaaaag

SEQ ID NO: 2522 - DNA, 23 bp, synthetic construct
  misc_feature 1..23: note = Synthetic Construct
  source 1..23: mol_type = other DNA
ctgtactgcctcctttcctctca

SEQ ID NO: 2523 - DNA, 20 bp, synthetic construct
  misc_feature 1..20: note = Synthetic Construct
  source 1..20: mol_type = other DNA
cctgagcaagggcacagaag

SEQ ID NO: 2524 - DNA, 20 bp, synthetic construct
  misc_feature 1..20: note = Synthetic Construct
  source 1..20: mol_type = other DNA
aggttcatgggccctcattg

SEQ ID NO: 2525 - DNA, 21 bp, synthetic construct
  misc_feature 1..21: note = Synthetic Construct
  source 1..21: mol_type = other DNA
gggctcccactttcctgagat

SEQ ID NO: 2526 - DNA, 26 bp, synthetic construct
  misc_feature 1..26: note = Synthetic Construct
  source 1..26: mol_type = other DNA
gcaggctcgatatctaattccagaga

SEQ ID NO: 2527 - DNA, 20 bp, synthetic construct
  misc_feature 1..20: note = Synthetic Construct
  source 1..20: mol_type = other DNA
gcagaatcgcctgtggttgt

SEQ ID NO: 2528 - DNA, 23 bp, synthetic construct
  misc_feature 1..23: note = Synthetic Construct
  source 1..23: mol_type = other DNA
gagaagctaaatggtccccaaga

SEQ ID NO: 2529 - DNA, 21 bp, synthetic construct
  misc_feature 1..21: note = Synthetic Construct
  source 1..21: mol_type = other DNA
ggactgaggggctctctggaa

SEQ ID NO: 2530 - DNA, 22 bp, synthetic construct
  misc_feature 1..22: note = Synthetic Construct
  source 1..22: mol_type = other DNA
gcccctgtagtacatccacact

SEQ ID NO: 2531 - DNA, 24 bp, synthetic construct
  misc_feature 1..24: note = Synthetic Construct
  source 1..24: mol_type = other DNA
cctttcgcatgaattgtgcagtga

SEQ ID NO: 2532 - DNA, 24 bp, synthetic construct
  misc_feature 1..24: note = Synthetic Construct
  source 1..24: mol_type = other DNA
gagctctagctgtgagtaggatct

SEQ ID NO: 2533 - DNA, 20 bp, synthetic construct
  misc_feature 1..20: note = Synthetic Construct
  source 1..20: mol_type = other DNA
cctctttgccaggtcacaca

SEQ ID NO: 2534 - DNA, 24 bp, synthetic construct
  misc_feature 1..24: note = Synthetic Construct
  source 1..24: mol_type = other DNA
actgggtgaataaaggacccaaga

SEQ ID NO: 2535 - DNA, 18 bp, synthetic construct
  misc_feature 1..18: note = Synthetic Construct
  source 1..18: mol_type = other DNA
agaggctcgtgggtgtga

SEQ ID NO: 2536 - DNA, 19 bp, synthetic construct
  misc_feature 1..19: note = Synthetic Construct
  source 1..19: mol_type = other DNA
tgggctctgctgcctgttg

SEQ ID NO: 2537 - DNA, 20 bp, synthetic construct
  misc_feature 1..20: note = Synthetic Construct
  source 1..20: mol_type = other DNA
gatggtccccagagggatga

SEQ ID NO: 2538 - DNA, 21 bp, synthetic construct
  misc_feature 1..21: note = Synthetic Construct
  source 1..21: mol_type = other DNA
acccctgatgggctcaagtca

SEQ ID NO: 2539 - DNA, 25 bp, synthetic construct
  misc_feature 1..25: note = Synthetic Construct
  source 1..25: mol_type = other DNA
gtcaatactgtggacagctgcttct

SEQ ID NO: 2540 - DNA, 19 bp, synthetic construct
  misc_feature 1..19: note = Synthetic Construct
  source 1..19: mol_type = other DNA
ggaagcatcccgccagcat

SEQ ID NO: 2541 - DNA, 27 bp, synthetic construct
  misc_feature 1..27: note = Synthetic Construct
  source 1..27: mol_type = other DNA
actaggatctatttcaacccagaccat

SEQ ID NO: 2542 - DNA, 22 bp, synthetic construct
  misc_feature 1..22: note = Synthetic Construct
  source 1..22: mol_type = other DNA
gcctctgcctgcaaagaaccat

SEQ ID NO: 2543 - DNA, 26 bp, synthetic construct
  misc_feature 1..26: note = Synthetic Construct
  source 1..26: mol_type = other DNA
gctcaccatcttcctcatcaaacaga

SEQ ID NO: 2544 - DNA, 26 bp, synthetic construct
  misc_feature 1..26: note = Synthetic Construct
  source 1..26: mol_type = other DNA
gggagagacaggttaagaggccattg

SEQ ID NO: 2545 - DNA, 20 bp, synthetic construct
  misc_feature 1..20: note = Synthetic Construct
  source 1..20: mol_type = other DNA
ccagcaagcatggggttcaa

SEQ ID NO: 2546 - DNA, 20 bp, synthetic construct
  misc_feature 1..20: note = Synthetic Construct
  source 1..20: mol_type = other DNA
cgccaggaattcgtgcctta

SEQ ID NO: 2547 - DNA, 24 bp, synthetic construct
  misc_feature 1..24: note = Synthetic Construct
  source 1..24: mol_type = other DNA
ggctctcaaaaccctcaggtctca

SEQ ID NO: 2548 - DNA, 21 bp, synthetic construct
  misc_feature 1..21: note = Synthetic Construct
  source 1..21: mol_type = other DNA
atgcttagtgcctgacacaca

SEQ ID NO: 2549 - DNA, 21 bp, synthetic construct
  misc_feature 1..21: note = Synthetic Construct
  source 1..21: mol_type = other DNA
accgactcctgtccctctttg

SEQ ID NO: 2550 - DNA, 25 bp, synthetic construct
  misc_feature 1..25: note = Synthetic Construct
  source 1..25: mol_type = other DNA
caggaggtggtctttacctcaattc

SEQ ID NO: 2551 - DNA, 26 bp, synthetic construct
  misc_feature 1..26: note = Synthetic Construct
  source 1..26: mol_type = other DNA
caccttagaaaaatgcctacccttga

SEQ ID NO: 2552 - DNA, 29 bp, synthetic construct
  misc_feature 1..29: note = Synthetic Construct
  source 1..29: mol_type = other DNA
ggaaatagatttcagggactagccaaaag

SEQ ID NO: 2553 - DNA, 21 bp, synthetic construct
  misc_feature 1..21: note = Synthetic Construct
  source 1..21: mol_type = other DNA
gccttctcactgctgaacctt

SEQ ID NO: 2554 - DNA, 20 bp, synthetic construct
  misc_feature 1..20: note = Synthetic Construct
  source 1..20: mol_type = other DNA
agcctcctcactgccaaatc

SEQ ID NO: 2555 - DNA, 27 bp, synthetic construct
  misc_feature 1..27: note = Synthetic Construct
  source 1..27: mol_type = other DNA
cccactacacgagaattacacccatct

SEQ ID NO: 2556 - DNA, 21 bp, synthetic construct
  misc_feature 1..21: note = Synthetic Construct
  source 1..21: mol_type = other DNA
tttagcagggcaagggctaag

SEQ ID NO: 2557 - DNA, 29 bp, synthetic construct
  misc_feature 1..29: note = Synthetic Construct
  source 1..29: mol_type = other DNA
cagggaaaaagactgaatcctaactccta

SEQ ID NO: 2558 - DNA, 21 bp, synthetic construct
  misc_feature 1..21: note = Synthetic Construct
  source 1..21: mol_type = other DNA
atgaggacgaggccgggacta

SEQ ID NO: 2559 - DNA, 27 bp, synthetic construct
  misc_feature 1..27: note = Synthetic Construct
  source 1..27: mol_type = other DNA
gagttagatgacccttactttctgcta

SEQ ID NO: 2560 - DNA, 22 bp, synthetic construct
  misc_feature 1..22: note = Synthetic Construct
  source 1..22: mol_type = other DNA
ccattagtggcgcacagacatc

SEQ ID NO: 2561 - DNA, 21 bp, synthetic construct
  misc_feature 1..21: note = Synthetic Construct
  source 1..21: mol_type = other DNA
tcctggctgtcactactgtgt

SEQ ID NO: 2562 - DNA, 21 bp, synthetic construct
  misc_feature 1..21: note = Synthetic Construct
  source 1..21: mol_type = other DNA
ctgggaacaaagccgcctaat

SEQ ID NO: 2563 - DNA, 22 bp, synthetic construct
  misc_feature 1..22: note = Synthetic Construct
  source 1..22: mol_type = other DNA
cgtctccgctgatgttctgtag

SEQ ID NO: 2564 - DNA, 19 bp, synthetic construct
  misc_feature 1..19: note = Synthetic Construct
  source 1..19: mol_type = other DNA
gtgccaactgtggctgtga

SEQ ID NO: 2565 - DNA, 22 bp, synthetic construct
  misc_feature 1..22: note = Synthetic Construct
  source 1..22: mol_type = other DNA
tggctagtggggaagccagata

SEQ ID NO: 2566 - DNA, 24 bp, synthetic construct
  misc_feature 1..24: note = Synthetic Construct
  source 1..24: mol_type = other DNA
ttggtaccagaagtgggattcaaa

SEQ ID NO: 2567 - DNA, 23 bp, synthetic construct
  misc_feature 1..23: note = Synthetic Construct
  source 1..23: mol_type = other DNA
ctgtggtttgtgtaggcccaaag

SEQ ID NO: 2568 - DNA, 21 bp, synthetic construct
  misc_feature 1..21: note = Synthetic Construct
  source 1..21: mol_type = other DNA
gggccaacacatgagggatgt

SEQ ID NO: 2569 - DNA, 22 bp, synthetic construct
  misc_feature 1..22: note = Synthetic Construct
  source 1..22: mol_type = other DNA
ccactggatcactgggtgctta

SEQ ID NO: 2570 - DNA, 21 bp, synthetic construct
  misc_feature 1..21: note = Synthetic Construct
  source 1..21: mol_type = other DNA
tgggacagtgattcccagctt

SEQ ID NO: 2571 - DNA, 20 bp, synthetic construct
  misc_feature 1..20: note = Synthetic Construct
  source 1..20: mol_type = other DNA
agggacagggcagccagtca

SEQ ID NO: 2572 - DNA, 21 bp, synthetic construct
  misc_feature 1..21: note = Synthetic Construct
  source 1..21: mol_type = other DNA
ttatagccgctgcctcctaga

SEQ ID NO: 2573 - DNA, 22 bp, synthetic construct
  misc_feature 1..22: note = Synthetic Construct
  source 1..22: mol_type = other DNA
gctcatccaggaccccatcttt

SEQ ID NO: 2574 - DNA, 20 bp, synthetic construct
  misc_feature 1..20: note = Synthetic Construct
  source 1..20: mol_type = other DNA
ctcattggcgtcagccgata

SEQ ID NO: 2575 - DNA, 24 bp, synthetic construct
  misc_feature 1..24: note = Synthetic Construct
  source 1..24: mol_type = other DNA
cctcgatgttggtagggactcttc

SEQ ID NO: 2576 - DNA, 22 bp, synthetic construct
  misc_feature 1..22: note = Synthetic Construct
  source 1..22: mol_type = other DNA
gcgagtcacctctgccatgttt

SEQ ID NO: 2577 - DNA, 21 bp, synthetic construct
  misc_feature 1..21: note = Synthetic Construct
  source 1..21: mol_type = other DNA
aggccactcagggctttgtga

SEQ ID NO: 2578 - DNA, 28 bp, synthetic construct
  misc_feature 1..28: note = Synthetic Construct
  source 1..28: mol_type = other DNA
ctggggagatgatattaaagctgactct

SEQ ID NO: 2579 - DNA, 20 bp, synthetic construct
  misc_feature 1..20: note = Synthetic Construct
  source 1..20: mol_type = other DNA
gctgcctctgtggtcacatc

SEQ ID NO: 2580 - DNA, 20 bp, synthetic construct
  misc_feature 1..20: note = Synthetic Construct
  source 1..20: mol_type = other DNA
ccaaggcagcacttgaggta

SEQ ID NO: 2581 - DNA, 21 bp, synthetic construct
  misc_feature 1..21: note = Synthetic Construct
  source 1..21: mol_type = other DNA
gccaactgctgtgttgtcttg

SEQ ID NO: 2582 - DNA, 21 bp, synthetic construct
  misc_feature 1..21: note = Synthetic Construct
  source 1..21: mol_type = other DNA
acaacctcacctttgcagaca

SEQ ID NO: 2583 - DNA, 25 bp, synthetic construct
  misc_feature 1..25: note = Synthetic Construct
  source 1..25: mol_type = other DNA
gtcatttgctttcatgaccctcctt

SEQ ID NO: 2584 - DNA, 20 bp, synthetic construct
  misc_feature 1..20: note = Synthetic Construct
  source 1..20: mol_type = other DNA
agtgcgcagcccttttcctt

SEQ ID NO: 2585 - DNA, 19 bp, synthetic construct
  misc_feature 1..19: note = Synthetic Construct
  source 1..19: mol_type = other DNA
atggcgaagcgcaggaaga

SEQ ID NO: 2586 - DNA, 22 bp, synthetic construct
  misc_feature 1..22: note = Synthetic Construct
  source 1..22: mol_type = other DNA
ttgccagaggttccccagattg

SEQ ID NO: 2587 - DNA, 25 bp, synthetic construct
  misc_feature 1..25: note = Synthetic Construct
  source 1..25: mol_type = other DNA
caaataaaggccctccttcaacaac

SEQ ID NO: 2588 - DNA, 22 bp, synthetic construct
  misc_feature 1..22: note = Synthetic Construct
  source 1..22: mol_type = other DNA
caaggaggaggaccaagtctca

SEQ ID NO: 2589 - DNA, 23 bp, synthetic construct
  misc_feature 1..23: note = Synthetic Construct
  source 1..23: mol_type = other DNA
gcatctgtatgcacactgggttt

SEQ ID NO: 2590 - DNA, 20 bp, synthetic construct
  misc_feature 1..20: note = Synthetic Construct
  source 1..20: mol_type = other DNA
aaggtgccagggcaactcaa

SEQ ID NO: 2591 - DNA, 20 bp, synthetic construct
  misc_feature 1..20: note = Synthetic Construct
  source 1..20: mol_type = other DNA
gttctgcagctggtcactgt

SEQ ID NO: 2592 - DNA, 20 bp, synthetic construct
  misc_feature 1..20: note = Synthetic Construct
  source 1..20: mol_type = other DNA
tgctgcagccatgcttccta

SEQ ID NO: 2593 - DNA, 18 bp, synthetic construct
  misc_feature 1..18: note = Synthetic Construct
  source 1..18: mol_type = other DNA
agaagcggctggctccat

SEQ ID NO: 2594 - DNA, 21 bp, synthetic construct
  misc_feature 1..21: note = Synthetic Construct
  source 1..21: mol_type = other DNA
gccttcagggaagctttgaca

SEQ ID NO: 2595 - DNA, 22 bp, synthetic construct
  misc_feature 1..22: note = Synthetic Construct
  source 1..22: mol_type = other DNA
gcagcaccgctctctagttaag

SEQ ID NO: 2596 - DNA, 22 bp, synthetic construct
  misc_feature 1..22: note = Synthetic Construct
  source 1..22: mol_type = other DNA
gacactaagtgcggctgtcatc

SEQ ID NO: 2597 - DNA, 20 bp, synthetic construct
  misc_feature 1..20: note = Synthetic Construct
  source 1..20: mol_type = other DNA
gctaccaggaacgggagtca

SEQ ID NO: 2598 - DNA, 20 bp, synthetic construct
  misc_feature 1..20: note = Synthetic Construct
  source 1..20: mol_type = other DNA
accctgttccctctgtcagt

SEQ ID NO: 2599 - DNA, 22 bp, synthetic construct
  misc_feature 1..22: note = Synthetic Construct
  source 1..22: mol_type = other DNA
gcccagctttagcggatgaagt

SEQ ID NO: 2600 - DNA, 21 bp, synthetic construct
  misc_feature 1..21: note = Synthetic Construct
  source 1..21: mol_type = other DNA
gctgcgcccatttgtttgcat

SEQ ID NO: 2601 - DNA, 19 bp, synthetic construct
  misc_feature 1..19: note = Synthetic Construct
  source 1..19: mol_type = other DNA
ggcacaaagccctctgcat

SEQ ID NO: 2602 - DNA, 21 bp, synthetic construct
  misc_feature 1..21: note = Synthetic Construct
  source 1..21: mol_type = other DNA
tgggcccatggtccatccaaa

SEQ ID NO: 2603 - DNA, 20 bp, synthetic construct
  misc_feature 1..20: note = Synthetic Construct
  source 1..20: mol_type = other DNA
ttgccgctcctctttctgtt

SEQ ID NO: 2604 - DNA, 22 bp, synthetic construct
  misc_feature 1..22: note = Synthetic Construct
  source 1..22: mol_type = other DNA
tcttccccaaatgggaccttca

SEQ ID NO: 2605 - DNA, 24 bp, synthetic construct
  misc_feature 1..24: note = Synthetic Construct
  source 1..24: mol_type = other DNA
ccacatagctctccatctggctat

SEQ ID NO: 2606 - DNA, 21 bp, synthetic construct
  misc_feature 1..21: note = Synthetic Construct
  source 1..21: mol_type = other DNA
ggagtttccgaaggcaacagt

SEQ ID NO: 2607 - DNA, 20 bp, synthetic construct
  misc_feature 1..20: note = Synthetic Construct
  source 1..20: mol_type = other DNA
tcctggcctaaggggtgttt

SEQ ID NO: 2608 - DNA, 20 bp, synthetic construct
  misc_feature 1..20: note = Synthetic Construct
  source 1..20: mol_type = other DNA
gtgctcaggttgtggagaca

SEQ ID NO: 2609 - DNA, 22 bp, synthetic construct
  misc_feature 1..22: note = Synthetic Construct
  source 1..22: mol_type = other DNA
ctcttcaagcaaggctgtctct

SEQ ID NO: 2610 - DNA, 24 bp, synthetic construct
  misc_feature 1..24: note = Synthetic Construct
  source 1..24: mol_type = other DNA
gtgtacagtgaaggccatgtgttc

SEQ ID NO: 2611 - DNA, 23 bp, synthetic construct
  misc_feature 1..23: note = Synthetic Construct
  source 1..23: mol_type = other DNA
tccatggctcaggagggacatag

SEQ ID NO: 2612 - DNA, 22 bp, synthetic construct
  misc_feature 1..22: note = Synthetic Construct
  source 1..22: mol_type = other DNA
accacgatccacacctcctaac

SEQ ID NO: 2613 - DNA, 20 bp, synthetic construct
  misc_feature 1..20: note = Synthetic Construct
  source 1..20: mol_type = other DNA
ttggctggagggctctggaa

SEQ ID NO: 2614 - DNA, 20 bp, synthetic construct
  misc_feature 1..20: note = Synthetic Construct
  source 1..20: mol_type = other DNA
gcaccactggagccaagatt

SEQ ID NO: 2615 - DNA, 25 bp, synthetic construct
  misc_feature 1..25: note = Synthetic Construct
  source 1..25: mol_type = other DNA
gctggaactctgtcataggctgaag

SEQ ID NO: 2616 - DNA, 21 bp, synthetic construct
  misc_feature 1..21: note = Synthetic Construct
  source 1..21: mol_type = other DNA
agtgggagtggtctggtcaac

SEQ ID NO: 2617 - DNA, 20 bp, synthetic construct
  misc_feature 1..20: note = Synthetic Construct
  source 1..20: mol_type = other DNA
actggagcgcttgaggtaga

SEQ ID NO: 2618 - DNA, 24 bp, synthetic construct
  misc_feature 1..24: note = Synthetic Construct
  source 1..24: mol_type = other DNA
gcacaccagaagataacccagctt

SEQ ID NO: 2619 - DNA, 27 bp, synthetic construct
  misc_feature 1..27: note = Synthetic Construct
  source 1..27: mol_type = other DNA
gggcattattgaatgctctgctttctt

SEQ ID NO: 2620 - DNA, 22 bp, synthetic construct
  misc_feature 1..22: note = Synthetic Construct
  source 1..22: mol_type = other DNA
accctggagctcccttccaaaa

SEQ ID NO: 2621 - DNA, 21 bp, synthetic construct
  misc_feature 1..21: note = Synthetic Construct
  source 1..21: mol_type = other DNA
ggcctcctggtgcattgaaac

SEQ ID NO: 2622 - DNA, 24 bp, synthetic construct
  misc_feature 1..24: note = Synthetic Construct
  source 1..24: mol_type = other DNA
gtgcatacacttgactgcttgaca

SEQ ID NO: 2623 - DNA, 21 bp, synthetic construct
  misc_feature 1..21: note = Synthetic Construct
  source 1..21: mol_type = other DNA
tgtaagtgccagccagctaga

SEQ ID NO: 2624 - DNA, 23 bp, synthetic construct
  misc_feature 1..23: note = Synthetic Construct
  source 1..23: mol_type = other DNA
gacctgagtgtggtgaaatgtct

SEQ ID NO: 2625 - DNA, 21 bp, synthetic construct
  misc_feature 1..21: note = Synthetic Construct
  source 1..21: mol_type = other DNA
cagggtgcctcatctcaggat

SEQ ID NO: 2626 - DNA, 22 bp, synthetic construct
  misc_feature 1..22: note = Synthetic Construct
  source 1..22: mol_type = other DNA
agctgaggctatggggatgact

SEQ ID NO: 2627 - DNA, 22 bp, synthetic construct
  misc_feature 1..22: note = Synthetic Construct
  source 1..22: mol_type = other DNA
gcttgtttccacccacctcgtt

SEQ ID NO: 2628 - DNA, 21 bp, synthetic construct
  misc_feature 1..21: note = Synthetic Construct
  source 1..21: mol_type = other DNA
gctgagtgcctttctgccttt

SEQ ID NO: 2629 - DNA, 23 bp, synthetic construct
  misc_feature 1..23: note = Synthetic Construct
  source 1..23: mol_type = other DNA
agtgacagagtatggggtgagaa

SEQ ID NO: 2630 - DNA, 22 bp, synthetic construct
  misc_feature 1..22: note = Synthetic Construct
  source 1..22: mol_type = other DNA
gcttcccagatcccacagttag

SEQ ID NO: 2631 - DNA, 22 bp, synthetic construct
  misc_feature 1..22: note = Synthetic Construct
  source 1..22: mol_type = other DNA
cccaggactgtcattcccaaga

SEQ ID NO: 2632 - DNA, 20 bp, synthetic construct
  misc_feature 1..20: note = Synthetic Construct
  source 1..20: mol_type = other DNA
gggttatgggcaccttcaca

SEQ ID NO: 2633 - DNA, 21 bp, synthetic construct
  misc_feature 1..21: note = Synthetic Construct
  source 1..21: mol_type = other DNA
ggcagacacaacttggggaaa

SEQ ID NO: 2634 - DNA, 21 bp, synthetic construct
  misc_feature 1..21: note = Synthetic Construct
  source 1..21: mol_type = other DNA
gacgtgctcagtgggatttgt

SEQ ID NO: 2635 - DNA, 23 bp, synthetic construct
  misc_feature 1..23: note = Synthetic Construct
  source 1..23: mol_type = other DNA
gcaataacccatcggtggagcaa

SEQ ID NO: 2636 - DNA, 22 bp, synthetic construct
  misc_feature 1..22: note = Synthetic Construct
  source 1..22: mol_type = other DNA
tggtgagatcttggctctccat

SEQ ID NO: 2637 - DNA, 22 bp, synthetic construct
  misc_feature 1..22: note = Synthetic Construct
  source 1..22: mol_type = other DNA
gccctctttccattgcccagaa

SEQ ID NO: 2638 - DNA, 22 bp, synthetic construct
  misc_feature 1..22: note = Synthetic Construct
  source 1..22: mol_type = other DNA
gtctctgtctgcccatcagtct

SEQ ID NO: 2639 - DNA, 20 bp, synthetic construct
  misc_feature 1..20: note = Synthetic Construct
  source 1..20: mol_type = other DNA
gcagggaaagcccagtcatc

SEQ ID NO: 2640 - DNA, 27 bp, synthetic construct
  misc_feature 1..27: note = Synthetic Construct
  source 1..27: mol_type = other DNA
ccccacatttcttcagacagtggaatc

SEQ ID NO: 2641 - DNA, 18 bp, synthetic construct
  misc_feature 1..18: note = Synthetic Construct
  source 1..18: mol_type = other DNA
tcccgcccactgctatct

SEQ ID NO: 2642 - DNA, 19 bp, synthetic construct
  misc_feature 1..19: note = Synthetic Construct
  source 1..19: mol_type = other DNA
tgtctcggggtgccacaca

SEQ ID NO: 2643 - DNA, 23 bp, synthetic construct
  misc_feature 1..23: note = Synthetic Construct
  source 1..23: mol_type = other DNA
gcacgtggagagtgttcatccat

SEQ ID NO: 2644 - DNA, 25 bp, synthetic construct
  misc_feature 1..25: note = Synthetic Construct
  source 1..25: mol_type = other DNA
tgaaatgaacagaccagctaacctt

SEQ ID NO: 2645 - DNA, 22 bp, synthetic construct
  misc_feature 1..22: note = Synthetic Construct
  source 1..22: mol_type = other DNA
cctgggctatgctgtcatccat

SEQ ID NO: 2646 - DNA, 25 bp, synthetic construct
  misc_feature 1..25: note = Synthetic Construct
  source 1..25: mol_type = other DNA
gagactgcctgaataccatggaaga

SEQ ID NO: 2647 - DNA, 20 bp, synthetic construct
  misc_feature 1..20: note = Synthetic Construct
  source 1..20: mol_type = other DNA
tgggagggtgccacctcttg

SEQ ID NO: 2648 - DNA, 20 bp, synthetic construct
  misc_feature 1..20: note = Synthetic Construct
  source 1..20: mol_type = other DNA
ctttggttgcaggccacaga

SEQ ID NO: 2649 - DNA, 20 bp, synthetic construct
  misc_feature 1..20: note = Synthetic Construct
  source 1..20: mol_type = other DNA
ggctgccttgggacacatct

SEQ ID NO: 2650 - DNA, 22 bp, synthetic construct
  misc_feature 1..22: note = Synthetic Construct
  source 1..22: mol_type = other DNA
gccaggaacactgcttgtgatg

SEQ ID NO: 2651 - DNA, 22 bp, synthetic construct
  misc_feature 1..22: note = Synthetic Construct
  source 1..22: mol_type = other DNA
gagaggggtttgcttccctctt

SEQ ID NO: 2652 - DNA, 19 bp, synthetic construct
  misc_feature 1..19: note = Synthetic Construct
  source 1..19: mol_type = other DNA
aggggcctgcactgtgatt

SEQ ID NO: 2653 - DNA, 23 bp, synthetic construct
  misc_feature 1..23: note = Synthetic Construct
  source 1..23: mol_type = other DNA
ccatcagcagattcacactcaga

SEQ ID NO: 2654 - DNA, 24 bp, synthetic construct
  misc_feature 1..24: note = Synthetic Construct
  source 1..24: mol_type = other DNA
cagggaaaacagggatgaaagaca

SEQ ID NO: 2655 - DNA, 26 bp, synthetic construct
  misc_feature 1..26: note = Synthetic Construct
  source 1..26: mol_type = other DNA
ctgctgtgaagctggagactttttac

SEQ ID NO: 2656 - DNA, 19 bp, synthetic construct
  misc_feature 1..19: note = Synthetic Construct
  source 1..19: mol_type = other DNA
tcgccgcgttgaccagtgt

SEQ ID NO: 2657 - DNA, 22 bp, synthetic construct
  misc_feature 1..22: note = Synthetic Construct
  source 1..22: mol_type = other DNA
ggacaggtactaggtgctgctt

SEQ ID NO: 2658 - DNA, 22 bp, synthetic construct
  misc_feature 1..22: note = Synthetic Construct
  source 1..22: mol_type = other DNA
gaagccggtttaactggtgttg

SEQ ID NO: 2659 - DNA, 22 bp, synthetic construct
  misc_feature 1..22: note = Synthetic Construct
  source 1..22: mol_type = other DNA
cagcaggagggaaaaggctatg

SEQ ID NO: 2660 - DNA, 22 bp, synthetic construct
  misc_feature 1..22: note = Synthetic Construct
  source 1..22: mol_type = other DNA
ctcaaaaggcaggtgcttgaca

SEQ ID NO: 2661 - DNA, 21 bp, synthetic construct
  misc_feature 1..21: note = Synthetic Construct
  source 1..21: mol_type = other DNA
tggttcccaaggggctcagat

SEQ ID NO: 2662 - DNA, 26 bp, synthetic construct
  misc_feature 1..26: note = Synthetic Construct
  source 1..26: mol_type = other DNA
gtggtgaaagtaatggcatcaagcat

SEQ ID NO: 2663 - DNA, 21 bp, synthetic construct
  misc_feature 1..21: note = Synthetic Construct
  source 1..21: mol_type = other DNA
tgctgtggtgtggtcatttgt

SEQ ID NO: 2664 - DNA, 20 bp, synthetic construct
  misc_feature 1..20: note = Synthetic Construct
  source 1..20: mol_type = other DNA
tcccagtgcaagggcattag

SEQ ID NO: 2665 - DNA, 19 bp, synthetic construct
  misc_feature 1..19: note = Synthetic Construct
  source 1..19: mol_type = other DNA
aggctggcctcccacttac

SEQ ID NO: 2666 - DNA, 26 bp, synthetic construct
  misc_feature 1..26: note = Synthetic Construct
  source 1..26: mol_type = other DNA
agagtaaacttggaaggatgggtttc

SEQ ID NO: 2667 - DNA, 19 bp, synthetic construct
  misc_feature 1..19: note = Synthetic Construct
  source 1..19: mol_type = other DNA
gcaatccctgcgaccacat

SEQ ID NO: 2668 - DNA, 20 bp, synthetic construct
  misc_feature 1..20: note = Synthetic Construct
  source 1..20: mol_type = other DNA
aggccaaagtccctgtgaac

SEQ ID NO: 2669 - DNA, 25 bp, synthetic construct
  misc_feature 1..25: note = Synthetic Construct
  source 1..25: mol_type = other DNA
ggatgagattcccttcctccacact

SEQ ID NO: 2670 - DNA, 21 bp, synthetic construct
  misc_feature 1..21: note = Synthetic Construct
  source 1..21: mol_type = other DNA
gctgtttctctgtcgctcctt

SEQ ID NO: 2671 - DNA, 22 bp, synthetic construct
  misc_feature 1..22: note = Synthetic Construct
  source 1..22: mol_type = other DNA
gggtgctgggaaacatgaggaa

SEQ ID NO: 2672 - DNA, 22 bp, synthetic construct
  misc_feature 1..22: note = Synthetic Construct
  source 1..22: mol_type = other DNA
cagccttctgtccactccttag

SEQ ID NO: 2673 - DNA, 20 bp, synthetic construct
  misc_feature 1..20: note = Synthetic Construct
  source 1..20: mol_type = other DNA
tgcttccagagccccacact

SEQ ID NO: 2674 - DNA, 20 bp, synthetic construct
  misc_feature 1..20: note = Synthetic Construct
  source 1..20: mol_type = other DNA
cactccgcattgttgtgcat

SEQ ID NO: 2675 - DNA, 20 bp, synthetic construct
  misc_feature 1..20: note = Synthetic Construct
  source 1..20: mol_type = other DNA
acaccctgtggggccgatga

SEQ ID NO: 2676 - DNA, 24 bp, synthetic construct
  misc_feature 1..24: note = Synthetic Construct
  source 1..24: mol_type = other DNA
gtggtagttagacctccccgaaag

SEQ ID NO: 2677 - DNA, 21 bp, synthetic construct
  misc_feature 1..21: note = Synthetic Construct
  source 1..21: mol_type = other DNA
gggcagaagtggatggtgaga

SEQ ID NO: 2678 - DNA, 21 bp, synthetic construct
  misc_feature 1..21: note = Synthetic Construct
  source 1..21: mol_type = other DNA
gcccctaccctgttcctccat

SEQ ID NO: 2679 - DNA, 24 bp, synthetic construct
  misc_feature 1..24: note = Synthetic Construct
  source 1..24: mol_type = other DNA
acttccaggagcacctttgaatag

SEQ ID NO: 2680 - DNA, 26 bp, synthetic construct
  misc_feature 1..26: note = Synthetic Construct
  source 1..26: mol_type = other DNA
ccatcaaagaggtaacaagccagtga

SEQ ID NO: 2681 - DNA, 20 bp, synthetic construct
  misc_feature 1..20: note = Synthetic Construct
  source 1..20: mol_type = other DNA
aaccccgtcttggctcgatt

SEQ ID NO: 2682 - DNA, 19 bp, synthetic construct
  misc_feature 1..19: note = Synthetic Construct
  source 1..19: mol_type = other DNA
gctacacgctgggcaccaa

SEQ ID NO: 2683 - DNA, 22 bp, synthetic construct
  misc_feature 1..22: note = Synthetic Construct
  source 1..22: mol_type = other DNA
gccctatggcaaaggctcacta

SEQ ID NO: 2684 - DNA, 20 bp, synthetic construct
  misc_feature 1..20: note = Synthetic Construct
  source 1..20: mol_type = other DNA
aagcctctggctggtgtttc

SEQ ID NO: 2685 - DNA, 20 bp, synthetic construct
  misc_feature 1..20: note = Synthetic Construct
  source 1..20: mol_type = other DNA
cctgtggttttgggcaggtt

SEQ ID NO: 2686 - DNA, 20 bp, synthetic construct
  misc_feature 1..20: note = Synthetic Construct
  source 1..20: mol_type = other DNA
tggttaccaccctgggatca

SEQ ID NO: 2687 - DNA, 21 bp, synthetic construct
  misc_feature 1..21: note = Synthetic Construct
  source 1..21: mol_type = other DNA
tctggtactcccagggtgcat

SEQ ID NO: 2688 - DNA, 20 bp, synthetic construct
  misc_feature 1..20: note = Synthetic Construct
  source 1..20: mol_type = other DNA
tggatacaccgggcttgtct

SEQ ID NO: 2689 - DNA, 20 bp, synthetic construct
  misc_feature 1..20: note = Synthetic Construct
  source 1..20: mol_type = other DNA
aagacaccgcgctgcctagt

SEQ ID NO: 2690 - DNA, 21 bp, synthetic construct
  misc_feature 1..21: note = Synthetic Construct
  source 1..21: mol_type = other DNA
tccagaggcaggagacaatca

SEQ ID NO: 2691 - DNA, 27 bp, synthetic construct
  misc_feature 1..27: note = Synthetic Construct
  source 1..27: mol_type = other DNA
ccgcaattggagctgaattcttaaatc

SEQ ID NO: 2692 - DNA, 20 bp, synthetic construct
  misc_feature 1..20: note = Synthetic Construct
  source 1..20: mol_type = other DNA
ccttggggtggcccacttag

SEQ ID NO: 2693 - DNA, 21 bp, synthetic construct
  misc_feature 1..21: note = Synthetic Construct
  source 1..21: mol_type = other DNA
ttttccctgacgatcggcttt

SEQ ID NO: 2694 - DNA, 23 bp, synthetic construct
  misc_feature 1..23: note = Synthetic Construct
  source 1..23: mol_type = other DNA
gtcagggagaacctatggaccta

SEQ ID NO: 2695 - DNA, 24 bp, synthetic construct
  misc_feature 1..24: note = Synthetic Construct
  source 1..24: mol_type = other DNA
ccccagacagatgtaagtccaaca

SEQ ID NO: 2696 - DNA, 20 bp, synthetic construct
  misc_feature 1..20: note = Synthetic Construct
  source 1..20: mol_type = other DNA
ctgcatgcctggaacacact

SEQ ID NO: 2697 - DNA, 22 bp, synthetic construct
  misc_feature 1..22: note = Synthetic Construct
  source 1..22: mol_type = other DNA
ctggactgctcactctggaact

SEQ ID NO: 2698 - DNA, 20 bp, synthetic construct
  misc_feature 1..20: note = Synthetic Construct
  source 1..20: mol_type = other DNA
tgcccgaagaggcatgaaac

SEQ ID NO: 2699 - DNA, 23 bp, synthetic construct
  misc_feature 1..23: note = Synthetic Construct
  source 1..23: mol_type = other DNA
tcttctccaaagtcagggtgtct

SEQ ID NO: 2700 - DNA, 20 bp, synthetic construct
  misc_feature 1..20: note = Synthetic Construct
  source 1..20: mol_type = other DNA
gcagtgccaggagcaaaaga

SEQ ID NO: 2701 - DNA, 25 bp, synthetic construct
  misc_feature 1..25: note = Synthetic Construct
  source 1..25: mol_type = other DNA
agccttaaaaactgccttctacaca

SEQ ID NO: 2702 - DNA, 25 bp, synthetic construct
  misc_feature 1..25: note = Synthetic Construct
  source 1..25: mol_type = other DNA
gggattcactagtgttgtggattga

SEQ ID NO: 2703 - DNA, 22 bp, synthetic construct
  misc_feature 1..22: note = Synthetic Construct
  source 1..22: mol_type = other DNA
ccaatggtggaaacagcctaca

SEQ ID NO: 2704 - DNA, 23 bp, synthetic construct
  misc_feature 1..23: note = Synthetic Construct
  source 1..23: mol_type = other DNA
gctagatgagggaggctggaaac

SEQ ID NO: 2705 - DNA, 20 bp, synthetic construct
  misc_feature 1..20: note = Synthetic Construct
  source 1..20: mol_type = other DNA
cctggatgtggctggcagta

SEQ ID NO: 2706 - DNA, 20 bp, synthetic construct
  misc_feature 1..20: note = Synthetic Construct
  source 1..20: mol_type = other DNA
cattggcaacccagctcaca

SEQ ID NO: 2707 - DNA, 21 bp, synthetic construct
  misc_feature 1..21: note = Synthetic Construct
  source 1..21: mol_type = other DNA
agcccgagcctcctacaactt

SEQ ID NO: 2708 - DNA, 20 bp, synthetic construct
  misc_feature 1..20: note = Synthetic Construct
  source 1..20: mol_type = other DNA
acagggctccaggcgagtgt

SEQ ID NO: 2709 - DNA, 21 bp, synthetic construct
  misc_feature 1..21: note = Synthetic Construct
  source 1..21: mol_type = other DNA
tgggaggtgaaccagggacat

SEQ ID NO: 2710 - DNA, 22 bp, synthetic construct
  misc_feature 1..22: note = Synthetic Construct
  source 1..22: mol_type = other DNA
gggctgcagagataagctcgtt

SEQ ID NO: 2711 - DNA, 22 bp, synthetic construct
  misc_feature 1..22: note = Synthetic Construct
  source 1..22: mol_type = other DNA
cgtcacagccagttctcacaca

SEQ ID NO: 2712 - DNA, 20 bp, synthetic construct
  misc_feature 1..20: note = Synthetic Construct
  source 1..20: mol_type = other DNA
tctgacctgcgggcagtttg

SEQ ID NO: 2713 - DNA, 23 bp, synthetic construct
  misc_feature 1..23: note = Synthetic Construct
  source 1..23: mol_type = other DNA
gcgagaaacaccactgacatttg

SEQ ID NO: 2714 - DNA, 22 bp, synthetic construct
  misc_feature 1..22: note = Synthetic Construct
  source 1..22: mol_type = other DNA
cccaatggtagctggcatgctt

SEQ ID NO: 2715 - DNA, 21 bp, synthetic construct
  misc_feature 1..21: note = Synthetic Construct
  source 1..21: mol_type = other DNA
acctccccagggacactcact

SEQ ID NO: 2716 - DNA, 22 bp, synthetic construct
  misc_feature 1..22: note = Synthetic Construct
  source 1..22: mol_type = other DNA
aggcagtggcctcctctttgta

SEQ ID NO: 2717 - DNA, 20 bp, synthetic construct
  misc_feature 1..20: note = Synthetic Construct
  source 1..20: mol_type = other DNA
ttgccggtggatcctgactt

SEQ ID NO: 2718 - DNA, 22 bp, synthetic construct
  misc_feature 1..22: note = Synthetic Construct
  source 1..22: mol_type = other DNA
tgcaattgatcgttggctccta

SEQ ID NO: 2719 - DNA, 22 bp, synthetic construct
  misc_feature 1..22: note = Synthetic Construct
  source 1..22: mol_type = other DNA
ggccgctttcttagggtgtaag

SEQ ID NO: 2720 - DNA, 24 bp, synthetic construct
  misc_feature 1..24: note = Synthetic Construct
  source 1..24: mol_type = other DNA
ggtgaaaggtgaggatcaatcaga

SEQ ID NO: 2721 - DNA, 20 bp, synthetic construct
  misc_feature 1..20: note = Synthetic Construct
  source 1..20: mol_type = other DNA
tgtgccttctgggagaccat

SEQ ID NO: 2722 - DNA, 25 bp, synthetic construct
  misc_feature 1..25: note = Synthetic Construct
  source 1..25: mol_type = other DNA
ggttctccagaatggtcctgtcgtt

SEQ ID NO: 2723 - DNA, 20 bp, synthetic construct
  misc_feature 1..20: note = Synthetic Construct
  source 1..20: mol_type = other DNA
gcagccttagggctagcaaa

SEQ ID NO: 2724 - DNA, 22 bp, synthetic construct
  misc_feature 1..22: note = Synthetic Construct
  source 1..22: mol_type = other DNA
cccctaaacctgggccaaatga

SEQ ID NO: 2725 - DNA, 20 bp, synthetic construct
  misc_feature 1..20: note = Synthetic Construct
  source 1..20: mol_type = other DNA
tgacaggccatgccacaaag

SEQ ID NO: 2726 - DNA, 26 bp, synthetic construct
  misc_feature 1..26: note = Synthetic Construct
  source 1..26: mol_type = other DNA
cccatcctattaccccaaacgtcttc

SEQ ID NO: 2727 - DNA, 20 bp, synthetic construct
  misc_feature 1..20: note = Synthetic Construct
  source 1..20: mol_type = other DNA
actgcagcccctgtgaatac

SEQ ID NO: 2728 - DNA, 23 bp, synthetic construct
  misc_feature 1..23: note = Synthetic Construct
  source 1..23: mol_type = other DNA
ggagacgtcctgcctgcagtctt

SEQ ID NO: 2729 - DNA, 20 bp, synthetic construct
  misc_feature 1..20: note = Synthetic Construct
  source 1..20: mol_type = other DNA
gcgcacagcagaatggagat

SEQ ID NO: 2730 - DNA, 23 bp, synthetic construct
  misc_feature 1..23: note = Synthetic Construct
  source 1..23: mol_type = other DNA
gcatgcagtggtgtatgttgtag

SEQ ID NO: 2731 - DNA, 25 bp, synthetic construct
  misc_feature 1..25: note = Synthetic Construct
  source 1..25: mol_type = other DNA
gcctaatgtttgtggggtagtggta

SEQ ID NO: 2732 - DNA, 20 bp, synthetic construct
  misc_feature 1..20: note = Synthetic Construct
  source 1..20: mol_type = other DNA
gggagaccaggcccctaaga

SEQ ID NO: 2733 - DNA, 20 bp, synthetic construct
  misc_feature 1..20: note = Synthetic Construct
  source 1..20: mol_type = other DNA
tccctgcaaggaccctcagt

SEQ ID NO: 2734 - DNA, 22 bp, synthetic construct
  misc_feature 1..22: note = Synthetic Construct
  source 1..22: mol_type = other DNA
tctcacctgaccctgaggtctt

SEQ ID NO: 2735 - DNA, 22 bp, synthetic construct
  misc_feature 1..22: note = Synthetic Construct
  source 1..22: mol_type = other DNA
gacgcagcttgccttagacttc

SEQ ID NO: 2736 - DNA, 24 bp, synthetic construct
  misc_feature 1..24: note = Synthetic Construct
  source 1..24: mol_type = other DNA
gggtgcagctgacttcctagtctt

SEQ ID NO: 2737 - DNA, 22 bp, synthetic construct
  misc_feature 1..22: note = Synthetic Construct
  source 1..22: mol_type = other DNA
gtgcggtcaaggtttacaggtt

SEQ ID NO: 2738 - DNA, 22 bp, synthetic construct
  misc_feature 1..22: note = Synthetic Construct
  source 1..22: mol_type = other DNA
tcacaagctccactccctcaag

SEQ ID NO: 2739 - DNA, 18 bp, synthetic construct
  misc_feature 1..18: note = Synthetic Construct
  source 1..18: mol_type = other DNA
tctgcgtgtgcgtgtgtt

SEQ ID NO: 2740 - DNA, 21 bp, synthetic construct
  misc_feature 1..21: note = Synthetic Construct
  source 1..21: mol_type = other DNA
cagtgacatgtggcccagttt

SEQ ID NO: 2741 - DNA, 25 bp, synthetic construct
  misc_feature 1..25: note = Synthetic Construct
  source 1..25: mol_type = other DNA
tgttcaatgatactggtgcaggatt

SEQ ID NO: 2742 - DNA, 24 bp, synthetic construct
  misc_feature 1..24: note = Synthetic Construct
  source 1..24: mol_type = other DNA
ggcgtggagttgcttcatctcctt

SEQ ID NO: 2743 - DNA, 19 bp, synthetic construct
  misc_feature 1..19: note = Synthetic Construct
  source 1..19: mol_type = other DNA
tggggtggcacagccaact

SEQ ID NO: 2744 - DNA, 22 bp, synthetic construct
  misc_feature 1..22: note = Synthetic Construct
  source 1..22: mol_type = other DNA
accacgtgacaggtgtgaggat

SEQ ID NO: 2745 - DNA, 24 bp, synthetic construct
  misc_feature 1..24: note = Synthetic Construct
  source 1..24: mol_type = other DNA
ggagtagctctgtagggagagttg

SEQ ID NO: 2746 - DNA, 23 bp, synthetic construct
  misc_feature 1..23: note = Synthetic Construct
  source 1..23: mol_type = other DNA
acatgattgatgccaaggggtaa

SEQ ID NO: 2747 - DNA, 22 bp, synthetic construct
  misc_feature 1..22: note = Synthetic Construct
  source 1..22: mol_type = other DNA
tgcgtgctcagagtcacataag

SEQ ID NO: 2748 - DNA, 20 bp, synthetic construct
  misc_feature 1..20: note = Synthetic Construct
  source 1..20: mol_type = other DNA
agcacacccctcctgcactt

SEQ ID NO: 2749 - DNA, 19 bp, synthetic construct
  misc_feature 1..19: note = Synthetic Construct
  source 1..19: mol_type = other DNA
ccaggcggctccaagaagt

SEQ ID NO: 2750 - DNA, 20 bp, synthetic construct
  misc_feature 1..20: note = Synthetic Construct
  source 1..20: mol_type = other DNA
aaacctggcagaggttgcat

SEQ ID NO: 2751 - DNA, 22 bp, synthetic construct
  misc_feature 1..22: note = Synthetic Construct
  source 1..22: mol_type = other DNA
caggatctgaacgggaggtttc

SEQ ID NO: 2752 - DNA, 24 bp, synthetic construct
  misc_feature 1..24: note = Synthetic Construct
  source 1..24: mol_type = other DNA
ggtggaaatctaccccaggcaact

SEQ ID NO: 2753 - DNA, 22 bp, synthetic construct
  misc_feature 1..22: note = Synthetic Construct
  source 1..22: mol_type = other DNA
ctgccggtgaactgagagtaga

SEQ ID NO: 2754 - DNA, 19 bp, synthetic construct
  misc_feature 1..19: note = Synthetic Construct
  source 1..19: mol_type = other DNA
atccctggccatgctgcta

SEQ ID NO: 2755 - DNA, 24 bp, synthetic construct
  misc_feature 1..24: note = Synthetic Construct
  source 1..24: mol_type = other DNA
agtgactcatcctgaagtcctgaa

SEQ ID NO: 2756 - DNA, 20 bp, synthetic construct
  misc_feature 1..20: note = Synthetic Construct
  source 1..20: mol_type = other DNA
acaggaaggcaccacgttga

SEQ ID NO: 2757 - DNA, 19 bp, synthetic construct
  misc_feature 1..19: note = Synthetic Construct
  source 1..19: mol_type = other DNA
gaggggccaagtgcagaag

SEQ ID NO: 2758 - DNA, 21 bp, synthetic construct
  misc_feature 1..21: note = Synthetic Construct
  source 1..21: mol_type = other DNA
agaggtgaccaggccctttga

SEQ ID NO: 2759 - DNA, 22 bp, synthetic construct
  misc_feature 1..22: note = Synthetic Construct
  source 1..22: mol_type = other DNA
gtgacgcgacctgctcataagt

SEQ ID NO: 2760 - DNA, 22 bp, synthetic construct
  misc_feature 1..22: note = Synthetic Construct
  source 1..22: mol_type = other DNA
acctgggctccatcctgtgaat

SEQ ID NO: 2761 - DNA, 23 bp, synthetic construct
  misc_feature 1..23: note = Synthetic Construct
  source 1..23: mol_type = other DNA
gctcaattcctcccactgcttct

SEQ ID NO: 2762 - DNA, 22 bp, synthetic construct
  misc_feature 1..22: note = Synthetic Construct
  source 1..22: mol_type = other DNA
ctcttctggagaaggggagagt

SEQ ID NO: 2763 - DNA, 27 bp, synthetic construct
  misc_feature 1..27: note = Synthetic Construct
  source 1..27: mol_type = other DNA
gtccaactccttccatctgaattcttc

SEQ ID NO: 2764 - DNA, 24 bp, synthetic construct
  misc_feature 1..24: note = Synthetic Construct
  source 1..24: mol_type = other DNA
cacgtaggcctctgttttctggtt

SEQ ID NO: 2765 - DNA, 22 bp, synthetic construct
  misc_feature 1..22: note = Synthetic Construct
  source 1..22: mol_type = other DNA
cccctggctaagctcaaagtca

SEQ ID NO: 2766 - DNA, 22 bp, synthetic construct
  misc_feature 1..22: note = Synthetic Construct
  source 1..22: mol_type = other DNA
ggaaaacacaccgccagagaag

SEQ ID NO: 2767 - DNA, 23 bp, synthetic construct
  misc_feature 1..23: note = Synthetic Construct
  source 1..23: mol_type = other DNA
gcaaactcctaggctctgtgctt

SEQ ID NO: 2768 - DNA, 23 bp, synthetic construct
  misc_feature 1..23: note = Synthetic Construct
  source 1..23: mol_type = other DNA
gtgagaggatgtgtgcgttccat

SEQ ID NO: 2769 - DNA, 23 bp, synthetic construct
  misc_feature 1..23: note = Synthetic Construct
  source 1..23: mol_type = other DNA
cattaccccagttggcagaaaac

SEQ ID NO: 2770 - DNA, 22 bp, synthetic construct
  misc_feature 1..22: note = Synthetic Construct
  source 1..22: mol_type = other DNA
gacaagttgggtggacagtctt

SEQ ID NO: 2771 - DNA, 19 bp, synthetic construct
  misc_feature 1..19: note = Synthetic Construct
  source 1..19: mol_type = other DNA
aaggggtgctctcccttga

SEQ ID NO: 2772 - DNA, 23 bp, synthetic construct
  misc_feature 1..23: note = Synthetic Construct
  source 1..23: mol_type = other DNA
ccccgtgaaatgatggtggaaac

SEQ ID NO: 2773 - DNA, 25 bp, synthetic construct
  misc_feature 1..25: note = Synthetic Construct
  source 1..25: mol_type = other DNA
ggtaatcaaccctcagtctctcatc

SEQ ID NO: 2774 - DNA, 19 bp, synthetic construct
  misc_feature 1..19: note = Synthetic Construct
  source 1..19: mol_type = other DNA
aggccagccctctgacttc

SEQ ID NO: 2775 - DNA, 20 bp, synthetic construct
  misc_feature 1..20: note = Synthetic Construct
  source 1..20: mol_type = other DNA
gcttgggactctggggttga

SEQ ID NO: 2776 - DNA, 21 bp, synthetic construct
  misc_feature 1..21: note = Synthetic Construct
  source 1..21: mol_type = other DNA
cctggctttgccccttcatct

SEQ ID NO: 2777 - DNA, 18 bp, synthetic construct
  misc_feature 1..18: note = Synthetic Construct
  source 1..18: mol_type = other DNA
agccagcctctgcacctt

SEQ ID NO: 2778 - DNA, 21 bp, synthetic construct
  misc_feature 1..21: note = Synthetic Construct
  source 1..21: mol_type = other DNA
cctctgaaaggcggaaaccaa

SEQ ID NO: 2779 - DNA, 18 bp, synthetic construct
  misc_feature 1..18: note = Synthetic Construct
  source 1..18: mol_type = other DNA
agtggccagcaggagcaa

SEQ ID NO: 2780 - DNA, 23 bp, synthetic construct
  misc_feature 1..23: note = Synthetic Construct
  source 1..23: mol_type = other DNA
ccagggcaggactctaaccattg

SEQ ID NO: 2781 - DNA, 24 bp, synthetic construct
  misc_feature 1..24: note = Synthetic Construct
  source 1..24: mol_type = other DNA
gttaggaaagggtcccctaaggtt

SEQ ID NO: 2782 - DNA, 20 bp, synthetic construct
  misc_feature 1..20: note = Synthetic Construct
  source 1..20: mol_type = other DNA
ggtggcttggattgcctact

SEQ ID NO: 2783 - DNA, 20 bp, synthetic construct
  misc_feature 1..20: note = Synthetic Construct
  source 1..20: mol_type = other DNA
tccaccctggccccagcatt

SEQ ID NO: 2784 - DNA, 21 bp, synthetic construct
  misc_feature 1..21: note = Synthetic Construct
  source 1..21: mol_type = other DNA
cgtggaggggaggaagtcttg

SEQ ID NO: 2785 - DNA, 20 bp, synthetic construct
  misc_feature 1..20: note = Synthetic Construct
  source 1..20: mol_type = other DNA
accaatgggaggcaccatca

SEQ ID NO: 2786 - DNA, 24 bp, synthetic construct
  misc_feature 1..24: note = Synthetic Construct
  source 1..24: mol_type = other DNA
gagttgcacttgtactctgtcagt

SEQ ID NO: 2787 - DNA, 25 bp, synthetic construct
  misc_feature 1..25: note = Synthetic Construct
  source 1..25: mol_type = other DNA
ggctttttggctttccaggttgatg

SEQ ID NO: 2788 - DNA, 20 bp, synthetic construct
  misc_feature 1..20: note = Synthetic Construct
  source 1..20: mol_type = other DNA
cccgcaagggttggggaaat

SEQ ID NO: 2789 - DNA, 20 bp, synthetic construct
  misc_feature 1..20: note = Synthetic Construct
  source 1..20: mol_type = other DNA
tccaacaccatccgctcttc

SEQ ID NO: 2790 - DNA, 22 bp, synthetic construct
  misc_feature 1..22: note = Synthetic Construct
  source 1..22: mol_type = other DNA
gtgggtgccagagttgagattc

SEQ ID NO: 2791 - DNA, 19 bp, synthetic construct
  misc_feature 1..19: note = Synthetic Construct
  source 1..19: mol_type = other DNA
ggccgggaaaagggagcat

SEQ ID NO: 2792 - DNA, 28 bp, synthetic construct
  misc_feature 1..28: note = Synthetic Construct
  source 1..28: mol_type = other DNA
gtcttccccatagttaagttgtctcttc

SEQ ID NO: 2793 - DNA, 28 bp, synthetic construct
  misc_feature 1..28: note = Synthetic Construct
  source 1..28: mol_type = other DNA
gcagctacgcatacaaatcactcacatc

SEQ ID NO: 2794 - DNA, 21 bp, synthetic construct
  misc_feature 1..21: note = Synthetic Construct
  source 1..21: mol_type = other DNA
actggactcagggagcagcat

SEQ ID NO: 2795 - DNA, 19 bp, synthetic construct
  misc_feature 1..19: note = Synthetic Construct
  source 1..19: mol_type = other DNA
aggccactgcctcgcatca

SEQ ID NO: 2796 - DNA, 25 bp, synthetic construct
  misc_feature 1..25: note = Synthetic Construct
  source 1..25: mol_type = other DNA
ggacttttgttttccccgtttgaag

SEQ ID NO: 2797 - DNA, 25 bp, synthetic construct
  misc_feature 1..25: note = Synthetic Construct
  source 1..25: mol_type = other DNA
tctaaatgttctctgggtgctgttc

SEQ ID NO: 2798 - DNA, 22 bp, synthetic construct
  misc_feature 1..22: note = Synthetic Construct
  source 1..22: mol_type = other DNA
ggggtctaatggctgtggttgt

SEQ ID NO: 2799 - DNA, 22 bp, synthetic construct
  misc_feature 1..22: note = Synthetic Construct
  source 1..22: mol_type = other DNA
ggctgttagccctgtggaacaa

SEQ ID NO: 2800 - DNA, 20 bp, synthetic construct
  misc_feature 1..20: note = Synthetic Construct
  source 1..20: mol_type = other DNA
acggcagagcaaaggcttgt

SEQ ID NO: 2801 - DNA, 28 bp, synthetic construct
  misc_feature 1..28: note = Synthetic Construct
  source 1..28: mol_type = other DNA
ggacaaggccctttaattcataccaaga

SEQ ID NO: 2802 - DNA, 18 bp, synthetic construct
  misc_feature 1..18: note = Synthetic Construct
  source 1..18: mol_type = other DNA
agcccagagcagcgttca

SEQ ID NO: 2803 - DNA, 21 bp, synthetic construct
  misc_feature 1..21: note = Synthetic Construct
  source 1..21: mol_type = other DNA
tggtagtgtagaggggcaact

SEQ ID NO: 2804 - DNA, 20 bp, synthetic construct
  misc_feature 1..20: note = Synthetic Construct
  source 1..20: mol_type = other DNA
gggccaagcgttcagactac

SEQ ID NO: 2805 - DNA, 18 bp, synthetic construct
  misc_feature 1..18: note = Synthetic Construct
  source 1..18: mol_type = other DNA
atgctcaggctgcgttgt

SEQ ID NO: 2806 - DNA, 21 bp, synthetic construct
  misc_feature 1..21: note = Synthetic Construct
  source 1..21: mol_type = other DNA
tggctccctgaggagtgtttg

SEQ ID NO: 2807 - DNA, 25 bp, synthetic construct
  misc_feature 1..25: note = Synthetic Construct
  source 1..25: mol_type = other DNA
cagaaaagtctagtgaagccagaca

SEQ ID NO: 2808 - DNA, 22 bp, synthetic construct
  misc_feature 1..22: note = Synthetic Construct
  source 1..22: mol_type = other DNA
cacagacaactggagggtgaac

SEQ ID NO: 2809 - DNA, 23 bp, synthetic construct
  misc_feature 1..23: note = Synthetic Construct
  source 1..23: mol_type = other DNA
acatacctgctgtaccccaaatg

SEQ ID NO: 2810 - DNA, 24 bp, synthetic construct
  misc_feature 1..24: note = Synthetic Construct
  source 1..24: mol_type = other DNA
gcaatgaacaacgacaggctttca

SEQ ID NO: 2811 - DNA, 22 bp, synthetic construct
  misc_feature 1..22: note = Synthetic Construct
  source 1..22: mol_type = other DNA
gactgagcttgtgaggcaggaa

SEQ ID NO: 2812 - DNA, 25 bp, synthetic construct
  misc_feature 1..25: note = Synthetic Construct
  source 1..25: mol_type = other DNA
gcatactaaaggagctttggagaca

SEQ ID NO: 2813 - DNA, 19 bp, synthetic construct
  misc_feature 1..19: note = Synthetic Construct
  source 1..19: mol_type = other DNA
gccaaccaggccagcatca

SEQ ID NO: 2814 - DNA, 21 bp, synthetic construct
  misc_feature 1..21: note = Synthetic Construct
  source 1..21: mol_type = other DNA
acagagcggtacagcggaatc

SEQ ID NO: 2815 - DNA, 26 bp, synthetic construct
  misc_feature 1..26: note = Synthetic Construct
  source 1..26: mol_type = other DNA
gagaaagtgagcatttgccatgaaag

SEQ ID NO: 2816 - DNA, 26 bp, synthetic construct
  misc_feature 1..26: note = Synthetic Construct
  source 1..26: mol_type = other DNA
ggtcttaccttcagagttctgtccta

SEQ ID NO: 2817 - DNA, 27 bp, synthetic construct
  misc_feature 1..27: note = Synthetic Construct
  source 1..27: mol_type = other DNA
ggggaacatttcagaccagataacact

SEQ ID NO: 2818 - DNA, 20 bp, synthetic construct
  misc_feature 1..20: note = Synthetic Construct
  source 1..20: mol_type = other DNA
agggccaatcctggaacact

SEQ ID NO: 2819 - DNA, 29 bp, synthetic construct
  misc_feature 1..29: note = Synthetic Construct
  source 1..29: mol_type = other DNA
ccttgcaccaaaaatagaagtgtgagcta

SEQ ID NO: 2820 - DNA, 18 bp, synthetic construct
  misc_feature 1..18: note = Synthetic Construct
  source 1..18: mol_type = other DNA
actgccaagtggctgcaa

SEQ ID NO: 2821 - DNA, 22 bp, synthetic construct
  misc_feature 1..22: note = Synthetic Construct
  source 1..22: mol_type = other DNA
cacagctgaacctcaggcaatc

SEQ ID NO: 2822 - DNA, 22 bp, synthetic construct
  misc_feature 1..22: note = Synthetic Construct
  source 1..22: mol_type = other DNA
caacagccgggatcttctgaac

SEQ ID NO: 2823 - DNA, 24 bp, synthetic construct
  misc_feature 1..24: note = Synthetic Construct
  source 1..24: mol_type = other DNA
gggcctaggtgtgtgtatccagtt

SEQ ID NO: 2824 - DNA, 25 bp, synthetic construct
  misc_feature 1..25: note = Synthetic Construct
  source 1..25: mol_type = other DNA
cctgtcggaatgttttctccaccaa

SEQ ID NO: 2825 - DNA, 22 bp, synthetic construct
  misc_feature 1..22: note = Synthetic Construct
  source 1..22: mol_type = other DNA
gggtctaaggacaccgggtcta

SEQ ID NO: 2826 - DNA, 21 bp, synthetic construct
  misc_feature 1..21: note = Synthetic Construct
  source 1..21: mol_type = other DNA
tttccggtggggccaatgtgt

SEQ ID NO: 2827 - DNA, 23 bp, synthetic construct
  misc_feature 1..23: note = Synthetic Construct
  source 1..23: mol_type = other DNA
gcattgtcaggcttctctctttg

SEQ ID NO: 2828 - DNA, 25 bp, synthetic construct
  misc_feature 1..25: note = Synthetic Construct
  source 1..25: mol_type = other DNA
cagaaatcagaagctctcagggaaa

SEQ ID NO: 2829 - DNA, 24 bp, synthetic construct
  misc_feature 1..24: note = Synthetic Construct
  source 1..24: mol_type = other DNA
actcttttgcctgggatttaccat

SEQ ID NO: 2830 - DNA, 20 bp, synthetic construct
  misc_feature 1..20: note = Synthetic Construct
  source 1..20: mol_type = other DNA
atctggcccgtgctccactt

SEQ ID NO: 2831 - DNA, 19 bp, synthetic construct
  misc_feature 1..19: note = Synthetic Construct
  source 1..19: mol_type = other DNA
aacacctggggaggcaaca

SEQ ID NO: 2832 - DNA, 19 bp, synthetic construct
  misc_feature 1..19: note = Synthetic Construct
  source 1..19: mol_type = other DNA
aggcagggagcacagagat

SEQ ID NO: 2833 - DNA, 23 bp, synthetic construct
  misc_feature 1..23: note = Synthetic Construct
  source 1..23: mol_type = other DNA
ggttttggggcatagtccacagt

SEQ ID NO: 2834 - DNA, 20 bp, synthetic construct
  misc_feature 1..20: note = Synthetic Construct
  source 1..20: mol_type = other DNA
cctcccctcccagcatgaag

SEQ ID NO: 2835 - DNA, 22 bp, synthetic construct
  misc_feature 1..22: note = Synthetic Construct
  source 1..22: mol_type = other DNA
tccctgggtggtctgtctgatt

SEQ ID NO: 2836 - DNA, 22 bp, synthetic construct
  misc_feature 1..22: note = Synthetic Construct
  source 1..22: mol_type = other DNA
ccccatcccattgcttctcagt

SEQ ID NO: 2837 - DNA, 21 bp, synthetic construct
  misc_feature 1..21: note = Synthetic Construct
  source 1..21: mol_type = other DNA
tggcttcaaggtagggaggtt

SEQ ID NO: 2838 - DNA, 19 bp, synthetic construct
  misc_feature 1..19: note = Synthetic Construct
  source 1..19: mol_type = other DNA
ggagggtggcagtgtggta

SEQ ID NO: 2839 - DNA, 23 bp, synthetic construct
  misc_feature 1..23: note = Synthetic Construct
  source 1..23: mol_type = other DNA
gctgtatccagggaggtgacaag

SEQ ID NO: 2840 - DNA, 25 bp, synthetic construct
  misc_feature 1..25: note = Synthetic Construct
  source 1..25: mol_type = other DNA
cctgcgtgtcaaatactcctttcta

SEQ ID NO: 2841 - DNA, 24 bp, synthetic construct
  misc_feature 1..24: note = Synthetic Construct
  source 1..24: mol_type = other DNA
gctgttgtggttaagagcctggat

SEQ ID NO: 2842 - DNA, 23 bp, synthetic construct
  misc_feature 1..23: note = Synthetic Construct
  source 1..23: mol_type = other DNA
accaggcatagtggagataggaa

SEQ ID NO: 2843 - DNA, 20 bp, synthetic construct
  misc_feature 1..20: note = Synthetic Construct
  source 1..20: mol_type = other DNA
tgccggcctcccagtctcat

SEQ ID NO: 2844 - DNA, 19 bp, synthetic construct
  misc_feature 1..19: note = Synthetic Construct
  source 1..19: mol_type = other DNA
tgctcgggcagggtgagaa

SEQ ID NO: 2845 - DNA, 22 bp, synthetic construct
  misc_feature 1..22: note = Synthetic Construct
  source 1..22: mol_type = other DNA
ggcacccgtttggccttaattg

SEQ ID NO: 2846 - DNA, 20 bp, synthetic construct
  misc_feature 1..20: note = Synthetic Construct
  source 1..20: mol_type = other DNA
tggtgggcaggagaggctaa

SEQ ID NO: 2847 - DNA, 22 bp, synthetic construct
  misc_feature 1..22: note = Synthetic Construct
  source 1..22: mol_type = other DNA
aagtgggtgctacagaagcatt

SEQ ID NO: 2848 - DNA, 27 bp, synthetic construct
  misc_feature 1..27: note = Synthetic Construct
  source 1..27: mol_type = other DNA
gggctaagaatgagtgattgggtcata

SEQ ID NO: 2849 - DNA, 22 bp, synthetic construct
  misc_feature 1..22: note = Synthetic Construct
  source 1..22: mol_type = other DNA
ttcaggctctgagacacgaaag

SEQ ID NO: 2850 - DNA, 20 bp, synthetic construct
  misc_feature 1..20: note = Synthetic Construct
  source 1..20: mol_type = other DNA
actcctgaccgagggaatgt

SEQ ID NO: 2851 - DNA, 22 bp, synthetic construct
  misc_feature 1..22: note = Synthetic Construct
  source 1..22: mol_type = other DNA
cccaaaggaaaccatcccatgt

SEQ ID NO: 2852 - DNA, 22 bp, synthetic construct
  misc_feature 1..22: note = Synthetic Construct
  source 1..22: mol_type = other DNA
cacaggttccctcccacttact

SEQ ID NO: 2853 - DNA, 22 bp, synthetic construct
  misc_feature 1..22: note = Synthetic Construct
  source 1..22: mol_type = other DNA
agccggggaatgtcctgtattc

SEQ ID NO: 2854 - DNA, 25 bp, synthetic construct
  misc_feature 1..25: note = Synthetic Construct
  source 1..25: mol_type = other DNA
ccttctgatgcttggataccgcaaa

SEQ ID NO: 2855 - DNA, 23 bp, synthetic construct
  misc_feature 1..23: note = Synthetic Construct
  source 1..23: mol_type = other DNA
gcagatcaggattgcaggctttg

SEQ ID NO: 2856 - DNA, 21 bp, synthetic construct
  misc_feature 1..21: note = Synthetic Construct
  source 1..21: mol_type = other DNA
ggcctcagaagccaggataag

SEQ ID NO: 2857 - DNA, 22 bp, synthetic construct
  misc_feature 1..22: note = Synthetic Construct
  source 1..22: mol_type = other DNA
ggtttcgctcatgcctctgttg

SEQ ID NO: 2858 - DNA, 20 bp, synthetic construct
  misc_feature 1..20: note = Synthetic Construct
  source 1..20: mol_type = other DNA
ttcctgagagggctgtgcta

SEQ ID NO: 2859 - DNA, 21 bp, synthetic construct
  misc_feature 1..21: note = Synthetic Construct
  source 1..21: mol_type = other DNA
accagctccttcctcccttct

SEQ ID NO: 2860 - DNA, 21 bp, synthetic construct
  misc_feature 1..21: note = Synthetic Construct
  source 1..21: mol_type = other DNA
gcacagctaggaatgggaaca

SEQ ID NO: 2861 - DNA, 27 bp, synthetic construct
  misc_feature 1..27: note = Synthetic Construct
  source 1..27: mol_type = other DNA
gctaatgctcaaagggaaaagtgtctt

SEQ ID NO: 2862 - DNA, 24 bp, synthetic construct
  misc_feature 1..24: note = Synthetic Construct
  source 1..24: mol_type = other DNA
gtggcattgtggaaacaagcaaag

SEQ ID NO: 2863 - DNA, 22 bp, synthetic construct
  misc_feature 1..22: note = Synthetic Construct
  source 1..22: mol_type = other DNA
cctgccagcagggcatttttct

SEQ ID NO: 2864 - DNA, 21 bp, synthetic construct
  misc_feature 1..21: note = Synthetic Construct
  source 1..21: mol_type = other DNA
cctcagatggctgagggaaga

SEQ ID NO: 2865 - DNA, 20 bp, synthetic construct
  misc_feature 1..20: note = Synthetic Construct
  source 1..20: mol_type = other DNA
gttcaggcctgcagggaaaa

SEQ ID NO: 2866 - DNA, 26 bp, synthetic construct
  misc_feature 1..26: note = Synthetic Construct
  source 1..26: mol_type = other DNA
gggtacaaatagcctttacagcattg

SEQ ID NO: 2867 - DNA, 22 bp, synthetic construct
  misc_feature 1..22: note = Synthetic Construct
  source 1..22: mol_type = other DNA
aggcagcttaggccactagtct

SEQ ID NO: 2868 - DNA, 25 bp, synthetic construct
  misc_feature 1..25: note = Synthetic Construct
  source 1..25: mol_type = other DNA
gaactccacccagttctaaggatag

SEQ ID NO: 2869 - DNA, 22 bp, synthetic construct
  misc_feature 1..22: note = Synthetic Construct
  source 1..22: mol_type = other DNA
ccctggaagaaggagagggaat

SEQ ID NO: 2870 - DNA, 21 bp, synthetic construct
  misc_feature 1..21: note = Synthetic Construct
  source 1..21: mol_type = other DNA
agggcagtgagcactgagttg

SEQ ID NO: 2871 - DNA, 21 bp, synthetic construct
  misc_feature 1..21: note = Synthetic Construct
  source 1..21: mol_type = other DNA
atccccacggacaccaacgat

SEQ ID NO: 2872 - DNA, 21 bp, synthetic construct
  misc_feature 1..21: note = Synthetic Construct
  source 1..21: mol_type = other DNA
gcagccattccctcaccacat

SEQ ID NO: 2873 - DNA, 19 bp, synthetic construct
  misc_feature 1..19: note = Synthetic Construct
  source 1..19: mol_type = other DNA
ccccgggcaaacacatact

SEQ ID NO: 2874 - DNA, 20 bp, synthetic construct
  misc_feature 1..20: note = Synthetic Construct
  source 1..20: mol_type = other DNA
atcctggtcctgggcagtaa

SEQ ID NO: 2875 - DNA, 22 bp, synthetic construct
  misc_feature 1..22: note = Synthetic Construct
  source 1..22: mol_type = other DNA
accaggtgccagctccctatac

SEQ ID NO: 2876 - DNA, 24 bp, synthetic construct
  misc_feature 1..24: note = Synthetic Construct
  source 1..24: mol_type = other DNA
gtggagcaggactagctgagaatc

SEQ ID NO: 2877 - DNA, 23 bp, synthetic construct
  misc_feature 1..23: note = Synthetic Construct
  source 1..23: mol_type = other DNA
gccagaaatccacaccatacaag

SEQ ID NO: 2878 - DNA, 24 bp, synthetic construct
  misc_feature 1..24: note = Synthetic Construct
  source 1..24: mol_type = other DNA
ggggacagtttcaagtggatgaga

SEQ ID NO: 2879 - DNA, 21 bp, synthetic construct
  misc_feature 1..21: note = Synthetic Construct
  source 1..21: mol_type = other DNA
aggtgagggcttgaggcagtt

SEQ ID NO: 2880 - DNA, 23 bp, synthetic construct
  misc_feature 1..23: note = Synthetic Construct
  source 1..23: mol_type = other DNA
tgagggaaaccaaaactgcattc

SEQ ID NO: 2881 - DNA, 22 bp, synthetic construct
  misc_feature 1..22: note = Synthetic Construct
  source 1..22: mol_type = other DNA
aggccttttccactctccctta

SEQ ID NO: 2882 - DNA, 24 bp, synthetic construct
  misc_feature 1..24: note = Synthetic Construct
  source 1..24: mol_type = other DNA
cccttacaaaccacagatgcaaag

SEQ ID NO: 2883 - DNA, 24 bp, synthetic construct
  misc_feature 1..24: note = Synthetic Construct
  source 1..24: mol_type = other DNA
cactcttaggaagggagtgtctgt

SEQ ID NO: 2884 - DNA, 22 bp, synthetic construct
  misc_feature 1..22: note = Synthetic Construct
  source 1..22: mol_type = other DNA
atagggaagtggtgtggtcaac

SEQ ID NO: 2885 - DNA, 18 bp, synthetic construct
  misc_feature 1..18: note = Synthetic Construct
  source 1..18: mol_type = other DNA
tccctgcctgggtcttgt

SEQ ID NO: 2886 - DNA, 22 bp, synthetic construct
  misc_feature 1..22: note = Synthetic Construct
  source 1..22: mol_type = other DNA
caggagctgaggctttggtttg

SEQ ID NO: 2887 - DNA, 22 bp, synthetic construct
  misc_feature 1..22: note = Synthetic Construct
  source 1..22: mol_type = other DNA
tgttttctgtgtgccagtgtgt

SEQ ID NO: 2888 - DNA, 20 bp, synthetic construct
  misc_feature 1..20: note = Synthetic Construct
  source 1..20: mol_type = other DNA
gcagggttcaggccagtaga

SEQ ID NO: 2889 - DNA, 22 bp, synthetic construct
  misc_feature 1..22: note = Synthetic Construct
  source 1..22: mol_type = other DNA
agctgggatggagggacattga

SEQ ID NO: 2890 - DNA, 27 bp, synthetic construct
  misc_feature 1..27: note = Synthetic Construct
  source 1..27: mol_type = other DNA
ggtgtacaattgctggatcctaagaca

SEQ ID NO: 2891 - DNA, 22 bp, synthetic construct
  misc_feature 1..22: note = Synthetic Construct
  source 1..22: mol_type = other DNA
cagcctccaggcaaatttccaa

SEQ ID NO: 2892 - DNA, 23 bp, synthetic construct
  misc_feature 1..23: note = Synthetic Construct
  source 1..23: mol_type = other DNA
gcaagtttggccatctcttgtga

SEQ ID NO: 2893 - DNA, 25 bp, synthetic construct
  misc_feature 1..25: note = Synthetic Construct
  source 1..25: mol_type = other DNA
cgtccatgaaggaatagctggtgtt

SEQ ID NO: 2894 - DNA, 23 bp, synthetic construct
  misc_feature 1..23: note = Synthetic Construct
  source 1..23: mol_type = other DNA
acccggctatacgagaactcttt

SEQ ID NO: 2895 - DNA, 25 bp, synthetic construct
  misc_feature 1..25: note = Synthetic Construct
  source 1..25: mol_type = other DNA
gttcatgaaagtgaaagagccatga

SEQ ID NO: 2896 - DNA, 23 bp, synthetic construct
  misc_feature 1..23: note = Synthetic Construct
  source 1..23: mol_type = other DNA
gggacaaaatcggctccttcaga

SEQ ID NO: 2897 - DNA, 20 bp, synthetic construct
  misc_feature 1..20: note = Synthetic Construct
  source 1..20: mol_type = other DNA
atgccctgaatcgcccttgt

SEQ ID NO: 2898 - DNA, 21 bp, synthetic construct
  misc_feature 1..21: note = Synthetic Construct
  source 1..21: mol_type = other DNA
cccacacctcttgccaaggaa

SEQ ID NO: 2899 - DNA, 20 bp, synthetic construct
  misc_feature 1..20: note = Synthetic Construct
  source 1..20: mol_type = other DNA
gcccatgggtaaggcaggaa

SEQ ID NO: 2900 - DNA, 19 bp, synthetic construct
  misc_feature 1..19: note = Synthetic Construct
  source 1..19: mol_type = other DNA
actggccggtggtcctgtt

SEQ ID NO: 2901 - DNA, 22 bp, synthetic construct
  misc_feature 1..22: note = Synthetic Construct
  source 1..22: mol_type = other DNA
cgctgtcctggaagtgttgttc

SEQ ID NO: 2902 - DNA, 21 bp, synthetic construct
  misc_feature 1..21: note = Synthetic Construct
  source 1..21: mol_type = other DNA
tggcccacagaaagggtctca

SEQ ID NO: 2903 - DNA, 24 bp, synthetic construct
  misc_feature 1..24: note = Synthetic Construct
  source 1..24: mol_type = other DNA
tctctggttaacagatgccagatg

SEQ ID NO: 2904 - DNA, 22 bp, synthetic construct
  misc_feature 1..22: note = Synthetic Construct
  source 1..22: mol_type = other DNA
cccaaaaggctctgaggtcatc

SEQ ID NO: 2905 - DNA, 21 bp, synthetic construct
  misc_feature 1..21: note = Synthetic Construct
  source 1..21: mol_type = other DNA
ggacatgactccctgggacaa

SEQ ID NO: 2906 - DNA, 20 bp, synthetic construct
  misc_feature 1..20: note = Synthetic Construct
  source 1..20: mol_type = other DNA
tgtcttagctgcgcctctgt

SEQ ID NO: 2907 - DNA, 19 bp, synthetic construct
  misc_feature 1..19: note = Synthetic Construct
  source 1..19: mol_type = other DNA
gccaagggcaggtgggata

SEQ ID NO: 2908 - DNA, 25 bp, synthetic construct
  misc_feature 1..25: note = Synthetic Construct
  source 1..25: mol_type = other DNA
cctttccaactccatcatctggtta

SEQ ID NO: 2909 - DNA, 25 bp, synthetic construct
  misc_feature 1..25: note = Synthetic Construct
  source 1..25: mol_type = other DNA
cctgcctgataccttcttgatgact

SEQ ID NO: 2910 - DNA, 22 bp, synthetic construct
  misc_feature 1..22: note = Synthetic Construct
  source 1..22: mol_type = other DNA
ggcctaaaggccaaggagtgaa

SEQ ID NO: 2911 - DNA, 20 bp, synthetic construct
  misc_feature 1..20: note = Synthetic Construct
  source 1..20: mol_type = other DNA
cactgcttagcgacctgtgt

SEQ ID NO: 2912 - DNA, 20 bp, synthetic construct
  misc_feature 1..20: note = Synthetic Construct
  source 1..20: mol_type = other DNA
tggtcagcgtgaagctctgt

SEQ ID NO: 2913 - DNA, 20 bp, synthetic construct
  misc_feature 1..20: note = Synthetic Construct
  source 1..20: mol_type = other DNA
aggctccacaggaggtcatt

SEQ ID NO: 2914 - DNA, 25 bp, synthetic construct
  misc_feature 1..25: note = Synthetic Construct
  source 1..25: mol_type = other DNA
tgtgaaagaaagggcagacattgta

SEQ ID NO: 2915 - DNA, 22 bp, synthetic construct
  misc_feature 1..22: note = Synthetic Construct
  source 1..22: mol_type = other DNA
ccagtgtgggatctcaggcatt

SEQ ID NO: 2916 - DNA, 25 bp, synthetic construct
  misc_feature 1..25: note = Synthetic Construct
  source 1..25: mol_type = other DNA
gaatttactctgaccaccacaccta

SEQ ID NO: 2917 - DNA, 19 bp, synthetic construct
  misc_feature 1..19: note = Synthetic Construct
  source 1..19: mol_type = other DNA
tgctgtgtgcagggactgt

SEQ ID NO: 2918 - DNA, 22 bp, synthetic construct
  misc_feature 1..22: note = Synthetic Construct
  source 1..22: mol_type = other DNA
tcaggtgacaggtggggtaaca

SEQ ID NO: 2919 - DNA, 20 bp, synthetic construct
  misc_feature 1..20: note = Synthetic Construct
  source 1..20: mol_type = other DNA
gaaaccaactgccggagact

SEQ ID NO: 2920 - DNA, 20 bp, synthetic construct
  misc_feature 1..20: note = Synthetic Construct
  source 1..20: mol_type = other DNA
aaggaagtggccgcagtatg

SEQ ID NO: 2921 - DNA, 19 bp, synthetic construct
  misc_feature 1..19: note = Synthetic Construct
  source 1..19: mol_type = other DNA
agcgctgggccatgtcatt

SEQ ID NO: 2922 - DNA, 27 bp, synthetic construct
  misc_feature 1..27: note = Synthetic Construct
  source 1..27: mol_type = other DNA
ggttagttccctttattgccccaagat

SEQ ID NO: 2923 - DNA, 23 bp, synthetic construct
  misc_feature 1..23: note = Synthetic Construct
  source 1..23: mol_type = other DNA
gtgtgcagttggtaaaggcaaag

SEQ ID NO: 2924 - DNA, 24 bp, synthetic construct
  misc_feature 1..24: note = Synthetic Construct
  source 1..24: mol_type = other DNA
gtgattttccagcacctcccacta

SEQ ID NO: 2925 - DNA, 27 bp, synthetic construct
  misc_feature 1..27: note = Synthetic Construct
  source 1..27: mol_type = other DNA
gggaaaccctgtaataactcactctgt

SEQ ID NO: 2926 - DNA, 23 bp, synthetic construct
  misc_feature 1..23: note = Synthetic Construct
  source 1..23: mol_type = other DNA
gtcagtgcttttcatggcatctt

SEQ ID NO: 2927 - DNA, 24 bp, synthetic construct
  misc_feature 1..24: note = Synthetic Construct
  source 1..24: mol_type = other DNA
aaattactccatggtgggaagtgt

SEQ ID NO: 2928 - DNA, 22 bp, synthetic construct
  misc_feature 1..22: note = Synthetic Construct
  source 1..22: mol_type = other DNA
gcctgattgaacccctacaaca

SEQ ID NO: 2929 - DNA, 19 bp, synthetic construct
  misc_feature 1..19: note = Synthetic Construct
  source 1..19: mol_type = other DNA
cggcgtccaggagacagtt

SEQ ID NO: 2930 - DNA, 23 bp, synthetic construct
  misc_feature 1..23: note = Synthetic Construct
  source 1..23: mol_type = other DNA
ccagggtctttccaagagcattc

SEQ ID NO: 2931 - DNA, 25 bp, synthetic construct
  misc_feature 1..25: note = Synthetic Construct
  source 1..25: mol_type = other DNA
gtttctcaggataagcagctcaaac

SEQ ID NO: 2932 - DNA, 20 bp, synthetic construct
  misc_feature 1..20: note = Synthetic Construct
  source 1..20: mol_type = other DNA
tgaccaggcagagggctgat

SEQ ID NO: 2933 - DNA, 21 bp, synthetic construct
  misc_feature 1..21: note = Synthetic Construct
  source 1..21: mol_type = other DNA
ttggccacccagagcagtcat

SEQ ID NO: 2934 - DNA, 21 bp, synthetic construct
  misc_feature 1..21: note = Synthetic Construct
  source 1..21: mol_type = other DNA
gcagtgatgcgatgtgagtct

SEQ ID NO: 2935 - DNA, 27 bp, synthetic construct
  misc_feature 1..27: note = Synthetic Construct
  source 1..27: mol_type = other DNA
gaaacctaaggatatcaaagggctgat

SEQ ID NO: 2936 - DNA, 22 bp, synthetic construct
  misc_feature 1..22: note = Synthetic Construct
  source 1..22: mol_type = other DNA
caggcccaataggcccatttac

SEQ ID NO: 2937 - DNA, 22 bp, synthetic construct
  misc_feature 1..22: note = Synthetic Construct
  source 1..22: mol_type = other DNA
ctgggtcagctcaagtggattg

SEQ ID NO: 2938 - DNA, 20 bp, synthetic construct
  misc_feature 1..20: note = Synthetic Construct
  source 1..20: mol_type = other DNA
tgtgccgctgtgtgacattc

SEQ ID NO: 2939 - DNA, 22 bp, synthetic construct
  misc_feature 1..22: note = Synthetic Construct
  source 1..22: mol_type = other DNA
gcccaggcatccaatccctaag

SEQ ID NO: 2940 - DNA, 23 bp, synthetic construct
  misc_feature 1..23: note = Synthetic Construct
  source 1..23: mol_type = other DNA
tgatgtgcctctcttgttccaat

SEQ ID NO: 2941 - DNA, 21 bp, synthetic construct
  misc_feature 1..21: note = Synthetic Construct
  source 1..21: mol_type = other DNA
aggaactctggggagatgcaa

SEQ ID NO: 2942 - DNA, 22 bp, synthetic construct
  misc_feature 1..22: note = Synthetic Construct
  source 1..22: mol_type = other DNA
cgttgctgcaatcaaggtgttg

SEQ ID NO: 2943 - DNA, 25 bp, synthetic construct
  misc_feature 1..25: note = Synthetic Construct
  source 1..25: mol_type = other DNA
gacacctcctctatcctgtggaatg

SEQ ID NO: 2944 - DNA, 25 bp, synthetic construct
  misc_feature 1..25: note = Synthetic Construct
  source 1..25: mol_type = other DNA
aaaggtaatgtccattcggctagat

SEQ ID NO: 2945 - DNA, 29 bp, synthetic construct
  misc_feature 1..29: note = Synthetic Construct
  source 1..29: mol_type = other DNA
cggagaaaattggttttcctatcggtgtt

SEQ ID NO: 2946 - DNA, 20 bp, synthetic construct
  misc_feature 1..20: note = Synthetic Construct
  source 1..20: mol_type = other DNA
gcactaaacgccagggtgat

SEQ ID NO: 2947 - DNA, 21 bp, synthetic construct
  misc_feature 1..21: note = Synthetic Construct
  source 1..21: mol_type = other DNA
aaaggggacctgccaccttca

SEQ ID NO: 2948 - DNA, 22 bp, synthetic construct
  misc_feature 1..22: note = Synthetic Construct
  source 1..22: mol_type = other DNA
tggtgtcagcctcgttccttct

SEQ ID NO: 2949 - DNA, 20 bp, synthetic construct
  misc_feature 1..20: note = Synthetic Construct
  source 1..20: mol_type = other DNA
caccacacaggtgcatcaca

SEQ ID NO: 2950 - DNA, 22 bp, synthetic construct
  misc_feature 1..22: note = Synthetic Construct
  source 1..22: mol_type = other DNA
cccattgccaaaagcaaactgt

SEQ ID NO: 2951 - DNA, 20 bp, synthetic construct
  misc_feature 1..20: note = Synthetic Construct
  source 1..20: mol_type = other DNA
agggccacagcagaggagat

SEQ ID NO: 2952 - DNA, 23 bp, synthetic construct
  misc_feature 1..23: note = Synthetic Construct
  source 1..23: mol_type = other DNA
ctgcgtttgtgttcaggctaaag

SEQ ID NO: 2953 - DNA, 21 bp, synthetic construct
  misc_feature 1..21: note = Synthetic Construct
  source 1..21: mol_type = other DNA
atgttcccaggccctgctctt

SEQ ID NO: 2954 - DNA, 20 bp, synthetic construct
  misc_feature 1..20: note = Synthetic Construct
  source 1..20: mol_type = other DNA
cacgcggaactagcaaccta

SEQ ID NO: 2955 - DNA, 21 bp, synthetic construct
  misc_feature 1..21: note = Synthetic Construct
  source 1..21: mol_type = other DNA
atgtgctgcctaccccacttg

SEQ ID NO: 2956 - DNA, 18 bp, synthetic construct
  misc_feature 1..18: note = Synthetic Construct
  source 1..18: mol_type = other DNA
tgggtgcaccaggagtgt

SEQ ID NO: 2957 - DNA, 25 bp, synthetic construct
  misc_feature 1..25: note = Synthetic Construct
  source 1..25: mol_type = other DNA
ctcagggactaagtgtctctgacaa

SEQ ID NO: 2958 - DNA, 28 bp, synthetic construct
  misc_feature 1..28: note = Synthetic Construct
  source 1..28: mol_type = other DNA
cctaaatacagggagtgggatgtagaag

SEQ ID NO: 2959 - DNA, 23 bp, synthetic construct
  misc_feature 1..23: note = Synthetic Construct
  source 1..23: mol_type = other DNA
gcttcctccaccccgtgattaag

SEQ ID NO: 2960 - DNA, 22 bp, synthetic construct
  misc_feature 1..22: note = Synthetic Construct
  source 1..22: mol_type = other DNA
ggagaacctccgaccacagaaa

SEQ ID NO: 2961 - DNA, 20 bp, synthetic construct
  misc_feature 1..20: note = Synthetic Construct
  source 1..20: mol_type = other DNA
agtccccagggaggcagctt

SEQ ID NO: 2962 - DNA, 18 bp, synthetic construct
  misc_feature 1..18: note = Synthetic Construct
  source 1..18: mol_type = other DNA
accccagagcctgctgtt

SEQ ID NO: 2963 - DNA, 23 bp, synthetic construct
  misc_feature 1..23: note = Synthetic Construct
  source 1..23: mol_type = other DNA
ctcgagctgaacacttgtgtgat

SEQ ID NO: 2964 - DNA, 19 bp, synthetic construct
  misc_feature 1..19: note = Synthetic Construct
  source 1..19: mol_type = other DNA
tggaagggacgcccgcaat

SEQ ID NO: 2965 - DNA, 22 bp, synthetic construct
  misc_feature 1..22: note = Synthetic Construct
  source 1..22: mol_type = other DNA
atttggcctggaggggctgagt

SEQ ID NO: 2966 - DNA, 22 bp, synthetic construct
  misc_feature 1..22: note = Synthetic Construct
  source 1..22: mol_type = other DNA
gaagtcagtggtcagagcatca

SEQ ID NO: 2967 - DNA, 22 bp, synthetic construct
  misc_feature 1..22: note = Synthetic Construct
  source 1..22: mol_type = other DNA
caccgtgtctctaagggtcagt

SEQ ID NO: 2968 - DNA, 24 bp, synthetic construct
  misc_feature 1..24: note = Synthetic Construct
  source 1..24: mol_type = other DNA
ggagccacagaattagcacagtca

SEQ ID NO: 2969 - DNA, 24 bp, synthetic construct
  misc_feature 1..24: note = Synthetic Construct
  source 1..24: mol_type = other DNA
cagatttggctggcatttcagaag

SEQ ID NO: 2970 - DNA, 24 bp, synthetic construct
  misc_feature 1..24: note = Synthetic Construct
  source 1..24: mol_type = other DNA
cctgtctgcttttgtgtcaacagt

SEQ ID NO: 2971 - DNA, 20 bp, synthetic construct
  misc_feature 1..20: note = Synthetic Construct
  source 1..20: mol_type = other DNA
agagaggtgagacggtgcaa

SEQ ID NO: 2972 - DNA, 21 bp, synthetic construct
  misc_feature 1..21: note = Synthetic Construct
  source 1..21: mol_type = other DNA
cgacaggggagcaggagagat

SEQ ID NO: 2973 - DNA, 24 bp, synthetic construct
  misc_feature 1..24: note = Synthetic Construct
  source 1..24: mol_type = other DNA
gctggatggtctaggatggcttca

SEQ ID NO: 2974 - DNA, 22 bp, synthetic construct
  misc_feature 1..22: note = Synthetic Construct
  source 1..22: mol_type = other DNA
ccaacttcagcacatgcacttc

SEQ ID NO: 2975 - DNA, 20 bp, synthetic construct
  misc_feature 1..20: note = Synthetic Construct
  source 1..20: mol_type = other DNA
gcacgcacctcttgcaaatc

SEQ ID NO: 2976 - DNA, 26 bp, synthetic construct
  misc_feature 1..26: note = Synthetic Construct
  source 1..26: mol_type = other DNA
cacaccttttctcaggtacaccttca

SEQ ID NO: 2977 - DNA, 19 bp, synthetic construct
  misc_feature 1..19: note = Synthetic Construct
  source 1..19: mol_type = other DNA
tggcgtctgcactcactca

SEQ ID NO: 2978 - DNA, 20 bp, synthetic construct
  misc_feature 1..20: note = Synthetic Construct
  source 1..20: mol_type = other DNA
gctatgaggcagtgcgtgtt

SEQ ID NO: 2979 - DNA, 20 bp, synthetic construct
  misc_feature 1..20: note = Synthetic Construct
  source 1..20: mol_type = other DNA
agatggggcagcagcattca

SEQ ID NO: 2980 - DNA, 24 bp, synthetic construct
  misc_feature 1..24: note = Synthetic Construct
  source 1..24: mol_type = other DNA
ctcatgacctttgcatttgctgat

SEQ ID NO: 2981 - DNA, 20 bp, synthetic construct
  misc_feature 1..20: note = Synthetic Construct
  source 1..20: mol_type = other DNA
tgcctcccactcttggtgtt

SEQ ID NO: 2982 - DNA, 22 bp, synthetic construct
  misc_feature 1..22: note = Synthetic Construct
  source 1..22: mol_type = other DNA
ggcttctgcacccctaagtttg

SEQ ID NO: 2983 - DNA, 20 bp, synthetic construct
  misc_feature 1..20: note = Synthetic Construct
  source 1..20: mol_type = other DNA
cttgctgtgccccttccaat

SEQ ID NO: 2984 - DNA, 22 bp, synthetic construct
  misc_feature 1..22: note = Synthetic Construct
  source 1..22: mol_type = other DNA
agtacaggccacaggggatgaa

SEQ ID NO: 2985 - DNA, 23 bp, synthetic construct
  misc_feature 1..23: note = Synthetic Construct
  source 1..23: mol_type = other DNA
aaaagccacaaagatgggtcaag

SEQ ID NO: 2986 - DNA, 22 bp, synthetic construct
  misc_feature 1..22: note = Synthetic Construct
  source 1..22: mol_type = other DNA
gcagccctgaattggaagttct

SEQ ID NO: 2987 - DNA, 21 bp, synthetic construct
  misc_feature 1..21: note = Synthetic Construct
  source 1..21: mol_type = other DNA
cccattcccacagagcaggaa

SEQ ID NO: 2988 - DNA, 22 bp, synthetic construct
  misc_feature 1..22: note = Synthetic Construct
  source 1..22: mol_type = other DNA
cccacaggagcaggtgttttag

SEQ ID NO: 2989 - DNA, 24 bp, synthetic construct
  misc_feature 1..24: note = Synthetic Construct
  source 1..24: mol_type = other DNA
cagtaaatggtgaggccacagttg

SEQ ID NO: 2990 - DNA, 20 bp, synthetic construct
  misc_feature 1..20: note = Synthetic Construct
  source 1..20: mol_type = other DNA
accaaccagtggacccagat

SEQ ID NO: 2991 - DNA, 30 bp, synthetic construct
  misc_feature 1..30: note = Synthetic Construct
  source 1..30: mol_type = other DNA
ctccagttcactaaggaacatgaaatgctt

SEQ ID NO: 2992 - DNA, 23 bp, synthetic construct
  misc_feature 1..23: note = Synthetic Construct
  source 1..23: mol_type = other DNA
ggtccttccatgtccctcagtct

SEQ ID NO: 2993 - DNA, 20 bp, synthetic construct
  misc_feature 1..20: note = Synthetic Construct
  source 1..20: mol_type = other DNA
tcctgtggctgaaggacaga

SEQ ID NO: 2994 - DNA, 20 bp, synthetic construct
  misc_feature 1..20: note = Synthetic Construct
  source 1..20: mol_type = other DNA
aactgagcgaggggctttgt

SEQ ID NO: 2995 - DNA, 19 bp, synthetic construct
  misc_feature 1..19: note = Synthetic Construct
  source 1..19: mol_type = other DNA
ggagccacaggggatggaa

SEQ ID NO: 2996 - DNA, 20 bp, synthetic construct
  misc_feature 1..20: note = Synthetic Construct
  source 1..20: mol_type = other DNA
tccagcaggctgaggcattg

SEQ ID NO: 2997 - DNA, 20 bp, synthetic construct
  misc_feature 1..20: note = Synthetic Construct
  source 1..20: mol_type = other DNA
tcctggtccgggagaacgat

SEQ ID NO: 2998 - DNA, 20 bp, synthetic construct
  misc_feature 1..20: note = Synthetic Construct
  source 1..20: mol_type = other DNA
agggaagcctgcatgtctct

SEQ ID NO: 2999 - DNA, 22 bp, synthetic construct
  misc_feature 1..22: note = Synthetic Construct
  source 1..22: mol_type = other DNA
gtctggaacccgcacaacttac

SEQ ID NO: 3000 - DNA, 23 bp, synthetic construct
  misc_feature 1..23: note = Synthetic Construct
  source 1..23: mol_type = other DNA
tgggtttttccaccatagcaaga

SEQ ID NO: 3001 - DNA, 19 bp, synthetic construct
  misc_feature 1..19: note = Synthetic Construct
  source 1..19: mol_type = other DNA
ggaccgcacggtgtcttct

SEQ ID NO: 3002 - DNA, 20 bp, synthetic construct
  misc_feature 1..20: note = Synthetic Construct
  source 1..20: mol_type = other DNA
ggtgggtcccttgtgagcat

SEQ ID NO: 3003 - DNA, 24 bp, synthetic construct
  misc_feature 1..24: note = Synthetic Construct
  source 1..24: mol_type = other DNA
cacctcgttcatatccaggtgagt

SEQ ID NO: 3004 - DNA, 20 bp, synthetic construct
  misc_feature 1..20: note = Synthetic Construct
  source 1..20: mol_type = other DNA
tggaactgcaccagcacaga

SEQ ID NO: 3005 - DNA, 19 bp, synthetic construct
  misc_feature 1..19: note = Synthetic Construct
  source 1..19: mol_type = other DNA
gtaccctccagcccaggaa

SEQ ID NO: 3006 - DNA, 20 bp, synthetic construct
  misc_feature 1..20: note = Synthetic Construct
  source 1..20: mol_type = other DNA
aggaggggctcagcatggat

SEQ ID NO: 3007 - DNA, 19 bp, synthetic construct
  misc_feature 1..19: note = Synthetic Construct
  source 1..19: mol_type = other DNA
tggacgtgcagacctcaca

SEQ ID NO: 3008 - DNA, 24 bp, synthetic construct
  misc_feature 1..24: note = Synthetic Construct
  source 1..24: mol_type = other DNA
tcaaggaaatgcagtggtatgtgt

SEQ ID NO: 3009 - DNA, 25 bp, synthetic construct
  misc_feature 1..25: note = Synthetic Construct
  source 1..25: mol_type = other DNA
gggcagtgggtaagaagaacccatt

SEQ ID NO: 3010 - DNA, 20 bp, synthetic construct
  misc_feature 1..20: note = Synthetic Construct
  source 1..20: mol_type = other DNA
taggccacggagccacttta

SEQ ID NO: 3011 - DNA, 24 bp, synthetic construct
  misc_feature 1..24: note = Synthetic Construct
  source 1..24: mol_type = other DNA
cgcttctgtttaatgccttagcaa

SEQ ID NO: 3012 - DNA, 25 bp, synthetic construct
  misc_feature 1..25: note = Synthetic Construct
  source 1..25: mol_type = other DNA
gggcgagtttcagaacaagggaaag

SEQ ID NO: 3013 - DNA, 24 bp, synthetic construct
  misc_feature 1..24: note = Synthetic Construct
  source 1..24: mol_type = other DNA
ctgtatctgtgggcttttccttca

SEQ ID NO: 3014 - DNA, 23 bp, synthetic construct
  misc_feature 1..23: note = Synthetic Construct
  source 1..23: mol_type = other DNA
tctatcccatggaagggcaaaag

SEQ ID NO: 3015 - DNA, 25 bp, synthetic construct
  misc_feature 1..25: note = Synthetic Construct
  source 1..25: mol_type = other DNA
tcaaaacagagtctcactgtcactt

SEQ ID NO: 3016 - DNA, 20 bp, synthetic construct
  misc_feature 1..20: note = Synthetic Construct
  source 1..20: mol_type = other DNA
ggccctctctgggcactttg

SEQ ID NO: 3017 - DNA, 21 bp, synthetic construct
  misc_feature 1..21: note = Synthetic Construct
  source 1..21: mol_type = other DNA
cctcatattgctccgccacaa

SEQ ID NO: 3018 - DNA, 20 bp, synthetic construct
  misc_feature 1..20: note = Synthetic Construct
  source 1..20: mol_type = other DNA
ccttgttctccggcgatgtt

SEQ ID NO: 3019 - DNA, 27 bp, synthetic construct
  misc_feature 1..27: note = Synthetic Construct
  source 1..27: mol_type = other DNA
ctgatgtgtaccccgaaatcattgaac

SEQ ID NO: 3020 - DNA, 25 bp, synthetic construct
  misc_feature 1..25: note = Synthetic Construct
  source 1..25: mol_type = other DNA
ggctcctccatttccttccacctaa

SEQ ID NO: 3021 - DNA, 26 bp, synthetic construct
  misc_feature 1..26: note = Synthetic Construct
  source 1..26: mol_type = other DNA
cacatcagaaacgtttgggctgatac

SEQ ID NO: 3022 - DNA, 21 bp, synthetic construct
  misc_feature 1..21: note = Synthetic Construct
  source 1..21: mol_type = other DNA
tcgggccagcccagatttact

SEQ ID NO: 3023 - DNA, 25 bp, synthetic construct
  misc_feature 1..25: note = Synthetic Construct
  source 1..25: mol_type = other DNA
caagaatttccctgtctggaaccaa

SEQ ID NO: 3024 - DNA, 22 bp, synthetic construct
  misc_feature 1..22: note = Synthetic Construct
  source 1..22: mol_type = other DNA
ggccagcccagagtagtaacaa

SEQ ID NO: 3025 - DNA, 22 bp, synthetic construct
  misc_feature 1..22: note = Synthetic Construct
  source 1..22: mol_type = other DNA
gacagagggctaaggtcagcaa

SEQ ID NO: 3026 - DNA, 21 bp, synthetic construct
  misc_feature 1..21: note = Synthetic Construct
  source 1..21: mol_type = other DNA
cagccatcaccacagaagtca

SEQ ID NO: 3027 - DNA, 20 bp, synthetic construct
  misc_feature 1..20: note = Synthetic Construct
  source 1..20: mol_type = other DNA
tgccaggtgctggagaaaga

SEQ ID NO: 3028 - DNA, 25 bp, synthetic construct
  misc_feature 1..25: note = Synthetic Construct
  source 1..25: mol_type = other DNA
agcatacccttagctctacttcaca

SEQ ID NO: 3029 - DNA, 24 bp, synthetic construct
  misc_feature 1..24: note = Synthetic Construct
  source 1..24: mol_type = other DNA
cctttgttgttgctcttccagttc

SEQ ID NO: 3030 - DNA, 20 bp, synthetic construct
  misc_feature 1..20: note = Synthetic Construct
  source 1..20: mol_type = other DNA
cagtttccccagccttgctt

SEQ ID NO: 3031 - DNA, 20 bp, synthetic construct
  misc_feature 1..20: note = Synthetic Construct
  source 1..20: mol_type = other DNA
ttcactgaggggcagggaat

SEQ ID NO: 3032 - DNA, 28 bp, synthetic construct
  misc_feature 1..28: note = Synthetic Construct
  source 1..28: mol_type = other DNA
ggccaacttggtgtaaaaatcccttgaa

SEQ ID NO: 3033 - DNA, 24 bp, synthetic construct
  misc_feature 1..24: note = Synthetic Construct
  source 1..24: mol_type = other DNA
gagttaccagtgaggtgtggaaac

SEQ ID NO: 3034 - DNA, 20 bp, synthetic construct
  misc_feature 1..20: note = Synthetic Construct
  source 1..20: mol_type = other DNA
cgcctccacggcttgattga

SEQ ID NO: 3035 - DNA, 29 bp, synthetic construct
  misc_feature 1..29: note = Synthetic Construct
  source 1..29: mol_type = other DNA
ggcaccaacactaaaaatcaacccgaaga

SEQ ID NO: 3036 - DNA, 22 bp, synthetic construct
  misc_feature 1..22: note = Synthetic Construct
  source 1..22: mol_type = other DNA
tgctttcttgggcatgggaata

SEQ ID NO: 3037 - DNA, 22 bp, synthetic construct
  misc_feature 1..22: note = Synthetic Construct
  source 1..22: mol_type = other DNA
aagcctgagggcaggagacttg

SEQ ID NO: 3038 - DNA, 24 bp, synthetic construct
  misc_feature 1..24: note = Synthetic Construct
  source 1..24: mol_type = other DNA
gcagaatagccagcagttttgaag

SEQ ID NO: 3039 - DNA, 23 bp, synthetic construct
  misc_feature 1..23: note = Synthetic Construct
  source 1..23: mol_type = other DNA
gcagctacttgcaaggtctgagt

SEQ ID NO: 3040 - DNA, 24 bp, synthetic construct
  misc_feature 1..24: note = Synthetic Construct
  source 1..24: mol_type = other DNA
cctccattctggatgccacttttg

SEQ ID NO: 3041 - DNA, 23 bp, synthetic construct
  misc_feature 1..23: note = Synthetic Construct
  source 1..23: mol_type = other DNA
gcacttcaccaagctctgtctca

SEQ ID NO: 3042 - DNA, 24 bp, synthetic construct
  misc_feature 1..24: note = Synthetic Construct
  source 1..24: mol_type = other DNA
ggcgtggaaggatgtctaacaagt

SEQ ID NO: 3043 - DNA, 20 bp, synthetic construct
  misc_feature 1..20: note = Synthetic Construct
  source 1..20: mol_type = other DNA
ccaaatgggcaggtgggaaa

SEQ ID NO: 3044 - DNA, 20 bp, synthetic construct
  misc_feature 1..20: note = Synthetic Construct
  source 1..20: mol_type = other DNA
actcctgggctcaagcaatc

SEQ ID NO: 3045 - DNA, 21 bp, synthetic construct
  misc_feature 1..21: note = Synthetic Construct
  source 1..21: mol_type = other DNA
ctgcattgtcagtccctctgt

SEQ ID NO: 3046 - DNA, 24 bp, synthetic construct
  misc_feature 1..24: note = Synthetic Construct
  source 1..24: mol_type = other DNA
gcagaagttatagcagggatgaca

SEQ ID NO: 3047 - DNA, 23 bp, synthetic construct
  misc_feature 1..23: note = Synthetic Construct
  source 1..23: mol_type = other DNA
ccagcaacctttttggagtgttt

SEQ ID NO: 3048 - DNA, 23 bp, synthetic construct
  misc_feature 1..23: note = Synthetic Construct
  source 1..23: mol_type = other DNA
aacagcttgatgtcttccctgaa

SEQ ID NO: 3049 - DNA, 25 bp, synthetic construct
  misc_feature 1..25: note = Synthetic Construct
  source 1..25: mol_type = other DNA
ggacagaacaatatcctggtgagaa

SEQ ID NO: 3050 - DNA, 24 bp, synthetic construct
  misc_feature 1..24: note = Synthetic Construct
  source 1..24: mol_type = other DNA
ccaccagagcaggtcttctacaac

SEQ ID NO: 3051 - DNA, 25 bp, synthetic construct
  misc_feature 1..25: note = Synthetic Construct
  source 1..25: mol_type = other DNA
ccaaatgtgaggatcaacccaggaa

SEQ ID NO: 3052 - DNA, 24 bp, synthetic construct
  misc_feature 1..24: note = Synthetic Construct
  source 1..24: mol_type = other DNA
ggagctaaggccagaaggtagttc

SEQ ID NO: 3053 - DNA, 20 bp, synthetic construct
  misc_feature 1..20: note = Synthetic Construct
  source 1..20: mol_type = other DNA
acagagtgggctggcacata

SEQ ID NO: 3054 - DNA, 20 bp, synthetic construct
  misc_feature 1..20: note = Synthetic Construct
  source 1..20: mol_type = other DNA
gtgtgttcagggcgacaaca

SEQ ID NO: 3055 - DNA, 20 bp, synthetic construct
  misc_feature 1..20: note = Synthetic Construct
  source 1..20: mol_type = other DNA
gccgcccctctcttttctca

SEQ ID NO: 3056 - DNA, 20 bp, synthetic construct
  misc_feature 1..20: note = Synthetic Construct
  source 1..20: mol_type = other DNA
gaatggggctgcactgcata

SEQ ID NO: 3057 - DNA, 24 bp, synthetic construct
  misc_feature 1..24: note = Synthetic Construct
  source 1..24: mol_type = other DNA
ttcaccacactagtaaggcaaagt

SEQ ID NO: 3058 - DNA, 27 bp, synthetic construct
  misc_feature 1..27: note = Synthetic Construct
  source 1..27: mol_type = other DNA
gtgagaatccattggaaatctgagcat

SEQ ID NO: 3059 - DNA, 26 bp, synthetic construct
  misc_feature 1..26: note = Synthetic Construct
  source 1..26: mol_type = other DNA
gggccctgaataaccaatagcgatac

SEQ ID NO: 3060 - DNA, 21 bp, synthetic construct
  misc_feature 1..21: note = Synthetic Construct
  source 1..21: mol_type = other DNA
gccaggagaggaaggccattt

SEQ ID NO: 3061 - DNA, 20 bp, synthetic construct
  misc_feature 1..20: note = Synthetic Construct
  source 1..20: mol_type = other DNA
caaagctgcccttggtctgt

SEQ ID NO: 3062 - DNA, 27 bp, synthetic construct
  misc_feature 1..27: note = Synthetic Construct
  source 1..27: mol_type = other DNA
ggccttaaagaggacatcgagagaaag

SEQ ID NO: 3063 - DNA, 21 bp, synthetic construct
  misc_feature 1..21: note = Synthetic Construct
  source 1..21: mol_type = other DNA
tatggctccaccctgcctaac

SEQ ID NO: 3064 - DNA, 22 bp, synthetic construct
  misc_feature 1..22: note = Synthetic Construct
  source 1..22: mol_type = other DNA
gggtggtgaggtttggtggaaa

SEQ ID NO: 3065 - DNA, 24 bp, synthetic construct
  misc_feature 1..24: note = Synthetic Construct
  source 1..24: mol_type = other DNA
ggagacaaacagaccaagcgaaca

SEQ ID NO: 3066 - DNA, 22 bp, synthetic construct
  misc_feature 1..22: note = Synthetic Construct
  source 1..22: mol_type = other DNA
gctctctcactgggatggacta

SEQ ID NO: 3067 - DNA, 27 bp, synthetic construct
  misc_feature 1..27: note = Synthetic Construct
  source 1..27: mol_type = other DNA
acaacctaggaagaattagggcttttc

SEQ ID NO: 3068 - DNA, 21 bp, synthetic construct
  misc_feature 1..21: note = Synthetic Construct
  source 1..21: mol_type = other DNA
cctaccccaggacagaagcat

SEQ ID NO: 3069 - DNA, 25 bp, synthetic construct
  misc_feature 1..25: note = Synthetic Construct
  source 1..25: mol_type = other DNA
gtcaaggataggcaagagacgaagt

SEQ ID NO: 3070 - DNA, 21 bp, synthetic construct
  misc_feature 1..21: note = Synthetic Construct
  source 1..21: mol_type = other DNA
ctgaagcaagctgggtgaagt

SEQ ID NO: 3071 - DNA, 24 bp, synthetic construct
  misc_feature 1..24: note = Synthetic Construct
  source 1..24: mol_type = other DNA
ggtccccaaattctctgccagttg

SEQ ID NO: 3072 - DNA, 23 bp, synthetic construct
  misc_feature 1..23: note = Synthetic Construct
  source 1..23: mol_type = other DNA
ccggaaagaatcggcctccttag

SEQ ID NO: 3073 - DNA, 25 bp, synthetic construct
  misc_feature 1..25: note = Synthetic Construct
  source 1..25: mol_type = other DNA
gaaaaagagctgaacaaacggaaac

SEQ ID NO: 3074 - DNA, 20 bp, synthetic construct
  misc_feature 1..20: note = Synthetic Construct
  source 1..20: mol_type = other DNA
tgctgctccagccataggtt

SEQ ID NO: 3075 - DNA, 20 bp, synthetic construct
  misc_feature 1..20: note = Synthetic Construct
  source 1..20: mol_type = other DNA
aacaccctgggaggcatagt

SEQ ID NO: 3076 - DNA, 22 bp, synthetic construct
  misc_feature 1..22: note = Synthetic Construct
  source 1..22: mol_type = other DNA
ggccctccaaactcatggaagt

SEQ ID NO: 3077 - DNA, 24 bp, synthetic construct
  misc_feature 1..24: note = Synthetic Construct
  source 1..24: mol_type = other DNA
gctctcacaaaggaggttcaaaga

SEQ ID NO: 3078 - DNA, 25 bp, synthetic construct
  misc_feature 1..25: note = Synthetic Construct
  source 1..25: mol_type = other DNA
catgcctatctcccttagtcctact

SEQ ID NO: 3079 - DNA, 21 bp, synthetic construct
  misc_feature 1..21: note = Synthetic Construct
  source 1..21: mol_type = other DNA
agtcagctcaggggtgacctt

SEQ ID NO: 3080 - DNA, 21 bp, synthetic construct
  misc_feature 1..21: note = Synthetic Construct
  source 1..21: mol_type = other DNA
ccacagcactgactgccatct

SEQ ID NO: 3081 - DNA, 24 bp, synthetic construct
  misc_feature 1..24: note = Synthetic Construct
  source 1..24: mol_type = other DNA
acatgctgaaagccaaaacctcta

SEQ ID NO: 3082 - DNA, 24 bp, synthetic construct
  misc_feature 1..24: note = Synthetic Construct
  source 1..24: mol_type = other DNA
cagaatagcacagagtgtcacaga

SEQ ID NO: 3083 - DNA, 22 bp, synthetic construct
  misc_feature 1..22: note = Synthetic Construct
  source 1..22: mol_type = other DNA
ccacatcctgccataggagcta

SEQ ID NO: 3084 - DNA, 20 bp, synthetic construct
  misc_feature 1..20: note = Synthetic Construct
  source 1..20: mol_type = other DNA
tagggcaaagagcgcctagt

SEQ ID NO: 3085 - DNA, 27 bp, synthetic construct
  misc_feature 1..27: note = Synthetic Construct
  source 1..27: mol_type = other DNA
ggaattctgtaagctaagaagccaagt

SEQ ID NO: 3086 - DNA, 20 bp, synthetic construct
  misc_feature 1..20: note = Synthetic Construct
  source 1..20: mol_type = other DNA
gctcccaaccccagaacact

SEQ ID NO: 3087 - DNA, 22 bp, synthetic construct
  misc_feature 1..22: note = Synthetic Construct
  source 1..22: mol_type = other DNA
ggcattccagcagtgaccatag

SEQ ID NO: 3088 - DNA, 23 bp, synthetic construct
  misc_feature 1..23: note = Synthetic Construct
  source 1..23: mol_type = other DNA
ccatgggcacaatccaagcctat

SEQ ID NO: 3089 - DNA, 19 bp, synthetic construct
  misc_feature 1..19: note = Synthetic Construct
  source 1..19: mol_type = other DNA
ggggccctttctggaggta

SEQ ID NO: 3090 - DNA, 19 bp, synthetic construct
  misc_feature 1..19: note = Synthetic Construct
  source 1..19: mol_type = other DNA
aacggcaggtgagcagtct

SEQ ID NO: 3091 - DNA, 25 bp, synthetic construct
  misc_feature 1..25: note = Synthetic Construct
  source 1..25: mol_type = other DNA
gtggttgctttcaccctacttcttc

SEQ ID NO: 3092 - DNA, 21 bp, synthetic construct
  misc_feature 1..21: note = Synthetic Construct
  source 1..21: mol_type = other DNA
gactcctggcttggaacagaa

SEQ ID NO: 3093 - DNA, 27 bp, synthetic construct
  misc_feature 1..27: note = Synthetic Construct
  source 1..27: mol_type = other DNA
gcaaagatgacataagcaaaggcttga

SEQ ID NO: 3094 - DNA, 25 bp, synthetic construct
  misc_feature 1..25: note = Synthetic Construct
  source 1..25: mol_type = other DNA
ggagtatcactttagcactggagtt

SEQ ID NO: 3095 - DNA, 20 bp, synthetic construct
  misc_feature 1..20: note = Synthetic Construct
  source 1..20: mol_type = other DNA
aggatcggtcaggccagtgt

SEQ ID NO: 3096 - DNA, 18 bp, synthetic construct
  misc_feature 1..18: note = Synthetic Construct
  source 1..18: mol_type = other DNA
tccaagccaccgccatca

SEQ ID NO: 3097 - DNA, 26 bp, synthetic construct
  misc_feature 1..26: note = Synthetic Construct
  source 1..26: mol_type = other DNA
cctccactctaccaaagcttataaca

SEQ ID NO: 3098 - DNA, 21 bp, synthetic construct
  misc_feature 1..21: note = Synthetic Construct
  source 1..21: mol_type = other DNA
tacgctgaccaccctgacact

SEQ ID NO: 3099 - DNA, 23 bp, synthetic construct
  misc_feature 1..23: note = Synthetic Construct
  source 1..23: mol_type = other DNA
gtgggtactactctgtgcaggaa

SEQ ID NO: 3100 - DNA, 25 bp, synthetic construct
  misc_feature 1..25: note = Synthetic Construct
  source 1..25: mol_type = other DNA
tgaggcatttgagtcaaggtgatac

SEQ ID NO: 3101 - DNA, 20 bp, synthetic construct
  misc_feature 1..20: note = Synthetic Construct
  source 1..20: mol_type = other DNA
tgcctgggttaaggcgcata

SEQ ID NO: 3102 - DNA, 29 bp, synthetic construct
  misc_feature 1..29: note = Synthetic Construct
  source 1..29: mol_type = other DNA
gggaaccttactgatcactagtacaaaac

SEQ ID NO: 3103 - DNA, 22 bp, synthetic construct
  misc_feature 1..22: note = Synthetic Construct
  source 1..22: mol_type = other DNA
ctcctgacacatgcccagtaaa

SEQ ID NO: 3104 - DNA, 19 bp, synthetic construct
  misc_feature 1..19: note = Synthetic Construct
  source 1..19: mol_type = other DNA
agtgtggggccacctggaa

SEQ ID NO: 3105 - DNA, 21 bp, synthetic construct
  misc_feature 1..21: note = Synthetic Construct
  source 1..21: mol_type = other DNA
atgtccggtcggaggtacagt

SEQ ID NO: 3106 - DNA, 23 bp, synthetic construct
  misc_feature 1..23: note = Synthetic Construct
  source 1..23: mol_type = other DNA
aatactgccctccccggactaca

SEQ ID NO: 3107 - DNA, 22 bp, synthetic construct
  misc_feature 1..22: note = Synthetic Construct
  source 1..22: mol_type = other DNA
cactgcagcaaaggctttcaac

SEQ ID NO: 3108 - DNA, 23 bp, synthetic construct
  misc_feature 1..23: note = Synthetic Construct
  source 1..23: mol_type = other DNA
ctcagctctgtgcctggataatg

SEQ ID NO: 3109 - DNA, 25 bp, synthetic construct
  misc_feature 1..25: note = Synthetic Construct
  source 1..25: mol_type = other DNA
ctgatgaattgctggggtggttaag

SEQ ID NO: 3110 - DNA, 26 bp, synthetic construct
  misc_feature 1..26: note = Synthetic Construct
  source 1..26: mol_type = other DNA
ggtttaggtcctccatagtgagcata

SEQ ID NO: 3111 - DNA, 25 bp, synthetic construct
  misc_feature 1..25: note = Synthetic Construct
  source 1..25: mol_type = other DNA
cgggttctttcttgacaggggatct

SEQ ID NO: 3112 - DNA, 20 bp, synthetic construct
  misc_feature 1..20: note = Synthetic Construct
  source 1..20: mol_type = other DNA
aggcttcccctggtgactgt

SEQ ID NO: 3113 - DNA, 20 bp, synthetic construct
  misc_feature 1..20: note = Synthetic Construct
  source 1..20: mol_type = other DNA
agagctggcaggctcaagta

SEQ ID NO: 3114 - DNA, 20 bp, synthetic construct
  misc_feature 1..20: note = Synthetic Construct
  source 1..20: mol_type = other DNA
ctggggcctgcagtttgatt

SEQ ID NO: 3115 - DNA, 22 bp, synthetic construct
  misc_feature 1..22: note = Synthetic Construct
  source 1..22: mol_type = other DNA
gcagcctgaatcttggcagaca

SEQ ID NO: 3116 - DNA, 30 bp, synthetic construct
  misc_feature 1..30: note = Synthetic Construct
  source 1..30: mol_type = other DNA
gagctgtccactaaccattaattaggtcat

SEQ ID NO: 3117 - DNA, 21 bp, synthetic construct
  misc_feature 1..21: note = Synthetic Construct
  source 1..21: mol_type = other DNA
tctcaccttagcctcccaagt

SEQ ID NO: 3118 - DNA, 21 bp, synthetic construct
  misc_feature 1..21: note = Synthetic Construct
  source 1..21: mol_type = other DNA
tggctgccctccttccatgat

SEQ ID NO: 3119 - DNA, 25 bp, synthetic construct
  misc_feature 1..25: note = Synthetic Construct
  source 1..25: mol_type = other DNA
cccaggagtgtatcttggtcctaca

SEQ ID NO: 3120 - DNA, 23 bp, synthetic construct
  misc_feature 1..23: note = Synthetic Construct
  source 1..23: mol_type = other DNA
gcggattttgaagccagagatga

SEQ ID NO: 3121 - DNA, 23 bp, synthetic construct
  misc_feature 1..23: note = Synthetic Construct
  source 1..23: mol_type = other DNA
ccatatgagctctccctgtgcta

SEQ ID NO: 3122 - DNA, 20 bp, synthetic construct
  misc_feature 1..20: note = Synthetic Construct
  source 1..20: mol_type = other DNA
gcgtggtgcagatggtgttt

SEQ ID NO: 3123 - DNA, 20 bp, synthetic construct
  misc_feature 1..20: note = Synthetic Construct
  source 1..20: mol_type = other DNA
tggtctcctggaagctcctt

SEQ ID NO: 3124 - DNA, 24 bp, synthetic construct
  misc_feature 1..24: note = Synthetic Construct
  source 1..24: mol_type = other DNA
tgtaaaacagggaagatgcactca

SEQ ID NO: 3125 - DNA, 25 bp, synthetic construct
  misc_feature 1..25: note = Synthetic Construct
  source 1..25: mol_type = other DNA
cctcctgtgaggatcaaagttcaag

SEQ ID NO: 3126 - DNA, 20 bp, synthetic construct
  misc_feature 1..20: note = Synthetic Construct
  source 1..20: mol_type = other DNA
ggaaaatccgccaccagcat

SEQ ID NO: 3127 - DNA, 22 bp, synthetic construct
  misc_feature 1..22: note = Synthetic Construct
  source 1..22: mol_type = other DNA
agcagtcagtcagttccagcta

SEQ ID NO: 3128 - DNA, 23 bp, synthetic construct
  misc_feature 1..23: note = Synthetic Construct
  source 1..23: mol_type = other DNA
cctcaatgattaccggggctttc

SEQ ID NO: 3129 - DNA, 20 bp, synthetic construct
  misc_feature 1..20: note = Synthetic Construct
  source 1..20: mol_type = other DNA
ggctctcttggccacaggtt

SEQ ID NO: 3130 - DNA, 23 bp, synthetic construct
  misc_feature 1..23: note = Synthetic Construct
  source 1..23: mol_type = other DNA
cacgcccagaatcaaagccaaag

SEQ ID NO: 3131 - DNA, 24 bp, synthetic construct
  misc_feature 1..24: note = Synthetic Construct
  source 1..24: mol_type = other DNA
cctcttagctgtccctcttgtttc

SEQ ID NO: 3132 - DNA, 20 bp, synthetic construct
  misc_feature 1..20: note = Synthetic Construct
  source 1..20: mol_type = other DNA
acacaccccacagcttcttc

SEQ ID NO: 3133 - DNA, 21 bp, synthetic construct
  misc_feature 1..21: note = Synthetic Construct
  source 1..21: mol_type = other DNA
ggctggagggcaaatctgtgt

SEQ ID NO: 3134 - DNA, 24 bp, synthetic construct
  misc_feature 1..24: note = Synthetic Construct
  source 1..24: mol_type = other DNA
gccatcacagaggggttacaggtt

SEQ ID NO: 3135 - DNA, 27 bp, synthetic construct
  misc_feature 1..27: note = Synthetic Construct
  source 1..27: mol_type = other DNA
tcactaagtataaggcctagcctacaa

SEQ ID NO: 3136 - DNA, 25 bp, synthetic construct
  misc_feature 1..25: note = Synthetic Construct
  source 1..25: mol_type = other DNA
gggtccaatgtgaaaagcacagagt

SEQ ID NO: 3137 - DNA, 22 bp, synthetic construct
  misc_feature 1..22: note = Synthetic Construct
  source 1..22: mol_type = other DNA
caaggccataaggccaatgagt

SEQ ID NO: 3138 - DNA, 21 bp, synthetic construct
  misc_feature 1..21: note = Synthetic Construct
  source 1..21: mol_type = other DNA
cctgaggtgaggggtgctagt

SEQ ID NO: 3139 - DNA, 25 bp, synthetic construct
  misc_feature 1..25: note = Synthetic Construct
  source 1..25: mol_type = other DNA
ggcatgctcttcagggagaagttag

SEQ ID NO: 3140 - DNA, 22 bp, synthetic construct
  misc_feature 1..22: note = Synthetic Construct
  source 1..22: mol_type = other DNA
tgtccccagcaccagtaagttc

SEQ ID NO: 3141 - DNA, 24 bp, synthetic construct
  misc_feature 1..24: note = Synthetic Construct
  source 1..24: mol_type = other DNA
gcgggaattggacacagactggta

SEQ ID NO: 3142 - DNA, 27 bp, synthetic construct
  misc_feature 1..27: note = Synthetic Construct
  source 1..27: mol_type = other DNA
ggcttcttcaactccaagtccaggata

SEQ ID NO: 3143 - DNA, 22 bp, synthetic construct
  misc_feature 1..22: note = Synthetic Construct
  source 1..22: mol_type = other DNA
gggctccattgtgttcctcaac

SEQ ID NO: 3144 - DNA, 23 bp, synthetic construct
  misc_feature 1..23: note = Synthetic Construct
  source 1..23: mol_type = other DNA
ggttctgagggagcaaacctctt

SEQ ID NO: 3145 - DNA, 25 bp, synthetic construct
  misc_feature 1..25: note = Synthetic Construct
  source 1..25: mol_type = other DNA
accctcttaattgctttggggtttt

SEQ ID NO: 3146 - DNA, 24 bp, synthetic construct
  misc_feature 1..24: note = Synthetic Construct
  source 1..24: mol_type = other DNA
cgtggagaggtattttggcagtgt

SEQ ID NO: 3147 - DNA, 27 bp, synthetic construct
  misc_feature 1..27: note = Synthetic Construct
  source 1..27: mol_type = other DNA
ggctgatttctgctgtccttcaagcta

SEQ ID NO: 3148 - DNA, 23 bp, synthetic construct
  misc_feature 1..23: note = Synthetic Construct
  source 1..23: mol_type = other DNA
cagttgcctgcatcttgatctgt

SEQ ID NO: 3149 - DNA, 24 bp, synthetic construct
  misc_feature 1..24: note = Synthetic Construct
  source 1..24: mol_type = other DNA
gcactggtggaagagacagcaaag

SEQ ID NO: 3150 - DNA, 20 bp, synthetic construct
  misc_feature 1..20: note = Synthetic Construct
  source 1..20: mol_type = other DNA
acccatgacagccgactctt

SEQ ID NO: 3151 - DNA, 24 bp, synthetic construct
  misc_feature 1..24: note = Synthetic Construct
  source 1..24: mol_type = other DNA
ccttagaaggcctctcttctctgt

SEQ ID NO: 3152 - DNA, 23 bp, synthetic construct
  misc_feature 1..23: note = Synthetic Construct
  source 1..23: mol_type = other DNA
cggtctgaacggaaactgccata

SEQ ID NO: 3153 - DNA, 21 bp, synthetic construct
  misc_feature 1..21: note = Synthetic Construct
  source 1..21: mol_type = other DNA
accctggtctgccttgccttt

SEQ ID NO: 3154 - DNA, 22 bp, synthetic construct
  misc_feature 1..22: note = Synthetic Construct
  source 1..22: mol_type = other DNA
gctcaatcgaggcaggactaac

SEQ ID NO: 3155 - DNA, 22 bp, synthetic construct
  misc_feature 1..22: note = Synthetic Construct
  source 1..22: mol_type = other DNA
ggagttggcccagaacttccat

SEQ ID NO: 3156 - DNA, 23 bp, synthetic construct
  misc_feature 1..23: note = Synthetic Construct
  source 1..23: mol_type = other DNA
ctaagggcttggagaagagcaaa

SEQ ID NO: 3157 - DNA, 21 bp, synthetic construct
  misc_feature 1..21: note = Synthetic Construct
  source 1..21: mol_type = other DNA
agccaaccaggacccagaagt

SEQ ID NO: 3158 - DNA, 23 bp, synthetic construct
  misc_feature 1..23: note = Synthetic Construct
  source 1..23: mol_type = other DNA
agacacatttgcatgcctaccat

SEQ ID NO: 3159 - DNA, 30 bp, synthetic construct
  misc_feature 1..30: note = Synthetic Construct
  source 1..30: mol_type = other DNA
cactccattaaagccatttgggaatagaag

SEQ ID NO: 3160 - DNA, 24 bp, synthetic construct
  misc_feature 1..24: note = Synthetic Construct
  source 1..24: mol_type = other DNA
gcagccaaaagggcttgttaaatg

SEQ ID NO: 3161 - DNA, 22 bp, synthetic construct
  misc_feature 1..22: note = Synthetic Construct
  source 1..22: mol_type = other DNA
tgggtaccagttaagccacagt

SEQ ID NO: 3162 - DNA, 24 bp, synthetic construct
  misc_feature 1..24: note = Synthetic Construct
  source 1..24: mol_type = other DNA
agagggacttatgtgcagtgaatg

SEQ ID NO: 3163 - DNA, 23 bp, synthetic construct
  misc_feature 1..23: note = Synthetic Construct
  source 1..23: mol_type = other DNA
gctggttttctcacaagcctaga

SEQ ID NO: 3164 - DNA, 21 bp, synthetic construct
  misc_feature 1..21: note = Synthetic Construct
  source 1..21: mol_type = other DNA
agactgcctgctgtttcatca

SEQ ID NO: 3165 - DNA, 21 bp, synthetic construct
  misc_feature 1..21: note = Synthetic Construct
  source 1..21: mol_type = other DNA
gcaggggctgtaaagggtgta

SEQ ID NO: 3166 - DNA, 23 bp, synthetic construct
  misc_feature 1..23: note = Synthetic Construct
  source 1..23: mol_type = other DNA
ctgggtcttctatggccttgttg

SEQ ID NO: 3167 - DNA, 22 bp, synthetic construct
  misc_feature 1..22: note = Synthetic Construct
  source 1..22: mol_type = other DNA
ggtgcctcacttcatagtgtca

SEQ ID NO: 3168 - DNA, 23 bp, synthetic construct
  misc_feature 1..23: note = Synthetic Construct
  source 1..23: mol_type = other DNA
agatggagggcagatttcagaag

SEQ ID NO: 3169 - DNA, 23 bp, synthetic construct
  misc_feature 1..23: note = Synthetic Construct
  source 1..23: mol_type = other DNA
cacacagagcctgggcttatatc

SEQ ID NO: 3170 - DNA, 25 bp, synthetic construct
  misc_feature 1..25: note = Synthetic Construct
  source 1..25: mol_type = other DNA
gcctgggatctctgaagaacagttg

SEQ ID NO: 3171 - DNA, 25 bp, synthetic construct
  misc_feature 1..25: note = Synthetic Construct
  source 1..25: mol_type = other DNA
ccctttgtaaagcatggccctatac

SEQ ID NO: 3172 - DNA, 25 bp, synthetic construct
  misc_feature 1..25: note = Synthetic Construct
  source 1..25: mol_type = other DNA
ttctcatacacaggtgatagcaaca

SEQ ID NO: 3173 - DNA, 21 bp, synthetic construct
  misc_feature 1..21: note = Synthetic Construct
  source 1..21: mol_type = other DNA
cctctttgcccttgggtggaa

SEQ ID NO: 3174 - DNA, 19 bp, synthetic construct
  misc_feature 1..19: note = Synthetic Construct
  source 1..19: mol_type = other DNA
gttgttggccaggcaccat

SEQ ID NO: 3175 - DNA, 21 bp, synthetic construct
  misc_feature 1..21: note = Synthetic Construct
  source 1..21: mol_type = other DNA
ccctggctactgcccatgttt

SEQ ID NO: 3176 - DNA, 22 bp, synthetic construct
  misc_feature 1..22: note = Synthetic Construct
  source 1..22: mol_type = other DNA
gccttgctgtcagctccaatgt

SEQ ID NO: 3177 - DNA, 22 bp, synthetic construct
  misc_feature 1..22: note = Synthetic Construct
  source 1..22: mol_type = other DNA
catctttgtggggctggagttc

SEQ ID NO: 3178 - DNA, 20 bp, synthetic construct
  misc_feature 1..20: note = Synthetic Construct
  source 1..20: mol_type = other DNA
gagcccacatcccgtgaaca

SEQ ID NO: 3179 - DNA, 20 bp, synthetic construct
  misc_feature 1..20: note = Synthetic Construct
  source 1..20: mol_type = other DNA
gaatgtgtccgccagtctgt

SEQ ID NO: 3180 - DNA, 23 bp, synthetic construct
  misc_feature 1..23: note = Synthetic Construct
  source 1..23: mol_type = other DNA
cctggaagccagctagaaaccat

SEQ ID NO: 3181 - DNA, 22 bp, synthetic construct
  misc_feature 1..22: note = Synthetic Construct
  source 1..22: mol_type = other DNA
ggagaggaagacagtggcatct

SEQ ID NO: 3182 - DNA, 22 bp, synthetic construct
  misc_feature 1..22: note = Synthetic Construct
  source 1..22: mol_type = other DNA
gggtgaatgccggtagttgtga

SEQ ID NO: 3183 - DNA, 20 bp, synthetic construct
  misc_feature 1..20: note = Synthetic Construct
  source 1..20: mol_type = other DNA
agccgggcgtacttcctttt

SEQ ID NO: 3184 - DNA, 22 bp, synthetic construct
  misc_feature 1..22: note = Synthetic Construct
  source 1..22: mol_type = other DNA
gctgtatgtctgcaggtcaagt

SEQ ID NO: 3185 - DNA, 24 bp, synthetic construct
  misc_feature 1..24: note = Synthetic Construct
  source 1..24: mol_type = other DNA
tcctcacatgagagtttcctgttc

SEQ ID NO: 3186 - DNA, 22 bp, synthetic construct
  misc_feature 1..22: note = Synthetic Construct
  source 1..22: mol_type = other DNA
ctccagcatctggaaggagaca

SEQ ID NO: 3187 - DNA, 20 bp, synthetic construct
  misc_feature 1..20: note = Synthetic Construct
  source 1..20: mol_type = other DNA
cgggaggcttgcctgagaaa

SEQ ID NO: 3188 - DNA, 20 bp, synthetic construct
  misc_feature 1..20: note = Synthetic Construct
  source 1..20: mol_type = other DNA
tagccagctcccacacacaa

SEQ ID NO: 3189 - DNA, 21 bp, synthetic construct
  misc_feature 1..21: note = Synthetic Construct
  source 1..21: mol_type = other DNA
tgggcgtagcacaagaaatca

SEQ ID NO: 3190 - DNA, 22 bp, synthetic construct
  misc_feature 1..22: note = Synthetic Construct
  source 1..22: mol_type = other DNA
tgggttgctctttgctgttcaa

SEQ ID NO: 3191 - DNA, 24 bp, synthetic construct
  misc_feature 1..24: note = Synthetic Construct
  source 1..24: mol_type = other DNA
gtggcaaacaactctgaggctaac

SEQ ID NO: 3192 - DNA, 24 bp, synthetic construct
  misc_feature 1..24: note = Synthetic Construct
  source 1..24: mol_type = other DNA
gggaagaatgctgtgtcctcacaa

SEQ ID NO: 3193 - DNA, 20 bp, synthetic construct
  misc_feature 1..20: note = Synthetic Construct
  source 1..20: mol_type = other DNA
atttcctgccgtgccacctt

SEQ ID NO: 3194 - DNA, 20 bp, synthetic construct
  misc_feature 1..20: note = Synthetic Construct
  source 1..20: mol_type = other DNA
cacagaaagctggggcaaca

SEQ ID NO: 3195 - DNA, 23 bp, synthetic construct
  misc_feature 1..23: note = Synthetic Construct
  source 1..23: mol_type = other DNA
ccagtacatgctttcccaacaca

SEQ ID NO: 3196 - DNA, 27 bp, synthetic construct
  misc_feature 1..27: note = Synthetic Construct
  source 1..27: mol_type = other DNA
cctttttaaaggagtggatgcagaagt

SEQ ID NO: 3197 - DNA, 23 bp, synthetic construct
  misc_feature 1..23: note = Synthetic Construct
  source 1..23: mol_type = other DNA
gagccccaaatgtacactagcaa

SEQ ID NO: 3198 - DNA, 27 bp, synthetic construct
  misc_feature 1..27: note = Synthetic Construct
  source 1..27: mol_type = other DNA
gcccagtgcttttcttaattgctttga

SEQ ID NO: 3199 - DNA, 23 bp, synthetic construct
  misc_feature 1..23: note = Synthetic Construct
  source 1..23: mol_type = other DNA
ccactggactactggactacact

SEQ ID NO: 3200 - DNA, 24 bp, synthetic construct
  misc_feature 1..24: note = Synthetic Construct
  source 1..24: mol_type = other DNA
caatagccagggtctgaattgcat

SEQ ID NO: 3201 - DNA, 23 bp, synthetic construct
  misc_feature 1..23: note = Synthetic Construct
  source 1..23: mol_type = other DNA
gagtgcagaagaatgggttctga

SEQ ID NO: 3202 - DNA, 20 bp, synthetic construct
  misc_feature 1..20: note = Synthetic Construct
  source 1..20: mol_type = other DNA
aagccctaaacccgcgttac

SEQ ID NO: 3203 - DNA, 25 bp, synthetic construct
  misc_feature 1..25: note = Synthetic Construct
  source 1..25: mol_type = other DNA
agcagaaatcacacaatggcaatac

SEQ ID NO: 3204 - DNA, 20 bp, synthetic construct
  misc_feature 1..20: note = Synthetic Construct
  source 1..20: mol_type = other DNA
tgccttcactgcctggtgat

SEQ ID NO: 3205 - DNA, 20 bp, synthetic construct
  misc_feature 1..20: note = Synthetic Construct
  source 1..20: mol_type = other DNA
accctccccgccatcaagta

SEQ ID NO: 3206 - DNA, 27 bp, synthetic construct
  misc_feature 1..27: note = Synthetic Construct
  source 1..27: mol_type = other DNA
cgtctttctccagtttctgagccctat

SEQ ID NO: 3207 - DNA, 25 bp, synthetic construct
  misc_feature 1..25: note = Synthetic Construct
  source 1..25: mol_type = other DNA
ggtcagctgtgtcaataaggactga

SEQ ID NO: 3208 - DNA, 20 bp, synthetic construct
  misc_feature 1..20: note = Synthetic Construct
  source 1..20: mol_type = other DNA
ggaagcaggtgtcagtgtga

SEQ ID NO: 3209 - DNA, 24 bp, synthetic construct
  misc_feature 1..24: note = Synthetic Construct
  source 1..24: mol_type = other DNA
ggtctgcttctggagtctgcagtt

SEQ ID NO: 3210 - DNA, 25 bp, synthetic construct
  misc_feature 1..25: note = Synthetic Construct
  source 1..25: mol_type = other DNA
cacactcggttcctgtttcaggatt

SEQ ID NO: 3211 - DNA, 25 bp, synthetic construct
  misc_feature 1..25: note = Synthetic Construct
  source 1..25: mol_type = other DNA
acacccatcccaaagggattaaaag

SEQ ID NO: 3212 - DNA, 22 bp, synthetic construct
  misc_feature 1..22: note = Synthetic Construct
  source 1..22: mol_type = other DNA
cctgtctcccttgccagatcaa

SEQ ID NO: 3213 - DNA, 23 bp, synthetic construct
  misc_feature 1..23: note = Synthetic Construct
  source 1..23: mol_type = other DNA
aggcttccctgagcagagatatt

SEQ ID NO: 3214 - DNA, 20 bp, synthetic construct
  misc_feature 1..20: note = Synthetic Construct
  source 1..20: mol_type = other DNA
tctctggctccagcgtctga

SEQ ID NO: 3215 - DNA, 19 bp, synthetic construct
  misc_feature 1..19: note = Synthetic Construct
  source 1..19: mol_type = other DNA
agggatatggccggcttct

SEQ ID NO: 3216 - DNA, 20 bp, synthetic construct
  misc_feature 1..20: note = Synthetic Construct
  source 1..20: mol_type = other DNA
gtggtggtggttgtgctact

SEQ ID NO: 3217 - DNA, 24 bp, synthetic construct
  misc_feature 1..24: note = Synthetic Construct
  source 1..24: mol_type = other DNA
ccttccttttcactaagcctgtct

SEQ ID NO: 3218 - DNA, 24 bp, synthetic construct
  misc_feature 1..24: note = Synthetic Construct
  source 1..24: mol_type = other DNA
gagagattggaaggggagagattg

SEQ ID NO: 3219 - DNA, 26 bp, synthetic construct
  misc_feature 1..26: note = Synthetic Construct
  source 1..26: mol_type = other DNA
ggtggagtaaaaacagcactggacta

SEQ ID NO: 3220 - DNA, 25 bp, synthetic construct
  misc_feature 1..25: note = Synthetic Construct
  source 1..25: mol_type = other DNA
ccttcagggcagtgagttctcttct

SEQ ID NO: 3221 - DNA, 22 bp, synthetic construct
  misc_feature 1..22: note = Synthetic Construct
  source 1..22: mol_type = other DNA
tccaggaaaaggaactgcaaca

SEQ ID NO: 3222 - DNA, 26 bp, synthetic construct
  misc_feature 1..26: note = Synthetic Construct
  source 1..26: mol_type = other DNA
cgcatgtgtaccttaatgatgtcaac

SEQ ID NO: 3223 - DNA, 21 bp, synthetic construct
  misc_feature 1..21: note = Synthetic Construct
  source 1..21: mol_type = other DNA
ccctgaatgttccaccagctt

SEQ ID NO: 3224 - DNA, 23 bp, synthetic construct
  misc_feature 1..23: note = Synthetic Construct
  source 1..23: mol_type = other DNA
gcctccagagctagggatggtta

SEQ ID NO: 3225 - DNA, 19 bp, synthetic construct
  misc_feature 1..19: note = Synthetic Construct
  source 1..19: mol_type = other DNA
tggaggggaccgggttcta

SEQ ID NO: 3226 - DNA, 24 bp, synthetic construct
  misc_feature 1..24: note = Synthetic Construct
  source 1..24: mol_type = other DNA
cctggatttgtctcctgtcacttc

SEQ ID NO: 3227 - DNA, 24 bp, synthetic construct
  misc_feature 1..24: note = Synthetic Construct
  source 1..24: mol_type = other DNA
ggggacacgtcttactgtagtctt

SEQ ID NO: 3228 - DNA, 22 bp, synthetic construct
  misc_feature 1..22: note = Synthetic Construct
  source 1..22: mol_type = other DNA
tcagcaggaaaagcacttgact

SEQ ID NO: 3229 - DNA, 24 bp, synthetic construct
  misc_feature 1..24: note = Synthetic Construct
  source 1..24: mol_type = other DNA
gtttccttccttgtttgcagagtt

SEQ ID NO: 3230 - DNA, 27 bp, synthetic construct
  misc_feature 1..27: note = Synthetic Construct
  source 1..27: mol_type = other DNA
ccataccagacacaaactacagtcaca

SEQ ID NO: 3231 - DNA, 28 bp, synthetic construct
  misc_feature 1..28: note = Synthetic Construct
  source 1..28: mol_type = other DNA
cctgactttctagttcaactcagccttt

SEQ ID NO: 3232 - DNA, 22 bp, synthetic construct
  misc_feature 1..22: note = Synthetic Construct
  source 1..22: mol_type = other DNA
gttgatgctctggctactgcta

SEQ ID NO: 3233 - DNA, 24 bp, synthetic construct
  misc_feature 1..24: note = Synthetic Construct
  source 1..24: mol_type = other DNA
caagggctattcaggactcacaaa

SEQ ID NO: 3234 - DNA, 25 bp, synthetic construct
  misc_feature 1..25: note = Synthetic Construct
  source 1..25: mol_type = other DNA
cactgcataccagcaaatgagttgt

SEQ ID NO: 3235 - DNA, 20 bp, synthetic construct
  misc_feature 1..20: note = Synthetic Construct
  source 1..20: mol_type = other DNA
actgcatggcagagcagctt

SEQ ID NO: 3236 - DNA, 21 bp, synthetic construct
  misc_feature 1..21: note = Synthetic Construct
  source 1..21: mol_type = other DNA
gcagagctcctcaaagggaaa

SEQ ID NO: 3237 - DNA, 25 bp, synthetic construct
  misc_feature 1..25: note = Synthetic Construct
  source 1..25: mol_type = other DNA
ccaccactaccatcatcactatgaa

SEQ ID NO: 3238 - DNA, 22 bp, synthetic construct
  misc_feature 1..22: note = Synthetic Construct
  source 1..22: mol_type = other DNA
gtgagtgaatgggtgggaggta

SEQ ID NO: 3239 - DNA, 25 bp, synthetic construct
  misc_feature 1..25: note = Synthetic Construct
  source 1..25: mol_type = other DNA
catgtgctctagcaagacaatcaaa

SEQ ID NO: 3240 - DNA, 24 bp, synthetic construct
  misc_feature 1..24: note = Synthetic Construct
  source 1..24: mol_type = other DNA
ggagaccacaatgcacaggtctac

SEQ ID NO: 3241 - DNA, 22 bp, synthetic construct
  misc_feature 1..22: note = Synthetic Construct
  source 1..22: mol_type = other DNA
agctctgtaggagggcaaggat

SEQ ID NO: 3242 - DNA, 20 bp, synthetic construct
  misc_feature 1..20: note = Synthetic Construct
  source 1..20: mol_type = other DNA
tccatggctctggctgctat

SEQ ID NO: 3243 - DNA, 22 bp, synthetic construct
  misc_feature 1..22: note = Synthetic Construct
  source 1..22: mol_type = other DNA
ccgtgactagtgcttcgtgctt

SEQ ID NO: 3244 - DNA, 22 bp, synthetic construct
  misc_feature 1..22: note = Synthetic Construct
  source 1..22: mol_type = other DNA
ggaccaatggctggaagaccaa

SEQ ID NO: 3245 - DNA, 24 bp, synthetic construct
  misc_feature 1..24: note = Synthetic Construct
  source 1..24: mol_type = other DNA
cagaagtgtggtggggttacttac

SEQ ID NO: 3246 - DNA, 21 bp, synthetic construct
  misc_feature 1..21: note = Synthetic Construct
  source 1..21: mol_type = other DNA
ggctgttgcagaagcatcact

SEQ ID NO: 3247 - DNA, 21 bp, synthetic construct
  misc_feature 1..21: note = Synthetic Construct
  source 1..21: mol_type = other DNA
ccaaacctgctcctccaccat

SEQ ID NO: 3248 - DNA, 20 bp, synthetic construct
  misc_feature 1..20: note = Synthetic Construct
  source 1..20: mol_type = other DNA
gcccaggtctcgtctccatt

SEQ ID NO: 3249 - DNA, 21 bp, synthetic construct
  misc_feature 1..21: note = Synthetic Construct
  source 1..21: mol_type = other DNA
tgagccttgcagtggggtaac

SEQ ID NO: 3250 - DNA, 30 bp, synthetic construct
  misc_feature 1..30: note = Synthetic Construct
  source 1..30: mol_type = other DNA
gcatagctctttgtagaaacttgaccctta

SEQ ID NO: 3251 - DNA, 22 bp, synthetic construct
  misc_feature 1..22: note = Synthetic Construct
  source 1..22: mol_type = other DNA
ccacagtgaagcctggagaaca

SEQ ID NO: 3252 - DNA, 20 bp, synthetic construct
  misc_feature 1..20: note = Synthetic Construct
  source 1..20: mol_type = other DNA
ggacatgggcgaggcaattt

SEQ ID NO: 3253 - DNA, 23 bp, synthetic construct
  misc_feature 1..23: note = Synthetic Construct
  source 1..23: mol_type = other DNA
atcccagggaggagaggtgacat

SEQ ID NO: 3254 - DNA, 22 bp, synthetic construct
  misc_feature 1..22: note = Synthetic Construct
  source 1..22: mol_type = other DNA
cgctggcccttctagtgaatgt

SEQ ID NO: 3255 - DNA, 24 bp, synthetic construct
  misc_feature 1..24: note = Synthetic Construct
  source 1..24: mol_type = other DNA
ctgcaattccccaacaatctctgt

SEQ ID NO: 3256 - DNA, 20 bp, synthetic construct
  misc_feature 1..20: note = Synthetic Construct
  source 1..20: mol_type = other DNA
ggctgtcctccctgcctaaa

SEQ ID NO: 3257 - DNA, 21 bp, synthetic construct
  misc_feature 1..21: note = Synthetic Construct
  source 1..21: mol_type = other DNA
gctgtggggtttgagggctat

SEQ ID NO: 3258 - DNA, 23 bp, synthetic construct
  misc_feature 1..23: note = Synthetic Construct
  source 1..23: mol_type = other DNA
ccctgagagtggtagctactgaa

SEQ ID NO: 3259 - DNA, 25 bp, synthetic construct
  misc_feature 1..25: note = Synthetic Construct
  source 1..25: mol_type = other DNA
gccagatcaaatcattccaggtgaa

SEQ ID NO: 3260 - DNA, 24 bp, synthetic construct
  misc_feature 1..24: note = Synthetic Construct
  source 1..24: mol_type = other DNA
cacagaagggcagataaagcaaaa

SEQ ID NO: 3261 - DNA, 23 bp, synthetic construct
  misc_feature 1..23: note = Synthetic Construct
  source 1..23: mol_type = other DNA
gccatgtggatttccaggtcact

SEQ ID NO: 3262 - DNA, 24 bp, synthetic construct
  misc_feature 1..24: note = Synthetic Construct
  source 1..24: mol_type = other DNA
cgctgtagctgaagcactgtccta

SEQ ID NO: 3263 - DNA, 22 bp, synthetic construct
  misc_feature 1..22: note = Synthetic Construct
  source 1..22: mol_type = other DNA
ctgctgattcaggaccacagaa

SEQ ID NO: 3264 - DNA, 22 bp, synthetic construct
  misc_feature 1..22: note = Synthetic Construct
  source 1..22: mol_type = other DNA
agcacagggcaacagaagtaac

SEQ ID NO: 3265 - DNA, 25 bp, synthetic construct
  misc_feature 1..25: note = Synthetic Construct
  source 1..25: mol_type = other DNA
gggcccaacatctagttctgctaca

SEQ ID NO: 3266 - DNA, 25 bp, synthetic construct
  misc_feature 1..25: note = Synthetic Construct
  source 1..25: mol_type = other DNA
gagaaagcaggtactgaccttttca

SEQ ID NO: 3267 - DNA, 23 bp, synthetic construct
  misc_feature 1..23: note = Synthetic Construct
  source 1..23: mol_type = other DNA
ccagtctccatctggaggaccaa

SEQ ID NO: 3268 - DNA, 28 bp, synthetic construct
  misc_feature 1..28: note = Synthetic Construct
  source 1..28: mol_type = other DNA
ggcaagcccatcatagattttagtgaca

SEQ ID NO: 3269 - DNA, 22 bp, synthetic construct
  misc_feature 1..22: note = Synthetic Construct
  source 1..22: mol_type = other DNA
ccccacctctttctgggatttg

SEQ ID NO: 3270 - DNA, 22 bp, synthetic construct
  misc_feature 1..22: note = Synthetic Construct
  source 1..22: mol_type = other DNA
agtggctgaacagaccgtctac

SEQ ID NO: 3271 - DNA, 24 bp, synthetic construct
  misc_feature 1..24: note = Synthetic Construct
  source 1..24: mol_type = other DNA
cagcctagtgagggtgtaagacta

SEQ ID NO: 3272 - DNA, 19 bp, synthetic construct
  misc_feature 1..19: note = Synthetic Construct
  source 1..19: mol_type = other DNA
gggtgtggggcgtagtgaa

SEQ ID NO: 3273 - DNA, 19 bp, synthetic construct
  misc_feature 1..19: note = Synthetic Construct
  source 1..19: mol_type = other DNA
gcagaggcaccaccacact

SEQ ID NO: 3274 - DNA, 22 bp, synthetic construct
  misc_feature 1..22: note = Synthetic Construct
  source 1..22: mol_type = other DNA
cctgcatacggagaggtcaaag

SEQ ID NO: 3275 - DNA, 22 bp, synthetic construct
  misc_feature 1..22: note = Synthetic Construct
  source 1..22: mol_type = other DNA
gcgccatctttttgaggcatag

SEQ ID NO: 3276 - DNA, 26 bp, synthetic construct
  misc_feature 1..26: note = Synthetic Construct
  source 1..26: mol_type = other DNA
ggaaggttctgacagacaatggaact

SEQ ID NO: 3277 - DNA, 20 bp, synthetic construct
  misc_feature 1..20: note = Synthetic Construct
  source 1..20: mol_type = other DNA
catcttccacgcctgagctt

SEQ ID NO: 3278 - DNA, 21 bp, synthetic construct
  misc_feature 1..21: note = Synthetic Construct
  source 1..21: mol_type = other DNA
gctcatgggcagggttcactt

SEQ ID NO: 3279 - DNA, 20 bp, synthetic construct
  misc_feature 1..20: note = Synthetic Construct
  source 1..20: mol_type = other DNA
gcagaagcactgtccagact

SEQ ID NO: 3280 - DNA, 26 bp, synthetic construct
  misc_feature 1..26: note = Synthetic Construct
  source 1..26: mol_type = other DNA
ccttctatcagtagcaaggagacagt

SEQ ID NO: 3281 - DNA, 20 bp, synthetic construct
  misc_feature 1..20: note = Synthetic Construct
  source 1..20: mol_type = other DNA
agcgggttggactcactgtt

SEQ ID NO: 3282 - DNA, 23 bp, synthetic construct
  misc_feature 1..23: note = Synthetic Construct
  source 1..23: mol_type = other DNA
ggctaactgagccctggtgaatg

SEQ ID NO: 3283 - DNA, 22 bp, synthetic construct
  misc_feature 1..22: note = Synthetic Construct
  source 1..22: mol_type = other DNA
ctggagacgtacatgccagtca

SEQ ID NO: 3284 - DNA, 22 bp, synthetic construct
  misc_feature 1..22: note = Synthetic Construct
  source 1..22: mol_type = other DNA
ccgcccatctctcctgtttgtt

SEQ ID NO: 3285 - DNA, 21 bp, synthetic construct
  misc_feature 1..21: note = Synthetic Construct
  source 1..21: mol_type = other DNA
ggggaacagctggaaaagcat

SEQ ID NO: 3286 - DNA, 21 bp, synthetic construct
  misc_feature 1..21: note = Synthetic Construct
  source 1..21: mol_type = other DNA
agtctggcctgtggtgtctgt

SEQ ID NO: 3287 - DNA, 22 bp, synthetic construct
  misc_feature 1..22: note = Synthetic Construct
  source 1..22: mol_type = other DNA
agggaccccatcacccatttac

SEQ ID NO: 3288 - DNA, 30 bp, synthetic construct
  misc_feature 1..30: note = Synthetic Construct
  source 1..30: mol_type = other DNA
ggaactacaatagacataaactggctgtca

SEQ ID NO: 3289 - DNA, 24 bp, synthetic construct
  misc_feature 1..24: note = Synthetic Construct
  source 1..24: mol_type = other DNA
tgttttagcagcacgagatgaact

SEQ ID NO: 3290 - DNA, 22 bp, synthetic construct
  misc_feature 1..22: note = Synthetic Construct
  source 1..22: mol_type = other DNA
aggcaaatggcaggagggaatg

SEQ ID NO: 3291 - DNA, 24 bp, synthetic construct
  misc_feature 1..24: note = Synthetic Construct
  source 1..24: mol_type = other DNA
gagattacaggagcatgccacttc

SEQ ID NO: 3292 - DNA, 22 bp, synthetic construct
  misc_feature 1..22: note = Synthetic Construct
  source 1..22: mol_type = other DNA
tgctttcgagaaaagccacact

SEQ ID NO: 3293 - DNA, 23 bp, synthetic construct
  misc_feature 1..23: note = Synthetic Construct
  source 1..23: mol_type = other DNA
gcagcggctatagacagatccaa

SEQ ID NO: 3294 - DNA, 20 bp, synthetic construct
  misc_feature 1..20: note = Synthetic Construct
  source 1..20: mol_type = other DNA
gcactgcctctgcctcaaaa

SEQ ID NO: 3295 - DNA, 23 bp, synthetic construct
  misc_feature 1..23: note = Synthetic Construct
  source 1..23: mol_type = other DNA
taccaccagggctgatccagaga

SEQ ID NO: 3296 - DNA, 22 bp, synthetic construct
  misc_feature 1..22: note = Synthetic Construct
  source 1..22: mol_type = other DNA
gtggtctgcagtcacatcttga

SEQ ID NO: 3297 - DNA, 23 bp, synthetic construct
  misc_feature 1..23: note = Synthetic Construct
  source 1..23: mol_type = other DNA
gtccatcagccagatgtggagtt

SEQ ID NO: 3298 - DNA, 22 bp, synthetic construct
  misc_feature 1..22: note = Synthetic Construct
  source 1..22: mol_type = other DNA
gggtctgtcgcctgacttaaca

SEQ ID NO: 3299 - DNA, 21 bp, synthetic construct
  misc_feature 1..21: note = Synthetic Construct
  source 1..21: mol_type = other DNA
agaggtcagggtgaagcacta

SEQ ID NO: 3300 - DNA, 27 bp, synthetic construct
  misc_feature 1..27: note = Synthetic Construct
  source 1..27: mol_type = other DNA
ggaaaaagtggaggcactgattcattc

SEQ ID NO: 3301 - DNA, 26 bp, synthetic construct
  misc_feature 1..26: note = Synthetic Construct
  source 1..26: mol_type = other DNA
agagaatagtacctcccatgggtaaa

SEQ ID NO: 3302 - DNA, 20 bp, synthetic construct
  misc_feature 1..20: note = Synthetic Construct
  source 1..20: mol_type = other DNA
gcagagccaggcctcaaaac

SEQ ID NO: 3303 - DNA, 19 bp, synthetic construct
  misc_feature 1..19: note = Synthetic Construct
  source 1..19: mol_type = other DNA
tgagtcctgccgcttcaca

SEQ ID NO: 3304 - DNA, 22 bp, synthetic construct
  misc_feature 1..22: note = Synthetic Construct
  source 1..22: mol_type = other DNA
gtgggaagcgggttaggaagat

SEQ ID NO: 3305 - DNA, 22 bp, synthetic construct
  misc_feature 1..22: note = Synthetic Construct
  source 1..22: mol_type = other DNA
ggagccagacttcttggtcctt

SEQ ID NO: 3306 - DNA, 21 bp, synthetic construct
  misc_feature 1..21: note = Synthetic Construct
  source 1..21: mol_type = other DNA
gcgttgtggtgctttcctttc

SEQ ID NO: 3307 - DNA, 25 bp, synthetic construct
  misc_feature 1..25: note = Synthetic Construct
  source 1..25: mol_type = other DNA
aattttcagaggaaagggaggaaca

SEQ ID NO: 3308 - DNA, 21 bp, synthetic construct
  misc_feature 1..21: note = Synthetic Construct
  source 1..21: mol_type = other DNA
gcaccacataggtgacagcaa

SEQ ID NO: 3309 - DNA, 18 bp, synthetic construct
  misc_feature 1..18: note = Synthetic Construct
  source 1..18: mol_type = other DNA
agtgcacgtccgccgtaa

SEQ ID NO: 3310 - DNA, 24 bp, synthetic construct
  misc_feature 1..24: note = Synthetic Construct
  source 1..24: mol_type = other DNA
tcctcaggttgttaggcattttga

SEQ ID NO: 3311 - DNA, 21 bp, synthetic construct
  misc_feature 1..21: note = Synthetic Construct
  source 1..21: mol_type = other DNA
ggcactggggaagacgaagaa

SEQ ID NO: 3312 - DNA, 21 bp, synthetic construct
  misc_feature 1..21: note = Synthetic Construct
  source 1..21: mol_type = other DNA
tcctgcttgcctctggggaat

SEQ ID NO: 3313 - DNA, 20 bp, synthetic construct
  misc_feature 1..20: note = Synthetic Construct
  source 1..20: mol_type = other DNA
accctggtgggatccagaaa

SEQ ID NO: 3314 - DNA, 23 bp, synthetic construct
  misc_feature 1..23: note = Synthetic Construct
  source 1..23: mol_type = other DNA
cgagcccctatccagaaagaaaa

SEQ ID NO: 3315 - DNA, 23 bp, synthetic construct
  misc_feature 1..23: note = Synthetic Construct
  source 1..23: mol_type = other DNA
gctcaaatcaccttcctgcaagt

SEQ ID NO: 3316 - DNA, 27 bp, synthetic construct
  misc_feature 1..27: note = Synthetic Construct
  source 1..27: mol_type = other DNA
ggtacttttacttttgccgtaggtagt

SEQ ID NO: 3317 - DNA, 22 bp, synthetic construct
  misc_feature 1..22: note = Synthetic Construct
  source 1..22: mol_type = other DNA
gggctgttacctcatcctcttg

SEQ ID NO: 3318 - DNA, 22 bp, synthetic construct
  misc_feature 1..22: note = Synthetic Construct
  source 1..22: mol_type = other DNA
catcatgcccaagtagcgttca

SEQ ID NO: 3319 - DNA, 24 bp, synthetic construct
  misc_feature 1..24: note = Synthetic Construct
  source 1..24: mol_type = other DNA
gggatttttgagcccctgaaattg

SEQ ID NO: 3320 - DNA, 20 bp, synthetic construct
  misc_feature 1..20: note = Synthetic Construct
  source 1..20: mol_type = other DNA
acaccggcgacttctccaat

SEQ ID NO: 3321 - DNA, 22 bp, synthetic construct
  misc_feature 1..22: note = Synthetic Construct
  source 1..22: mol_type = other DNA
tggcctcaggcaacactctgta

SEQ ID NO: 3322 - DNA, 28 bp, synthetic construct
  misc_feature 1..28: note = Synthetic Construct
  source 1..28: mol_type = other DNA
ctcaaggctaaagtaactccttggaaag

SEQ ID NO: 3323 - DNA, 20 bp, synthetic construct
  misc_feature 1..20: note = Synthetic Construct
  source 1..20: mol_type = other DNA
agtctgcagagacccgtgta

SEQ ID NO: 3324 - DNA, 22 bp, synthetic construct
  misc_feature 1..22: note = Synthetic Construct
  source 1..22: mol_type = other DNA
tgctgggtaggtgtgtggtaca

SEQ ID NO: 3325 - DNA, 20 bp, synthetic construct
  misc_feature 1..20: note = Synthetic Construct
  source 1..20: mol_type = other DNA
aacacaggcctggctctcaa

SEQ ID NO: 3326 - DNA, 20 bp, synthetic construct
  misc_feature 1..20: note = Synthetic Construct
  source 1..20: mol_type = other DNA
ggaaagggagggaggtgctt

SEQ ID NO: 3327 - DNA, 22 bp, synthetic construct
  misc_feature 1..22: note = Synthetic Construct
  source 1..22: mol_type = other DNA
gctctcctggctctgtgaggat

SEQ ID NO: 3328 - DNA, 22 bp, synthetic construct
  misc_feature 1..22: note = Synthetic Construct
  source 1..22: mol_type = other DNA
acaacctagtgccaggggaagt

SEQ ID NO: 3329 - DNA, 21 bp, synthetic construct
  misc_feature 1..21: note = Synthetic Construct
  source 1..21: mol_type = other DNA
acaagccccacagggtagact

SEQ ID NO: 3330 - DNA, 24 bp, synthetic construct
  misc_feature 1..24: note = Synthetic Construct
  source 1..24: mol_type = other DNA
gaaccagtttcctttctcctggaa

SEQ ID NO: 3331 - DNA, 18 bp, synthetic construct
  misc_feature 1..18: note = Synthetic Construct
  source 1..18: mol_type = other DNA
ggaagccactcgctgcat

SEQ ID NO: 3332 - DNA, 18 bp, synthetic construct
  misc_feature 1..18: note = Synthetic Construct
  source 1..18: mol_type = other DNA
tgggtgcctcggatgctt

SEQ ID NO: 3333 - DNA, 23 bp, synthetic construct
  misc_feature 1..23: note = Synthetic Construct
  source 1..23: mol_type = other DNA
gctcattaatgcacgcagacaca

SEQ ID NO: 3334 - DNA, 28 bp, synthetic construct
  misc_feature 1..28: note = Synthetic Construct
  source 1..28: mol_type = other DNA
ggtggtacagaatacaatggctgtgatg

SEQ ID NO: 3335 - DNA, 22 bp, synthetic construct
  misc_feature 1..22: note = Synthetic Construct
  source 1..22: mol_type = other DNA
tctggtagcaggagggagaaag

SEQ ID NO: 3336 - DNA, 26 bp, synthetic construct
  misc_feature 1..26: note = Synthetic Construct
  source 1..26: mol_type = other DNA
ggatgtgttcatccgtctcttcacta

SEQ ID NO: 3337 - DNA, 20 bp, synthetic construct
  misc_feature 1..20: note = Synthetic Construct
  source 1..20: mol_type = other DNA
agacatgggtccctctgctt

SEQ ID NO: 3338 - DNA, 28 bp, synthetic construct
  misc_feature 1..28: note = Synthetic Construct
  source 1..28: mol_type = other DNA
cctggtacctgatatgatgttagctgta

SEQ ID NO: 3339 - DNA, 21 bp, synthetic construct
  misc_feature 1..21: note = Synthetic Construct
  source 1..21: mol_type = other DNA
ggtccacccatagccctctga

SEQ ID NO: 3340 - DNA, 25 bp, synthetic construct
  misc_feature 1..25: note = Synthetic Construct
  source 1..25: mol_type = other DNA
ggtaggcatttttcgatggcagaga

SEQ ID NO: 3341 - DNA, 20 bp, synthetic construct
  misc_feature 1..20: note = Synthetic Construct
  source 1..20: mol_type = other DNA
agtagaggcagggtcacaca

SEQ ID NO: 3342 - DNA, 23 bp, synthetic construct
  misc_feature 1..23: note = Synthetic Construct
  source 1..23: mol_type = other DNA
actaaggaagcctcttgggttct

SEQ ID NO: 3343 - DNA, 24 bp, synthetic construct
  misc_feature 1..24: note = Synthetic Construct
  source 1..24: mol_type = other DNA
ctcttccctgaagacaaccaactt

SEQ ID NO: 3344 - DNA, 23 bp, synthetic construct
  misc_feature 1..23: note = Synthetic Construct
  source 1..23: mol_type = other DNA
ccttccaggttgatggtcgcatt

SEQ ID NO: 3345 - DNA, 20 bp, synthetic construct
  misc_feature 1..20: note = Synthetic Construct
  source 1..20: mol_type = other DNA
cactgcccagatggcagaag

SEQ ID NO: 3346 - DNA, 22 bp, synthetic construct
  misc_feature 1..22: note = Synthetic Construct
  source 1..22: mol_type = other DNA
cgtggctgcatctgatcctttc

SEQ ID NO: 3347 - DNA, 20 bp, synthetic construct
  misc_feature 1..20: note = Synthetic Construct
  source 1..20: mol_type = other DNA
tgtgagaggccgttgggaaa

SEQ ID NO: 3348 - DNA, 26 bp, synthetic construct
  misc_feature 1..26: note = Synthetic Construct
  source 1..26: mol_type = other DNA
ggaaatgtttgactcatgccctgatg

SEQ ID NO: 3349 - DNA, 20 bp, synthetic construct
  misc_feature 1..20: note = Synthetic Construct
  source 1..20: mol_type = other DNA
agtcagccagatgcccagaa

SEQ ID NO: 3350 - DNA, 20 bp, synthetic construct
  misc_feature 1..20: note = Synthetic Construct
  source 1..20: mol_type = other DNA
agctcaggactgcgttcttc

SEQ ID NO: 3351 - DNA, 24 bp, synthetic construct
  misc_feature 1..24: note = Synthetic Construct
  source 1..24: mol_type = other DNA
ccatgtacccaggagaggtgatga

SEQ ID NO: 3352 - DNA, 20 bp, synthetic construct
  misc_feature 1..20: note = Synthetic Construct
  source 1..20: mol_type = other DNA
tgtgtgctgcagtggagctt

SEQ ID NO: 3353 - DNA, 25 bp, synthetic construct
  misc_feature 1..25: note = Synthetic Construct
  source 1..25: mol_type = other DNA
ggcgtaacattagggtaccttctct

SEQ ID NO: 3354 - DNA, 24 bp, synthetic construct
  misc_feature 1..24: note = Synthetic Construct
  source 1..24: mol_type = other DNA
gggtctgggagagggataacttca

SEQ ID NO: 3355 - DNA, 23 bp, synthetic construct
  misc_feature 1..23: note = Synthetic Construct
  source 1..23: mol_type = other DNA
gtggtaactgcacgaggacaaag

SEQ ID NO: 3356 - DNA, 21 bp, synthetic construct
  misc_feature 1..21: note = Synthetic Construct
  source 1..21: mol_type = other DNA
ggagcctcttggttcctgtgt

SEQ ID NO: 3357 - DNA, 21 bp, synthetic construct
  misc_feature 1..21: note = Synthetic Construct
  source 1..21: mol_type = other DNA
aagacctctcgcaggccgatt

SEQ ID NO: 3358 - DNA, 20 bp, synthetic construct
  misc_feature 1..20: note = Synthetic Construct
  source 1..20: mol_type = other DNA
agtgaaggccctctcctgaa

SEQ ID NO: 3359 - DNA, 24 bp, synthetic construct
  misc_feature 1..24: note = Synthetic Construct
  source 1..24: mol_type = other DNA
cctcgattcagtctggggacattc

SEQ ID NO: 3360 - DNA, 22 bp, synthetic construct
  misc_feature 1..22: note = Synthetic Construct
  source 1..22: mol_type = other DNA
tcactttccacctctcgaggaa

SEQ ID NO: 3361 - DNA, 22 bp, synthetic construct
  misc_feature 1..22: note = Synthetic Construct
  source 1..22: mol_type = other DNA
aggtgaagcagagcaggacttc

SEQ ID NO: 3362 - DNA, 23 bp, synthetic construct
  misc_feature 1..23: note = Synthetic Construct
  source 1..23: mol_type = other DNA
gcctcctcatctcatgggtttca

SEQ ID NO: 3363 - DNA, 21 bp, synthetic construct
  misc_feature 1..21: note = Synthetic Construct
  source 1..21: mol_type = other DNA
aacccctttggtcttgcacat

SEQ ID NO: 3364 - DNA, 26 bp, synthetic construct
  misc_feature 1..26: note = Synthetic Construct
  source 1..26: mol_type = other DNA
gctgctatggtggtatcagggagttc

SEQ ID NO: 3365 - DNA, 22 bp, synthetic construct
  misc_feature 1..22: note = Synthetic Construct
  source 1..22: mol_type = other DNA
gcaggagcaggtttagctgaca

SEQ ID NO: 3366 - DNA, 20 bp, synthetic construct
  misc_feature 1..20: note = Synthetic Construct
  source 1..20: mol_type = other DNA
ctcacacttgggcactgctt

SEQ ID NO: 3367 - DNA, 21 bp, synthetic construct
  misc_feature 1..21: note = Synthetic Construct
  source 1..21: mol_type = other DNA
gctccccagtgatgggctttt

SEQ ID NO: 3368 - DNA, 27 bp, synthetic construct
  misc_feature 1..27: note = Synthetic Construct
  source 1..27: mol_type = other DNA
cctctgtctacacagtgaacagcattg

SEQ ID NO: 3369 - DNA, 21 bp, synthetic construct
  misc_feature 1..21: note = Synthetic Construct
  source 1..21: mol_type = other DNA
agcacccctgagcatgtggat

SEQ ID NO: 3370 - DNA, 21 bp, synthetic construct
  misc_feature 1..21: note = Synthetic Construct
  source 1..21: mol_type = other DNA
cgatgcaggccatgacagaca

SEQ ID NO: 3371 - DNA, 23 bp, synthetic construct
  misc_feature 1..23: note = Synthetic Construct
  source 1..23: mol_type = other DNA
ataatcagcctgcctcaaacaga

SEQ ID NO: 3372 - DNA, 23 bp, synthetic construct
  misc_feature 1..23: note = Synthetic Construct
  source 1..23: mol_type = other DNA
gctgccaagagaaatgggacact

SEQ ID NO: 3373 - DNA, 22 bp, synthetic construct
  misc_feature 1..22: note = Synthetic Construct
  source 1..22: mol_type = other DNA
gccatctcaaactcggccaatg

SEQ ID NO: 3374 - DNA, 22 bp, synthetic construct
  misc_feature 1..22: note = Synthetic Construct
  source 1..22: mol_type = other DNA
gcagcttgcatgctttggaaca

SEQ ID NO: 3375 - DNA, 25 bp, synthetic construct
  misc_feature 1..25: note = Synthetic Construct
  source 1..25: mol_type = other DNA
gtgaatggaaggtgcatgtaagaag

SEQ ID NO: 3376 - DNA, 25 bp, synthetic construct
  misc_feature 1..25: note = Synthetic Construct
  source 1..25: mol_type = other DNA
ggggagaaacataatgctgggtctt

SEQ ID NO: 3377 - DNA, 22 bp, synthetic construct
  misc_feature 1..22: note = Synthetic Construct
  source 1..22: mol_type = other DNA
gacagaccaagcctggagatca

SEQ ID NO: 3378 - DNA, 26 bp, synthetic construct
  misc_feature 1..26: note = Synthetic Construct
  source 1..26: mol_type = other DNA
gcttcactaacaccagggtaggtatc

SEQ ID NO: 3379 - DNA, 22 bp, synthetic construct
  misc_feature 1..22: note = Synthetic Construct
  source 1..22: mol_type = other DNA
gctggaactgggatttcagcaa

SEQ ID NO: 3380 - DNA, 24 bp, synthetic construct
  misc_feature 1..24: note = Synthetic Construct
  source 1..24: mol_type = other DNA
gtccataacaggaccttagagcaa

SEQ ID NO: 3381 - DNA, 22 bp, synthetic construct
  misc_feature 1..22: note = Synthetic Construct
  source 1..22: mol_type = other DNA
gctcttgggagtaggtggaaac

SEQ ID NO: 3382 - DNA, 24 bp, synthetic construct
  misc_feature 1..24: note = Synthetic Construct
  source 1..24: mol_type = other DNA
ggttttgggacctagaagcagtca

SEQ ID NO: 3383 - DNA, 23 bp, synthetic construct
  misc_feature 1..23: note = Synthetic Construct
  source 1..23: mol_type = other DNA
gggatagcaggtctctgttccaa

SEQ ID NO: 3384 - DNA, 23 bp, synthetic construct
  misc_feature 1..23: note = Synthetic Construct
  source 1..23: mol_type = other DNA
ctcttctggagctctacccaact

SEQ ID NO: 3385 - DNA, 23 bp, synthetic construct
  misc_feature 1..23: note = Synthetic Construct
  source 1..23: mol_type = other DNA
ccctttttccctgaagagctgaa

SEQ ID NO: 3386 - DNA, 24 bp, synthetic construct
  misc_feature 1..24: note = Synthetic Construct
  source 1..24: mol_type = other DNA
ggactggtgaggaaggtgtaggaa

SEQ ID NO: 3387 - DNA, 22 bp, synthetic construct
  misc_feature 1..22: note = Synthetic Construct
  source 1..22: mol_type = other DNA
gcaaaactccgggatcctcaac

SEQ ID NO: 3388 - DNA, 21 bp, synthetic construct
  misc_feature 1..21: note = Synthetic Construct
  source 1..21: mol_type = other DNA
ttccctcccaggcaaggagtt

SEQ ID NO: 3389 - DNA, 18 bp, synthetic construct
  misc_feature 1..18: note = Synthetic Construct
  source 1..18: mol_type = other DNA
tgcccaggtggagggttt

SEQ ID NO: 3390 - DNA, 22 bp, synthetic construct
  misc_feature 1..22: note = Synthetic Construct
  source 1..22: mol_type = other DNA
aatcagccccaaagcaaagaac

SEQ ID NO: 3391 - DNA, 21 bp, synthetic construct
  misc_feature 1..21: note = Synthetic Construct
  source 1..21: mol_type = other DNA
ccaaagtcgggagaagccaaa

SEQ ID NO: 3392 - DNA, 20 bp, synthetic construct
  misc_feature 1..20: note = Synthetic Construct
  source 1..20: mol_type = other DNA
cctcaacacagcagccaaga

SEQ ID NO: 3393 - DNA, 23 bp, synthetic construct
  misc_feature 1..23: note = Synthetic Construct
  source 1..23: mol_type = other DNA
cccacttcggtacaagtcagaca

SEQ ID NO: 3394 - DNA, 21 bp, synthetic construct
  misc_feature 1..21: note = Synthetic Construct
  source 1..21: mol_type = other DNA
gccagtgtcactcccaagtca

SEQ ID NO: 3395 - DNA, 20 bp, synthetic construct
  misc_feature 1..20: note = Synthetic Construct
  source 1..20: mol_type = other DNA
gggtagacagcagccgtaca

SEQ ID NO: 3396 - DNA, 21 bp, synthetic construct
  misc_feature 1..21: note = Synthetic Construct
  source 1..21: mol_type = other DNA
cccctcctctgcagggttcta

SEQ ID NO: 3397 - DNA, 22 bp, synthetic construct
  misc_feature 1..22: note = Synthetic Construct
  source 1..22: mol_type = other DNA
agggtcagttgggagtagaaca

SEQ ID NO: 3398 - DNA, 24 bp, synthetic construct
  misc_feature 1..24: note = Synthetic Construct
  source 1..24: mol_type = other DNA
tgttcccacctctttatcctcctt

SEQ ID NO: 3399 - DNA, 18 bp, synthetic construct
  misc_feature 1..18: note = Synthetic Construct
  source 1..18: mol_type = other DNA
tcagcgggctgtgtgtct

SEQ ID NO: 3400 - DNA, 19 bp, synthetic construct
  misc_feature 1..19: note = Synthetic Construct
  source 1..19: mol_type = other DNA
ggagggctgcagctgaact

SEQ ID NO: 3401 - DNA, 19 bp, synthetic construct
  misc_feature 1..19: note = Synthetic Construct
  source 1..19: mol_type = other DNA
acagccacagggcacttct

SEQ ID NO: 3402 - DNA, 22 bp, synthetic construct
  misc_feature 1..22: note = Synthetic Construct
  source 1..22: mol_type = other DNA
gcagaagcttaggacggcattc

SEQ ID NO: 3403 - DNA, 26 bp, synthetic construct
  misc_feature 1..26: note = Synthetic Construct
  source 1..26: mol_type = other DNA
gcctttccacctttgtctgaggagat

SEQ ID NO: 3404 - DNA, 22 bp, synthetic construct
  misc_feature 1..22: note = Synthetic Construct
  source 1..22: mol_type = other DNA
gggcaggaatgcatgggcataa

SEQ ID NO: 3405 - DNA, 25 bp, synthetic construct
  misc_feature 1..25: note = Synthetic Construct
  source 1..25: mol_type = other DNA
aaaactgcaaggagcctattgttac

SEQ ID NO: 3406 - DNA, 20 bp, synthetic construct
  misc_feature 1..20: note = Synthetic Construct
  source 1..20: mol_type = other DNA
gcaaacagctgggcaagaga

SEQ ID NO: 3407 - DNA, 20 bp, synthetic construct
  misc_feature 1..20: note = Synthetic Construct
  source 1..20: mol_type = other DNA
tccaggagcaggaggaggta

SEQ ID NO: 3408 - DNA, 21 bp, synthetic construct
  misc_feature 1..21: note = Synthetic Construct
  source 1..21: mol_type = other DNA
ttgaatggccccagtgatgtt

SEQ ID NO: 3409 - DNA, 23 bp, synthetic construct
  misc_feature 1..23: note = Synthetic Construct
  source 1..23: mol_type = other DNA
gaggctcagaaagatgcactgat

SEQ ID NO: 3410 - DNA, 21 bp, synthetic construct
  misc_feature 1..21: note = Synthetic Construct
  source 1..21: mol_type = other DNA
aaggtgtggggagagcagtca

SEQ ID NO: 3411 - DNA, 20 bp, synthetic construct
  misc_feature 1..20: note = Synthetic Construct
  source 1..20: mol_type = other DNA
gccttcgtggctagggttgt

SEQ ID NO: 3412 - DNA, 22 bp, synthetic construct
  misc_feature 1..22: note = Synthetic Construct
  source 1..22: mol_type = other DNA
ggacggatgcaccaaacgtgat

SEQ ID NO: 3413 - DNA, 25 bp, synthetic construct
  misc_feature 1..25: note = Synthetic Construct
  source 1..25: mol_type = other DNA
ccaatcagccatttggtgaatagtt

SEQ ID NO: 3414 - DNA, 22 bp, synthetic construct
  misc_feature 1..22: note = Synthetic Construct
  source 1..22: mol_type = other DNA
cacaaaagcgcctctggtgaag

SEQ ID NO: 3415 - DNA, 19 bp, synthetic construct
  misc_feature 1..19: note = Synthetic Construct
  source 1..19: mol_type = other DNA
taacgctgtggcggactca

SEQ ID NO: 3416 - DNA, 25 bp, synthetic construct
  misc_feature 1..25: note = Synthetic Construct
  source 1..25: mol_type = other DNA
tttctacctgtgtcatttggacctt

SEQ ID NO: 3417 - DNA, 23 bp, synthetic construct
  misc_feature 1..23: note = Synthetic Construct
  source 1..23: mol_type = other DNA
accatgacacttttcctgaccat

SEQ ID NO: 3418 - DNA, 22 bp, synthetic construct
  misc_feature 1..22: note = Synthetic Construct
  source 1..22: mol_type = other DNA
gcatctccactccaagttcctt

SEQ ID NO: 3419 - DNA, 24 bp, synthetic construct
  misc_feature 1..24: note = Synthetic Construct
  source 1..24: mol_type = other DNA
gttagaaaacctctgtgccagtga

SEQ ID NO: 3420 - DNA, 25 bp, synthetic construct
  misc_feature 1..25: note = Synthetic Construct
  source 1..25: mol_type = other DNA
acgtatattttggtggggttgatgt

SEQ ID NO: 3421 - DNA, 20 bp, synthetic construct
  misc_feature 1..20: note = Synthetic Construct
  source 1..20: mol_type = other DNA
cccggagtgttccccagttt

SEQ ID NO: 3422 - DNA, 21 bp, synthetic construct
  misc_feature 1..21: note = Synthetic Construct
  source 1..21: mol_type = other DNA
aggctagtcccaggacaggaa

SEQ ID NO: 3423 - DNA, 21 bp, synthetic construct
  misc_feature 1..21: note = Synthetic Construct
  source 1..21: mol_type = other DNA
agtgctaccggctcctgaact

SEQ ID NO: 3424 - DNA, 22 bp, synthetic construct
  misc_feature 1..22: note = Synthetic Construct
  source 1..22: mol_type = other DNA
gggccactgtgattgcagactt

SEQ ID NO: 3425 - DNA, 20 bp, synthetic construct
  misc_feature 1..20: note = Synthetic Construct
  source 1..20: mol_type = other DNA
cccaggcagctggtcctcta

SEQ ID NO: 3426 - DNA, 20 bp, synthetic construct
  misc_feature 1..20: note = Synthetic Construct
  source 1..20: mol_type = other DNA
aactgatggcccctccaagt

SEQ ID NO: 3427 - DNA, 18 bp, synthetic construct
  misc_feature 1..18: note = Synthetic Construct
  source 1..18: mol_type = other DNA
tgcccaccagtgccatgt

SEQ ID NO: 3428 - DNA, 19 bp, synthetic construct
  misc_feature 1..19: note = Synthetic Construct
  source 1..19: mol_type = other DNA
aggatggcgagggctggaa

SEQ ID NO: 3429 - DNA, 23 bp, synthetic construct
  misc_feature 1..23: note = Synthetic Construct
  source 1..23: mol_type = other DNA
ttggttcccagctactacagaga

SEQ ID NO: 3430 - DNA, 24 bp, synthetic construct
  misc_feature 1..24: note = Synthetic Construct
  source 1..24: mol_type = other DNA
ggagcctggttttccatgccattc

SEQ ID NO: 3431 - DNA, 26 bp, synthetic construct
  misc_feature 1..26: note = Synthetic Construct
  source 1..26: mol_type = other DNA
cagaagaaaacaatgcaggggttatg

SEQ ID NO: 3432 - DNA, 28 bp, synthetic construct
  misc_feature 1..28: note = Synthetic Construct
  source 1..28: mol_type = other DNA
ccagctaccaaactcatttacagacaga

SEQ ID NO: 3433 - DNA, 20 bp, synthetic construct
  misc_feature 1..20: note = Synthetic Construct
  source 1..20: mol_type = other DNA
tgacttctggtgccctggtt

SEQ ID NO: 3434 - DNA, 21 bp, synthetic construct
  misc_feature 1..21: note = Synthetic Construct
  source 1..21: mol_type = other DNA
tgcaggggacccaacctttca

SEQ ID NO: 3435 - DNA, 21 bp, synthetic construct
  misc_feature 1..21: note = Synthetic Construct
  source 1..21: mol_type = other DNA
tgcctaagcagaggcagtttg

SEQ ID NO: 3436 - DNA, 25 bp, synthetic construct
  misc_feature 1..25: note = Synthetic Construct
  source 1..25: mol_type = other DNA
tccaatgtcagttggggtaactaaa

SEQ ID NO: 3437 - DNA, 27 bp, synthetic construct
  misc_feature 1..27: note = Synthetic Construct
  source 1..27: mol_type = other DNA
gtccatttccacttattccagcatttg

SEQ ID NO: 3438 - DNA, 22 bp, synthetic construct
  misc_feature 1..22: note = Synthetic Construct
  source 1..22: mol_type = other DNA
ccattgagagcaagggcaggta

SEQ ID NO: 3439 - DNA, 25 bp, synthetic construct
  misc_feature 1..25: note = Synthetic Construct
  source 1..25: mol_type = other DNA
tgacatgtgtgtttatgagggagaa

SEQ ID NO: 3440 - DNA, 19 bp, synthetic construct
  misc_feature 1..19: note = Synthetic Construct
  source 1..19: mol_type = other DNA
ttcggtgggagggctgtca

SEQ ID NO: 3441 - DNA, 26 bp, synthetic construct
  misc_feature 1..26: note = Synthetic Construct
  source 1..26: mol_type = other DNA
cctgattccttgctcctcatccatag

SEQ ID NO: 3442 - DNA, 27 bp, synthetic construct
  misc_feature 1..27: note = Synthetic Construct
  source 1..27: mol_type = other DNA
tgctgcttattgtctagaagctgtatc

SEQ ID NO: 3443 - DNA, 21 bp, synthetic construct
  misc_feature 1..21: note = Synthetic Construct
  source 1..21: mol_type = other DNA
acatccctgcctcccacaagt

SEQ ID NO: 3444 - DNA, 20 bp, synthetic construct
  misc_feature 1..20: note = Synthetic Construct
  source 1..20: mol_type = other DNA
tgctcctgcacggtcacaat

SEQ ID NO: 3445 - DNA, 23 bp, synthetic construct
  misc_feature 1..23: note = Synthetic Construct
  source 1..23: mol_type = other DNA
gtgatcatttgcccttggctaca

SEQ ID NO: 3446 - DNA, 27 bp, synthetic construct
  misc_feature 1..27: note = Synthetic Construct
  source 1..27: mol_type = other DNA
ctgacaatgattatggattggggtgtt

SEQ ID NO: 3447 - DNA, 25 bp, synthetic construct
  misc_feature 1..25: note = Synthetic Construct
  source 1..25: mol_type = other DNA
ccctagaggttcatgggtacagaca

SEQ ID NO: 3448 - DNA, 19 bp, synthetic construct
  misc_feature 1..19: note = Synthetic Construct
  source 1..19: mol_type = other DNA
acaatggagccggcactga

SEQ ID NO: 3449 - DNA, 27 bp, synthetic construct
  misc_feature 1..27: note = Synthetic Construct
  source 1..27: mol_type = other DNA
gcttgtgggtttgactgaagagacttt

SEQ ID NO: 3450 - DNA, 20 bp, synthetic construct
  misc_feature 1..20: note = Synthetic Construct
  source 1..20: mol_type = other DNA
ggccctggaagtcaggaaag

SEQ ID NO: 3451 - DNA, 21 bp, synthetic construct
  misc_feature 1..21: note = Synthetic Construct
  source 1..21: mol_type = other DNA
ccagccttggttgtcctggtt

SEQ ID NO: 3452 - DNA, 27 bp, synthetic construct
  misc_feature 1..27: note = Synthetic Construct
  source 1..27: mol_type = other DNA
ggaaggtaatacagcctgatgggagaa

SEQ ID NO: 3453 - DNA, 21 bp, synthetic construct
  misc_feature 1..21: note = Synthetic Construct
  source 1..21: mol_type = other DNA
gcaagcagtgtctggcaaatc

SEQ ID NO: 3454 - DNA, 22 bp, synthetic construct
  misc_feature 1..22: note = Synthetic Construct
  source 1..22: mol_type = other DNA
ccaactgcttcctgctgactgt

SEQ ID NO: 3455 - DNA, 22 bp, synthetic construct
  misc_feature 1..22: note = Synthetic Construct
  source 1..22: mol_type = other DNA
ggtactaatgccgctgatgctt

SEQ ID NO: 3456 - DNA, 24 bp, synthetic construct
  misc_feature 1..24: note = Synthetic Construct
  source 1..24: mol_type = other DNA
gtggtttaagtgcggactgtgttg

SEQ ID NO: 3457 - DNA, 21 bp, synthetic construct
  misc_feature 1..21: note = Synthetic Construct
  source 1..21: mol_type = other DNA
tgagggaggtcggcacctaaa

SEQ ID NO: 3458 - DNA, 19 bp, synthetic construct
  misc_feature 1..19: note = Synthetic Construct
  source 1..19: mol_type = other DNA
ggagcaggtccccagtgaa

SEQ ID NO: 3459 - DNA, 20 bp, synthetic construct
  misc_feature 1..20: note = Synthetic Construct
  source 1..20: mol_type = other DNA
agtgctgagggtggcagaca

SEQ ID NO: 3460 - DNA, 25 bp, synthetic construct
  misc_feature 1..25: note = Synthetic Construct
  source 1..25: mol_type = other DNA
gttctcaaatcaatccatggcaact

SEQ ID NO: 3461 - DNA, 23 bp, synthetic construct
  misc_feature 1..23: note = Synthetic Construct
  source 1..23: mol_type = other DNA
ccttctccagcttcccaggatac

SEQ ID NO: 3462 - DNA, 19 bp, synthetic construct
  misc_feature 1..19: note = Synthetic Construct
  source 1..19: mol_type = other DNA
aggcgatggcacgctgtct

SEQ ID NO: 3463 - DNA, 23 bp, synthetic construct
  misc_feature 1..23: note = Synthetic Construct
  source 1..23: mol_type = other DNA
caacatccaacagagccgatttt

SEQ ID NO: 3464 - DNA, 20 bp, synthetic construct
  misc_feature 1..20: note = Synthetic Construct
  source 1..20: mol_type = other DNA
acacaaggggcacccagaaa

SEQ ID NO: 3465 - DNA, 27 bp, synthetic construct
  misc_feature 1..27: note = Synthetic Construct
  source 1..27: mol_type = other DNA
gcttcaggggagataaggaaatcaaga

SEQ ID NO: 3466 - DNA, 25 bp, synthetic construct
  misc_feature 1..25: note = Synthetic Construct
  source 1..25: mol_type = other DNA
gcaatcacccaagaccaaacccaat

SEQ ID NO: 3467 - DNA, 19 bp, synthetic construct
  misc_feature 1..19: note = Synthetic Construct
  source 1..19: mol_type = other DNA
caaggggctgccttcttga

SEQ ID NO: 3468 - DNA, 20 bp, synthetic construct
  misc_feature 1..20: note = Synthetic Construct
  source 1..20: mol_type = other DNA
tgccccatttccctcagagt

SEQ ID NO: 3469 - DNA, 22 bp, synthetic construct
  misc_feature 1..22: note = Synthetic Construct
  source 1..22: mol_type = other DNA
tttgtggagaaggcaagtgtca

SEQ ID NO: 3470 - DNA, 20 bp, synthetic construct
  misc_feature 1..20: note = Synthetic Construct
  source 1..20: mol_type = other DNA
gcctgtgccatcagccaact

SEQ ID NO: 3471 - DNA, 22 bp, synthetic construct
  misc_feature 1..22: note = Synthetic Construct
  source 1..22: mol_type = other DNA
aaccagatacacctgcatgctt

SEQ ID NO: 3472 - DNA, 19 bp, synthetic construct
  misc_feature 1..19: note = Synthetic Construct
  source 1..19: mol_type = other DNA
atgccggggaaagccagaa

SEQ ID NO: 3473 - DNA, 22 bp, synthetic construct
  misc_feature 1..22: note = Synthetic Construct
  source 1..22: mol_type = other DNA
ccatctgtgctggccaatccta

SEQ ID NO: 3474 - DNA, 21 bp, synthetic construct
  misc_feature 1..21: note = Synthetic Construct
  source 1..21: mol_type = other DNA
ttcccaccatccgagactttg

SEQ ID NO: 3475 - DNA, 18 bp, synthetic construct
  misc_feature 1..18: note = Synthetic Construct
  source 1..18: mol_type = other DNA
tgtgccctgggacactga

SEQ ID NO: 3476 - DNA, 21 bp, synthetic construct
  misc_feature 1..21: note = Synthetic Construct
  source 1..21: mol_type = other DNA
gctgggtctggacccttctaa

SEQ ID NO: 3477 - DNA, 24 bp, synthetic construct
  misc_feature 1..24: note = Synthetic Construct
  source 1..24: mol_type = other DNA
ggtgtgctggaccgagattctaac

SEQ ID NO: 3478 - DNA, 20 bp, synthetic construct
  misc_feature 1..20: note = Synthetic Construct
  source 1..20: mol_type = other DNA
tgcacgcactctcccttatg

SEQ ID NO: 3479 - DNA, 22 bp, synthetic construct
  misc_feature 1..22: note = Synthetic Construct
  source 1..22: mol_type = other DNA
ggaatgctgccacttggtgtag

SEQ ID NO: 3480 - DNA, 20 bp, synthetic construct
  misc_feature 1..20: note = Synthetic Construct
  source 1..20: mol_type = other DNA
acacccacccatctctcctt

SEQ ID NO: 3481 - DNA, 19 bp, synthetic construct
  misc_feature 1..19: note = Synthetic Construct
  source 1..19: mol_type = other DNA
tgccccaggccagaagcat

SEQ ID NO: 3482 - DNA, 19 bp, synthetic construct
  misc_feature 1..19: note = Synthetic Construct
  source 1..19: mol_type = other DNA
ccgacggcagaacggaaac

SEQ ID NO: 3483 - DNA, 18 bp, synthetic construct
  misc_feature 1..18: note = Synthetic Construct
  source 1..18: mol_type = other DNA
agggcaccagaggtgaca

SEQ ID NO: 3484 - DNA, 20 bp, synthetic construct
  misc_feature 1..20: note = Synthetic Construct
  source 1..20: mol_type = other DNA
tggcaggtgctgctgtcaga

SEQ ID NO: 3485 - DNA, 20 bp, synthetic construct
  misc_feature 1..20: note = Synthetic Construct
  source 1..20: mol_type = other DNA
tgttccctgcggtaggatgt

SEQ ID NO: 3486 - DNA, 22 bp, synthetic construct
  misc_feature 1..22: note = Synthetic Construct
  source 1..22: mol_type = other DNA
gcccttgtgctttggggttcaa

SEQ ID NO: 3487 - DNA, 23 bp, synthetic construct
  misc_feature 1..23: note = Synthetic Construct
  source 1..23: mol_type = other DNA
tccttactgctcagcatggatct

SEQ ID NO: 3488 - DNA, 26 bp, synthetic construct
  misc_feature 1..26: note = Synthetic Construct
  source 1..26: mol_type = other DNA
ggaaacctcctatagtacggccagaa

SEQ ID NO: 3489 - DNA, 21 bp, synthetic construct
  misc_feature 1..21: note = Synthetic Construct
  source 1..21: mol_type = other DNA
caccagccatggacaacaagt

SEQ ID NO: 3490 - DNA, 22 bp, synthetic construct
  misc_feature 1..22: note = Synthetic Construct
  source 1..22: mol_type = other DNA
gcctcctggtattcctgtgcta

SEQ ID NO: 3491 - DNA, 23 bp, synthetic construct
  misc_feature 1..23: note = Synthetic Construct
  source 1..23: mol_type = other DNA
ccgggaaatcagaggtgggtaac

SEQ ID NO: 3492 - DNA, 22 bp, synthetic construct
  misc_feature 1..22: note = Synthetic Construct
  source 1..22: mol_type = other DNA
gtccatcaggaagcaagcacat

SEQ ID NO: 3493 - DNA, 22 bp, synthetic construct
  misc_feature 1..22: note = Synthetic Construct
  source 1..22: mol_type = other DNA
ccagcaagaggaaactgcgtaa

SEQ ID NO: 3494 - DNA, 25 bp, synthetic construct
  misc_feature 1..25: note = Synthetic Construct
  source 1..25: mol_type = other DNA
gggcagtagaaggtatcagcagtgt

SEQ ID NO: 3495 - DNA, 22 bp, synthetic construct
  misc_feature 1..22: note = Synthetic Construct
  source 1..22: mol_type = other DNA
gtgccttacttcgggagctttc

SEQ ID NO: 3496 - DNA, 18 bp, synthetic construct
  misc_feature 1..18: note = Synthetic Construct
  source 1..18: mol_type = other DNA
tgctgcgggtgaggttca

SEQ ID NO: 3497 - DNA, 21 bp, synthetic construct
  misc_feature 1..21: note = Synthetic Construct
  source 1..21: mol_type = other DNA
cccaatccgagctgcagtcat

SEQ ID NO: 3498 - DNA, 23 bp, synthetic construct
  misc_feature 1..23: note = Synthetic Construct
  source 1..23: mol_type = other DNA
tcctccatctaactcctgctcat

SEQ ID NO: 3499 - DNA, 24 bp, synthetic construct
  misc_feature 1..24: note = Synthetic Construct
  source 1..24: mol_type = other DNA
ctgccttgataactctgggcattg

SEQ ID NO: 3500 - DNA, 19 bp, synthetic construct
  misc_feature 1..19: note = Synthetic Construct
  source 1..19: mol_type = other DNA
ctggggtacccagggatgt

SEQ ID NO: 3501 - DNA, 20 bp, synthetic construct
  misc_feature 1..20: note = Synthetic Construct
  source 1..20: mol_type = other DNA
tgggccagggctgtaatcta

SEQ ID NO: 3502 - DNA, 20 bp, synthetic construct
  misc_feature 1..20: note = Synthetic Construct
  source 1..20: mol_type = other DNA
accggccgaggggtctttga

SEQ ID NO: 3503 - DNA, 21 bp, synthetic construct
  misc_feature 1..21: note = Synthetic Construct
  source 1..21: mol_type = other DNA
tcccttccccacctctctttc

SEQ ID NO: 3504 - DNA, 20 bp, synthetic construct
  misc_feature 1..20: note = Synthetic Construct
  source 1..20: mol_type = other DNA
ccgaaagctctgccaggaaa

SEQ ID NO: 3505 - DNA, 24 bp, synthetic construct
  misc_feature 1..24: note = Synthetic Construct
  source 1..24: mol_type = other DNA
gtgccaatttttgtggggctgata

SEQ ID NO: 3506 - DNA, 21 bp, synthetic construct
  misc_feature 1..21: note = Synthetic Construct
  source 1..21: mol_type = other DNA
cctctccaccaagcacagcat

SEQ ID NO: 3507 - DNA, 22 bp, synthetic construct
  misc_feature 1..22: note = Synthetic Construct
  source 1..22: mol_type = other DNA
ctgccactgtccatccacatct

SEQ ID NO: 3508 - DNA, 20 bp, synthetic construct
  misc_feature 1..20: note = Synthetic Construct
  source 1..20: mol_type = other DNA
tgcaaagtgcatggcacaga

SEQ ID NO: 3509 - DNA, 19 bp, synthetic construct
  misc_feature 1..19: note = Synthetic Construct
  source 1..19: mol_type = other DNA
ggtggcgctgtctctccat

SEQ ID NO: 3510 - DNA, 22 bp, synthetic construct
  misc_feature 1..22: note = Synthetic Construct
  source 1..22: mol_type = other DNA
tcctggcatcaagactgtgaac

SEQ ID NO: 3511 - DNA, 26 bp, synthetic construct
  misc_feature 1..26: note = Synthetic Construct
  source 1..26: mol_type = other DNA
gtctttgtttacctccagggttccta

SEQ ID NO: 3512 - DNA, 24 bp, synthetic construct
  misc_feature 1..24: note = Synthetic Construct
  source 1..24: mol_type = other DNA
ccatctctgcattcccaaatggat

SEQ ID NO: 3513 - DNA, 24 bp, synthetic construct
  misc_feature 1..24: note = Synthetic Construct
  source 1..24: mol_type = other DNA
ccctctgttttcagctccactttc

SEQ ID NO: 3514 - DNA, 23 bp, synthetic construct
  misc_feature 1..23: note = Synthetic Construct
  source 1..23: mol_type = other DNA
cagacttcacccactttgctctt

SEQ ID NO: 3515 - DNA, 20 bp, synthetic construct
  misc_feature 1..20: note = Synthetic Construct
  source 1..20: mol_type = other DNA
tgggctgagcggctttctta

SEQ ID NO: 3516 - DNA, 24 bp, synthetic construct
  misc_feature 1..24: note = Synthetic Construct
  source 1..24: mol_type = other DNA
gggatagcccttgtggctactttc

SEQ ID NO: 3517 - DNA, 27 bp, synthetic construct
  misc_feature 1..27: note = Synthetic Construct
  source 1..27: mol_type = other DNA
tcccattggaaagtatggactacaaag

SEQ ID NO: 3518 - DNA, 24 bp, synthetic construct
  misc_feature 1..24: note = Synthetic Construct
  source 1..24: mol_type = other DNA
gttcaggagtaaggaatggaccaa

SEQ ID NO: 3519 - DNA, 20 bp, synthetic construct
  misc_feature 1..20: note = Synthetic Construct
  source 1..20: mol_type = other DNA
acttggcaggaagggtggat

SEQ ID NO: 3520 - DNA, 18 bp, synthetic construct
  misc_feature 1..18: note = Synthetic Construct
  source 1..18: mol_type = other DNA
tccacccctgccccaaat

SEQ ID NO: 3521 - DNA, 22 bp, synthetic construct
  misc_feature 1..22: note = Synthetic Construct
  source 1..22: mol_type = other DNA
ggcagacgggattcagttgcta

SEQ ID NO: 3522 - DNA, 18 bp, synthetic construct
  misc_feature 1..18: note = Synthetic Construct
  source 1..18: mol_type = other DNA
accatgctggcccacagt

SEQ ID NO: 3523 - DNA, 21 bp, synthetic construct
  misc_feature 1..21: note = Synthetic Construct
  source 1..21: mol_type = other DNA
gggactttcccaggccatgta

SEQ ID NO: 3524 - DNA, 26 bp, synthetic construct
  misc_feature 1..26: note = Synthetic Construct
  source 1..26: mol_type = other DNA
gtcttgtgctgaatgctgaatggttt

SEQ ID NO: 3525 - DNA, 19 bp, synthetic construct
  misc_feature 1..19: note = Synthetic Construct
  source 1..19: mol_type = other DNA
cctggctccatgggtcact

SEQ ID NO: 3526 - DNA, 19 bp, synthetic construct
  misc_feature 1..19: note = Synthetic Construct
  source 1..19: mol_type = other DNA
tctggggtgccaccagcaa

SEQ ID NO: 3527 - DNA, 22 bp, synthetic construct
  misc_feature 1..22: note = Synthetic Construct
  source 1..22: mol_type = other DNA
gcctcttcatacctgcagaact

SEQ ID NO: 3528 - DNA, 22 bp, synthetic construct
  misc_feature 1..22: note = Synthetic Construct
  source 1..22: mol_type = other DNA
gcaggtggagtctgaagtgtca

SEQ ID NO: 3529 - DNA, 26 bp, synthetic construct
  misc_feature 1..26: note = Synthetic Construct
  source 1..26: mol_type = other DNA
gtcctcattatccactccttccctta

SEQ ID NO: 3530 - DNA, 21 bp, synthetic construct
  misc_feature 1..21: note = Synthetic Construct
  source 1..21: mol_type = other DNA
aggctgcagaacagcaaagat

SEQ ID NO: 3531 - DNA, 22 bp, synthetic construct
  misc_feature 1..22: note = Synthetic Construct
  source 1..22: mol_type = other DNA
ctggtgggccttatggacaaga

SEQ ID NO: 3532 - DNA, 24 bp, synthetic construct
  misc_feature 1..24: note = Synthetic Construct
  source 1..24: mol_type = other DNA
ctggggccagagtctgattcttag

SEQ ID NO: 3533 - DNA, 22 bp, synthetic construct
  misc_feature 1..22: note = Synthetic Construct
  source 1..22: mol_type = other DNA
gcactggagatgaggctgcttt

SEQ ID NO: 3534 - DNA, 20 bp, synthetic construct
  misc_feature 1..20: note = Synthetic Construct
  source 1..20: mol_type = other DNA
tttctgccccacctgcacaa

SEQ ID NO: 3535 - DNA, 24 bp, synthetic construct
  misc_feature 1..24: note = Synthetic Construct
  source 1..24: mol_type = other DNA
ccaaaactatctcaggtgcaggaa

SEQ ID NO: 3536 - DNA, 22 bp, synthetic construct
  misc_feature 1..22: note = Synthetic Construct
  source 1..22: mol_type = other DNA
cctctggcaaagcacccattca

SEQ ID NO: 3537 - DNA, 20 bp, synthetic construct
  misc_feature 1..20: note = Synthetic Construct
  source 1..20: mol_type = other DNA
agagccaagaggctgcaaca

SEQ ID NO: 3538 - DNA, 22 bp, synthetic construct
  misc_feature 1..22: note = Synthetic Construct
  source 1..22: mol_type = other DNA
gcagtgagccagtagccttttg

SEQ ID NO: 3539 - DNA, 23 bp, synthetic construct
  misc_feature 1..23: note = Synthetic Construct
  source 1..23: mol_type = other DNA
gctccaaggtactagtgctgcat

SEQ ID NO: 3540 - DNA, 22 bp, synthetic construct
  misc_feature 1..22: note = Synthetic Construct
  source 1..22: mol_type = other DNA
ggccaacctctgtaccttcagt

SEQ ID NO: 3541 - DNA, 23 bp, synthetic construct
  misc_feature 1..23: note = Synthetic Construct
  source 1..23: mol_type = other DNA
cacttctcagtctctcccctttg

SEQ ID NO: 3542 - DNA, 22 bp, synthetic construct
  misc_feature 1..22: note = Synthetic Construct
  source 1..22: mol_type = other DNA
ctcctggtttgcctggtactct

SEQ ID NO: 3543 - DNA, 20 bp, synthetic construct
  misc_feature 1..20: note = Synthetic Construct
  source 1..20: mol_type = other DNA
agggagggaccagtcaactt

SEQ ID NO: 3544 - DNA, 29 bp, synthetic construct
  misc_feature 1..29: note = Synthetic Construct
  source 1..29: mol_type = other DNA
gccctacaggtttacatgcaaagatattc

SEQ ID NO: 3545 - DNA, 21 bp, synthetic construct
  misc_feature 1..21: note = Synthetic Construct
  source 1..21: mol_type = other DNA
gctgtccatgcagagctaagt

SEQ ID NO: 3546 - DNA, 22 bp, synthetic construct
  misc_feature 1..22: note = Synthetic Construct
  source 1..22: mol_type = other DNA
gaatgaactggcaggcatctgt

SEQ ID NO: 3547 - DNA, 22 bp, synthetic construct
  misc_feature 1..22: note = Synthetic Construct
  source 1..22: mol_type = other DNA
ggctaagggaatgccgacataa

SEQ ID NO: 3548 - DNA, 20 bp, synthetic construct
  misc_feature 1..20: note = Synthetic Construct
  source 1..20: mol_type = other DNA
gccagaagggaatcgccaat

SEQ ID NO: 3549 - DNA, 20 bp, synthetic construct
  misc_feature 1..20: note = Synthetic Construct
  source 1..20: mol_type = other DNA
ttccatccccggagcaactt

SEQ ID NO: 3550 - DNA, 21 bp, synthetic construct
  misc_feature 1..21: note = Synthetic Construct
  source 1..21: mol_type = other DNA
ttgaaggaagtggcagccttt

SEQ ID NO: 3551 - DNA, 20 bp, synthetic construct
  misc_feature 1..20: note = Synthetic Construct
  source 1..20: mol_type = other DNA
gccttccctggagctcgtta

SEQ ID NO: 3552 - DNA, 26 bp, synthetic construct
  misc_feature 1..26: note = Synthetic Construct
  source 1..26: mol_type = other DNA
ctgaaatggcagcctttatgttcatc

SEQ ID NO: 3553 - DNA, 20 bp, synthetic construct
  misc_feature 1..20: note = Synthetic Construct
  source 1..20: mol_type = other DNA
ttcctcggagtgctgctttg

SEQ ID NO: 3554 - DNA, 20 bp, synthetic construct
  misc_feature 1..20: note = Synthetic Construct
  source 1..20: mol_type = other DNA
tggagctggcaggagtcagt

SEQ ID NO: 3555 - DNA, 20 bp, synthetic construct
  misc_feature 1..20: note = Synthetic Construct
  source 1..20: mol_type = other DNA
gggctgtgaggtttgtgtca

SEQ ID NO: 3556 - DNA, 22 bp, synthetic construct
  misc_feature 1..22: note = Synthetic Construct
  source 1..22: mol_type = other DNA
gctcagggcttgcacattcctt

SEQ ID NO: 3557 - DNA, 22 bp, synthetic construct
  misc_feature 1..22: note = Synthetic Construct
  source 1..22: mol_type = other DNA
tgccctaacttctcctgcattg

SEQ ID NO: 3558 - DNA, 21 bp, synthetic construct
  misc_feature 1..21: note = Synthetic Construct
  source 1..21: mol_type = other DNA
accaggccttccttctagtca

SEQ ID NO: 3559 - DNA, 20 bp, synthetic construct
  misc_feature 1..20: note = Synthetic Construct
  source 1..20: mol_type = other DNA
gggtgagccgaatgttcact

SEQ ID NO: 3560 - DNA, 22 bp, synthetic construct
  misc_feature 1..22: note = Synthetic Construct
  source 1..22: mol_type = other DNA
cccagccagagaggtatcaact

SEQ ID NO: 3561 - DNA, 23 bp, synthetic construct
  misc_feature 1..23: note = Synthetic Construct
  source 1..23: mol_type = other DNA
gctactttgcagctaccactgaa

SEQ ID NO: 3562 - DNA, 26 bp, synthetic construct
  misc_feature 1..26: note = Synthetic Construct
  source 1..26: mol_type = other DNA
ctgaagtatcatctcttccccggatt

SEQ ID NO: 3563 - DNA, 22 bp, synthetic construct
  misc_feature 1..22: note = Synthetic Construct
  source 1..22: mol_type = other DNA
cagaggggtaggatgcatgaga

SEQ ID NO: 3564 - DNA, 26 bp, synthetic construct
  misc_feature 1..26: note = Synthetic Construct
  source 1..26: mol_type = other DNA
ctgatgctagatcctccttctacttg

SEQ ID NO: 3565 - DNA, 20 bp, synthetic construct
  misc_feature 1..20: note = Synthetic Construct
  source 1..20: mol_type = other DNA
ggcaataggagcctgcagat

SEQ ID NO: 3566 - DNA, 20 bp, synthetic construct
  misc_feature 1..20: note = Synthetic Construct
  source 1..20: mol_type = other DNA
gggctgttgggccaagattt

SEQ ID NO: 3567 - DNA, 27 bp, synthetic construct
  misc_feature 1..27: note = Synthetic Construct
  source 1..27: mol_type = other DNA
cccaactatttttgggttaggaagaac

SEQ ID NO: 3568 - DNA, 22 bp, synthetic construct
  misc_feature 1..22: note = Synthetic Construct
  source 1..22: mol_type = other DNA
gggtgacacctgaggttcttga

SEQ ID NO: 3569 - DNA, 22 bp, synthetic construct
  misc_feature 1..22: note = Synthetic Construct
  source 1..22: mol_type = other DNA
cccaaaatgcctcctgggaaac

SEQ ID NO: 3570 - DNA, 25 bp, synthetic construct
  misc_feature 1..25: note = Synthetic Construct
  source 1..25: mol_type = other DNA
ggaacatctcatggtcacgtatttg

SEQ ID NO: 3571 - DNA, 25 bp, synthetic construct
  misc_feature 1..25: note = Synthetic Construct
  source 1..25: mol_type = other DNA
ggtctagggtctcaatttggtcagt

SEQ ID NO: 3572 - DNA, 24 bp, synthetic construct
  misc_feature 1..24: note = Synthetic Construct
  source 1..24: mol_type = other DNA
ccctttggatgactcttcgcacat

SEQ ID NO: 3573 - DNA, 20 bp, synthetic construct
  misc_feature 1..20: note = Synthetic Construct
  source 1..20: mol_type = other DNA
ccactgccaccactgacaaa

SEQ ID NO: 3574 - DNA, 23 bp, synthetic construct
  misc_feature 1..23: note = Synthetic Construct
  source 1..23: mol_type = other DNA
gagtggtttcccatcagggatga

SEQ ID NO: 3575 - DNA, 21 bp, synthetic construct
  misc_feature 1..21: note = Synthetic Construct
  source 1..21: mol_type = other DNA
ggcaaaactgcaacactgtga

SEQ ID NO: 3576 - DNA, 24 bp, synthetic construct
  misc_feature 1..24: note = Synthetic Construct
  source 1..24: mol_type = other DNA
tgcaggtttctcacataactcctt

SEQ ID NO: 3577 - DNA, 24 bp, synthetic construct
  misc_feature 1..24: note = Synthetic Construct
  source 1..24: mol_type = other DNA
ttctctccagcagcactctttatt

SEQ ID NO: 3578 - DNA, 20 bp, synthetic construct
  misc_feature 1..20: note = Synthetic Construct
  source 1..20: mol_type = other DNA
ctgtggcccatgaagcatct

SEQ ID NO: 3579 - DNA, 21 bp, synthetic construct
  misc_feature 1..21: note = Synthetic Construct
  source 1..21: mol_type = other DNA
tgtctgcttcctagcgtcttc

SEQ ID NO: 3580 - DNA, 27 bp, synthetic construct
  misc_feature 1..27: note = Synthetic Construct
  source 1..27: mol_type = other DNA
cacacatttcaggagcttgatctcatc

SEQ ID NO: 3581 - DNA, 26 bp, synthetic construct
  misc_feature 1..26: note = Synthetic Construct
  source 1..26: mol_type = other DNA
ggaaccatgttcctttccaggttgtt

SEQ ID NO: 3582 - DNA, 23 bp, synthetic construct
  misc_feature 1..23: note = Synthetic Construct
  source 1..23: mol_type = other DNA
tcatcatcccagagacacagcta

SEQ ID NO: 3583 - DNA, 24 bp, synthetic construct
  misc_feature 1..24: note = Synthetic Construct
  source 1..24: mol_type = other DNA
ccttgtgctgctaaccatgagact

SEQ ID NO: 3584 - DNA, 24 bp, synthetic construct
  misc_feature 1..24: note = Synthetic Construct
  source 1..24: mol_type = other DNA
ggaccctagtgattctcccatcat

SEQ ID NO: 3585 - DNA, 22 bp, synthetic construct
  misc_feature 1..22: note = Synthetic Construct
  source 1..22: mol_type = other DNA
cacacttttcggtggtgccttt

SEQ ID NO: 3586 - DNA, 22 bp, synthetic construct
  misc_feature 1..22: note = Synthetic Construct
  source 1..22: mol_type = other DNA
aggagccaagaacaaggagaag

SEQ ID NO: 3587 - DNA, 23 bp, synthetic construct
  misc_feature 1..23: note = Synthetic Construct
  source 1..23: mol_type = other DNA
tggccataacagagtaggtgtga

SEQ ID NO: 3588 - DNA, 20 bp, synthetic construct
  misc_feature 1..20: note = Synthetic Construct
  source 1..20: mol_type = other DNA
tagccccacgtgtcttccta

SEQ ID NO: 3589 - DNA, 24 bp, synthetic construct
  misc_feature 1..24: note = Synthetic Construct
  source 1..24: mol_type = other DNA
acttgttcacttgctaggggatac

SEQ ID NO: 3590 - DNA, 22 bp, synthetic construct
  misc_feature 1..22: note = Synthetic Construct
  source 1..22: mol_type = other DNA
cagagagaaggaggcccaaaga

SEQ ID NO: 3591 - DNA, 22 bp, synthetic construct
  misc_feature 1..22: note = Synthetic Construct
  source 1..22: mol_type = other DNA
tgtcagtaacggtggagaccta

SEQ ID NO: 3592 - DNA, 24 bp, synthetic construct
  misc_feature 1..24: note = Synthetic Construct
  source 1..24: mol_type = other DNA
gccttttaattagccttgcagctt

SEQ ID NO: 3593 - DNA, 20 bp, synthetic construct
  misc_feature 1..20: note = Synthetic Construct
  source 1..20: mol_type = other DNA
agtgggagcctcgtaagcat

SEQ ID NO: 3594 - DNA, 24 bp, synthetic construct
  misc_feature 1..24: note = Synthetic Construct
  source 1..24: mol_type = other DNA
ggaataggtaggtgcaagcagttg

SEQ ID NO: 3595 - DNA, 25 bp, synthetic construct
  misc_feature 1..25: note = Synthetic Construct
  source 1..25: mol_type = other DNA
atccacaatttccctaggctagaag

SEQ ID NO: 3596 - DNA, 25 bp, synthetic construct
  misc_feature 1..25: note = Synthetic Construct
  source 1..25: mol_type = other DNA
gcctagggttctcttccttcccttt

SEQ ID NO: 3597 - DNA, 20 bp, synthetic construct
  misc_feature 1..20: note = Synthetic Construct
  source 1..20: mol_type = other DNA
tggttccccgagctcttttc

SEQ ID NO: 3598 - DNA, 25 bp, synthetic construct
  misc_feature 1..25: note = Synthetic Construct
  source 1..25: mol_type = other DNA
tgggtctagaaggaaactgactttg

SEQ ID NO: 3599 - DNA, 21 bp, synthetic construct
  misc_feature 1..21: note = Synthetic Construct
  source 1..21: mol_type = other DNA
gggctcagggagaaaatcaca

SEQ ID NO: 3600 - DNA, 21 bp, synthetic construct
  misc_feature 1..21: note = Synthetic Construct
  source 1..21: mol_type = other DNA
tgagtcttacggggacgaagt

SEQ ID NO: 3601 - DNA, 21 bp, synthetic construct
  misc_feature 1..21: note = Synthetic Construct
  source 1..21: mol_type = other DNA
gtgtcgtgcctgctaggtatt

SEQ ID NO: 3602 - DNA, 20 bp, synthetic construct
  misc_feature 1..20: note = Synthetic Construct
  source 1..20: mol_type = other DNA
tgtgccaggcccaaaagctt

SEQ ID NO: 3603 - DNA, 19 bp, synthetic construct
  misc_feature 1..19: note = Synthetic Construct
  source 1..19: mol_type = other DNA
tctgcttctgccggcattc

SEQ ID NO: 3604 - DNA, 22 bp, synthetic construct
  misc_feature 1..22: note = Synthetic Construct
  source 1..22: mol_type = other DNA
aggaactgtcagattgcaacca

SEQ ID NO: 3605 - DNA, 21 bp, synthetic construct
  misc_feature 1..21: note = Synthetic Construct
  source 1..21: mol_type = other DNA
ccaccaggtgctctcaactct

SEQ ID NO: 3606 - DNA, 22 bp, synthetic construct
  misc_feature 1..22: note = Synthetic Construct
  source 1..22: mol_type = other DNA
tcccacacacgtgtctgtatct

SEQ ID NO: 3607 - DNA, 24 bp, synthetic construct
  misc_feature 1..24: note = Synthetic Construct
  source 1..24: mol_type = other DNA
agaagggcaaggaaacataacctt

SEQ ID NO: 3608 - DNA, 24 bp, synthetic construct
  misc_feature 1..24: note = Synthetic Construct
  source 1..24: mol_type = other DNA
ccactcctggcccttttctctttt

SEQ ID NO: 3609 - DNA, 19 bp, synthetic construct
  misc_feature 1..19: note = Synthetic Construct
  source 1..19: mol_type = other DNA
aacttggggccaggctcta

SEQ ID NO: 3610 - DNA, 25 bp, synthetic construct
  misc_feature 1..25: note = Synthetic Construct
  source 1..25: mol_type = other DNA
ccacgatgaaaaacagaaaccaaac

SEQ ID NO: 3611 - DNA, 21 bp, synthetic construct
  misc_feature 1..21: note = Synthetic Construct
  source 1..21: mol_type = other DNA
ggttgcaaacccctcctcttt

SEQ ID NO: 3612 - DNA, 22 bp, synthetic construct
  misc_feature 1..22: note = Synthetic Construct
  source 1..22: mol_type = other DNA
gcctttgtgtagacagccactt

SEQ ID NO: 3613 - DNA, 24 bp, synthetic construct
  misc_feature 1..24: note = Synthetic Construct
  source 1..24: mol_type = other DNA
tgtgtgcataaagggtcttgaaga

SEQ ID NO: 3614 - DNA, 20 bp, synthetic construct
  misc_feature 1..20: note = Synthetic Construct
  source 1..20: mol_type = other DNA
acccttccctgccactgttt

SEQ ID NO: 3615 - DNA, 23 bp, synthetic construct
  misc_feature 1..23: note = Synthetic Construct
  source 1..23: mol_type = other DNA
tagccgtagctcagatcctagct

SEQ ID NO: 3616 - DNA, 21 bp, synthetic construct
  misc_feature 1..21: note = Synthetic Construct
  source 1..21: mol_type = other DNA
tcatggtgccctggcctcact

SEQ ID NO: 3617 - DNA, 24 bp, synthetic construct
  misc_feature 1..24: note = Synthetic Construct
  source 1..24: mol_type = other DNA
ctccaagccacagaactcaacatg

SEQ ID NO: 3618 - DNA, 20 bp, synthetic construct
  misc_feature 1..20: note = Synthetic Construct
  source 1..20: mol_type = other DNA
gcctcaccatggctctgatc

SEQ ID NO: 3619 - DNA, 18 bp, synthetic construct
  misc_feature 1..18: note = Synthetic Construct
  source 1..18: mol_type = other DNA
ccaggtccccccaaacac

SEQ ID NO: 3620 - DNA, 23 bp, synthetic construct
  misc_feature 1..23: note = Synthetic Construct
  source 1..23: mol_type = other DNA
tccagtgctcactcactctcctt

SEQ ID NO: 3621 - DNA, 22 bp, synthetic construct
  misc_feature 1..22: note = Synthetic Construct
  source 1..22: mol_type = other DNA
gagtagtgcatgcacacagtga

SEQ ID NO: 3622 - DNA, 20 bp, synthetic construct
  misc_feature 1..20: note = Synthetic Construct
  source 1..20: mol_type = other DNA
tgggcctcattcccaagttc

SEQ ID NO: 3623 - DNA, 26 bp, synthetic construct
  misc_feature 1..26: note = Synthetic Construct
  source 1..26: mol_type = other DNA
ggcttctgcagaataacatcctgatt

SEQ ID NO: 3624 - DNA, 18 bp, synthetic construct
  misc_feature 1..18: note = Synthetic Construct
  source 1..18: mol_type = other DNA
tccagcctcagcctggtt

SEQ ID NO: 3625 - DNA, 21 bp, synthetic construct
  misc_feature 1..21: note = Synthetic Construct
  source 1..21: mol_type = other DNA
tgcatggccagacaatatggt

SEQ ID NO: 3626 - DNA, 24 bp, synthetic construct
  misc_feature 1..24: note = Synthetic Construct
  source 1..24: mol_type = other DNA
gaaagttgtgttcccaaggctttg

SEQ ID NO: 3627 - DNA, 26 bp, synthetic construct
  misc_feature 1..26: note = Synthetic Construct
  source 1..26: mol_type = other DNA
gtatgactccccttaaggatgagaag

SEQ ID NO: 3628 - DNA, 20 bp, synthetic construct
  misc_feature 1..20: note = Synthetic Construct
  source 1..20: mol_type = other DNA
agcagcatgatgccaacgaa

SEQ ID NO: 3629 - DNA, 25 bp, synthetic construct
  misc_feature 1..25: note = Synthetic Construct
  source 1..25: mol_type = other DNA
ggctcatctttgccagttatttcca

SEQ ID NO: 3630 - DNA, 23 bp, synthetic construct
  misc_feature 1..23: note = Synthetic Construct
  source 1..23: mol_type = other DNA
gctgttccatggagcaatcactt

SEQ ID NO: 3631 - DNA, 23 bp, synthetic construct
  misc_feature 1..23: note = Synthetic Construct
  source 1..23: mol_type = other DNA
aaaaatggcccagttttgcagaa

SEQ ID NO: 3632 - DNA, 21 bp, synthetic construct
  misc_feature 1..21: note = Synthetic Construct
  source 1..21: mol_type = other DNA
aacaatccccggcccaatcct

SEQ ID NO: 3633 - DNA, 19 bp, synthetic construct
  misc_feature 1..19: note = Synthetic Construct
  source 1..19: mol_type = other DNA
tgcccaggctttccccaat

SEQ ID NO: 3634 - DNA, 20 bp, synthetic construct
  misc_feature 1..20: note = Synthetic Construct
  source 1..20: mol_type = other DNA
tgctgtctgcctcaggatga

SEQ ID NO: 3635 - DNA, 21 bp, synthetic construct
  misc_feature 1..21: note = Synthetic Construct
  source 1..21: mol_type = other DNA
gtgggacagacagcccttgtt

SEQ ID NO: 3636 - DNA, 25 bp, synthetic construct
  misc_feature 1..25: note = Synthetic Construct
  source 1..25: mol_type = other DNA
gttttcctgttcaggtgacctagtc

SEQ ID NO: 3637 - DNA, 27 bp, synthetic construct
  misc_feature 1..27: note = Synthetic Construct
  source 1..27: mol_type = other DNA
gagagctatacagaattgtggcttttc

SEQ ID NO: 3638 - DNA, 22 bp, synthetic construct
  misc_feature 1..22: note = Synthetic Construct
  source 1..22: mol_type = other DNA
cccgcagtgattccaacataga

SEQ ID NO: 3639 - DNA, 20 bp, synthetic construct
  misc_feature 1..20: note = Synthetic Construct
  source 1..20: mol_type = other DNA
tgcaaactgcgacctgaact

SEQ ID NO: 3640 - DNA, 20 bp, synthetic construct
  misc_feature 1..20: note = Synthetic Construct
  source 1..20: mol_type = other DNA
agctggggctctgaatgtga

SEQ ID NO: 3641 - DNA, 21 bp, synthetic construct
  misc_feature 1..21: note = Synthetic Construct
  source 1..21: mol_type = other DNA
cccaactgtcccctctcacta

SEQ ID NO: 3642 - DNA, 27 bp, synthetic construct
  misc_feature 1..27: note = Synthetic Construct
  source 1..27: mol_type = other DNA
ctggtttgaatgtcttggattgcttag

SEQ ID NO: 3643 - DNA, 24 bp, synthetic construct
  misc_feature 1..24: note = Synthetic Construct
  source 1..24: mol_type = other DNA
tcaacaggctaccattctttggat

SEQ ID NO: 3644 - DNA, 21 bp, synthetic construct
  misc_feature 1..21: note = Synthetic Construct
  source 1..21: mol_type = other DNA
tcccccaaagaggaactgctt

SEQ ID NO: 3645 - DNA, 25 bp, synthetic construct
  misc_feature 1..25: note = Synthetic Construct
  source 1..25: mol_type = other DNA
ggaatcccctcccctgtatttattg

SEQ ID NO: 3646 - DNA, 24 bp, synthetic construct
  misc_feature 1..24: note = Synthetic Construct
  source 1..24: mol_type = other DNA
gaaatgtcctctctggtccaagat

SEQ ID NO: 3647 - DNA, 19 bp, synthetic construct
  misc_feature 1..19: note = Synthetic Construct
  source 1..19: mol_type = other DNA
tgggctactggcactgagt

SEQ ID NO: 3648 - DNA, 22 bp, synthetic construct
  misc_feature 1..22: note = Synthetic Construct
  source 1..22: mol_type = other DNA
cacggttaagttgcacccaaac

SEQ ID NO: 3649 - DNA, 22 bp, synthetic construct
  misc_feature 1..22: note = Synthetic Construct
  source 1..22: mol_type = other DNA
aggaggtggtgagtgcagagaa

SEQ ID NO: 3650 - DNA, 18 bp, synthetic construct
  misc_feature 1..18: note = Synthetic Construct
  source 1..18: mol_type = other DNA
gctgggcgagctctttgg

SEQ ID NO: 3651 - DNA, 22 bp, synthetic construct
  misc_feature 1..22: note = Synthetic Construct
  source 1..22: mol_type = other DNA
agagtgaggagcagagacttca

SEQ ID NO: 3652 - DNA, 21 bp, synthetic construct
  misc_feature 1..21: note = Synthetic Construct
  source 1..21: mol_type = other DNA
taggcagaggcatgcctgaat

SEQ ID NO: 3653 - DNA, 21 bp, synthetic construct
  misc_feature 1..21: note = Synthetic Construct
  source 1..21: mol_type = other DNA
ttgggtgccagtttggaccaa

SEQ ID NO: 3654 - DNA, 20 bp, synthetic construct
  misc_feature 1..20: note = Synthetic Construct
  source 1..20: mol_type = other DNA
ccccagctgtcttcactgtt

SEQ ID NO: 3655 - DNA, 20 bp, synthetic construct
  misc_feature 1..20: note = Synthetic Construct
  source 1..20: mol_type = other DNA
gtgtgctcagtggacaagca

SEQ ID NO: 3656 - DNA, 21 bp, synthetic construct
  misc_feature 1..21: note = Synthetic Construct
  source 1..21: mol_type = other DNA
aggacaggggcagggagtaat

SEQ ID NO: 3657 - DNA, 24 bp, synthetic construct
  misc_feature 1..24: note = Synthetic Construct
  source 1..24: mol_type = other DNA
ggaaccacttatccagaaccagaa

SEQ ID NO: 3658 - DNA, 20 bp, synthetic construct
  misc_feature 1..20: note = Synthetic Construct
  source 1..20: mol_type = other DNA
gaggctgactcctgttgcat

SEQ ID NO: 3659 - DNA, 29 bp, synthetic construct
  misc_feature 1..29: note = Synthetic Construct
  source 1..29: mol_type = other DNA
tggaaagctacattcaattcaaagacaaa

SEQ ID NO: 3660 - DNA, 22 bp, synthetic construct
  misc_feature 1..22: note = Synthetic Construct
  source 1..22: mol_type = other DNA
ctccaaaactgatcccggcaaa

SEQ ID NO: 3661 - DNA, 24 bp, synthetic construct
  misc_feature 1..24: note = Synthetic Construct
  source 1..24: mol_type = other DNA
tgataagggctgtgctcttctaag

SEQ ID NO: 3662 - DNA, 26 bp, synthetic construct
  misc_feature 1..26: note = Synthetic Construct
  source 1..26: mol_type = other DNA
agataccgagtgggtttattcttctc

SEQ ID NO: 3663 - DNA, 25 bp, synthetic construct
  misc_feature 1..25: note = Synthetic Construct
  source 1..25: mol_type = other DNA
tgtttccccatccatcaaccatatc

SEQ ID NO: 3664 - DNA, 19 bp, synthetic construct
  misc_feature 1..19: note = Synthetic Construct
  source 1..19: mol_type = other DNA
tgcccatgcccacatccat

SEQ ID NO: 3665 - DNA, 22 bp, synthetic construct
  misc_feature 1..22: note = Synthetic Construct
  source 1..22: mol_type = other DNA
aggctatgaaccagctctcctt

SEQ ID NO: 3666 - DNA, 24 bp, synthetic construct
  misc_feature 1..24: note = Synthetic Construct
  source 1..24: mol_type = other DNA
ccacacgattcagaaagagcctta

SEQ ID NO: 3667 - DNA, 24 bp, synthetic construct
  misc_feature 1..24: note = Synthetic Construct
  source 1..24: mol_type = other DNA
cacctctacttcttcagggacaag

SEQ ID NO: 3668 - DNA, 22 bp, synthetic construct
  misc_feature 1..22: note = Synthetic Construct
  source 1..22: mol_type = other DNA
gctatgcccacacaagtacaga

SEQ ID NO: 3669 - DNA, 28 bp, synthetic construct
  misc_feature 1..28: note = Synthetic Construct
  source 1..28: mol_type = other DNA
gcatcttcattgatgggaactgtaaacc

SEQ ID NO: 3670 - DNA, 26 bp, synthetic construct
  misc_feature 1..26: note = Synthetic Construct
  source 1..26: mol_type = other DNA
gcccatatctcattgaaaggagaaca

SEQ ID NO: 3671 - DNA, 25 bp, synthetic construct
  misc_feature 1..25: note = Synthetic Construct
  source 1..25: mol_type = other DNA
ccattctaggttaggcttgacgttt

SEQ ID NO: 3672 - DNA, 19 bp, synthetic construct
  misc_feature 1..19: note = Synthetic Construct
  source 1..19: mol_type = other DNA
cttcccccgagaccaacac

SEQ ID NO: 3673 - DNA, 18 bp, synthetic construct
  misc_feature 1..18: note = Synthetic Construct
  source 1..18: mol_type = other DNA
agccaggctgagcaaggt

SEQ ID NO: 3674 - DNA, 23 bp, synthetic construct
  misc_feature 1..23: note = Synthetic Construct
  source 1..23: mol_type = other DNA
tcccaagttaacggcattttcct

SEQ ID NO: 3675 - DNA, 21 bp, synthetic construct
  misc_feature 1..21: note = Synthetic Construct
  source 1..21: mol_type = other DNA
agggcactgtggggatatcca

SEQ ID NO: 3676 - DNA, 30 bp, synthetic construct
  misc_feature 1..30: note = Synthetic Construct
  source 1..30: mol_type = other DNA
agagataacctgtctacagaaaatgcttta

SEQ ID NO: 3677 - DNA, 21 bp, synthetic construct
  misc_feature 1..21: note = Synthetic Construct
  source 1..21: mol_type = other DNA
ttcctaccccaggcagatgca

SEQ ID NO: 3678 - DNA, 20 bp, synthetic construct
  misc_feature 1..20: note = Synthetic Construct
  source 1..20: mol_type = other DNA
gccctatggcggggtgaata

SEQ ID NO: 3679 - DNA, 21 bp, synthetic construct
  misc_feature 1..21: note = Synthetic Construct
  source 1..21: mol_type = other DNA
agctcccaccctaccttagca

SEQ ID NO: 3680 - DNA, 20 bp, synthetic construct
  misc_feature 1..20: note = Synthetic Construct
  source 1..20: mol_type = other DNA
agacacggtgggttctgcat

SEQ ID NO: 3681 - DNA, 24 bp, synthetic construct
  misc_feature 1..24: note = Synthetic Construct
  source 1..24: mol_type = other DNA
tcttatgctactgggcctttcttc

SEQ ID NO: 3682 - DNA, 26 bp, synthetic construct
  misc_feature 1..26: note = Synthetic Construct
  source 1..26: mol_type = other DNA
ggtctgttgggatttcagaagctaaa

SEQ ID NO: 3683 - DNA, 19 bp, synthetic construct
  misc_feature 1..19: note = Synthetic Construct
  source 1..19: mol_type = other DNA
gaggccacactgcagtcaa

SEQ ID NO: 3684 - DNA, 27 bp, synthetic construct
  misc_feature 1..27: note = Synthetic Construct
  source 1..27: mol_type = other DNA
ccccttccattatgggatcataagtag

SEQ ID NO: 3685 - DNA, 24 bp, synthetic construct
  misc_feature 1..24: note = Synthetic Construct
  source 1..24: mol_type = other DNA
aaaggcaggaactagactgaaaca

SEQ ID NO: 3686 - DNA, 21 bp, synthetic construct
  misc_feature 1..21: note = Synthetic Construct
  source 1..21: mol_type = other DNA
tccttgaggctttcccattcc

SEQ ID NO: 3687 - DNA, 21 bp, synthetic construct
  misc_feature 1..21: note = Synthetic Construct
  source 1..21: mol_type = other DNA
gccagaaggtgccagttttgt

SEQ ID NO: 3688 - DNA, 20 bp, synthetic construct
  misc_feature 1..20: note = Synthetic Construct
  source 1..20: mol_type = other DNA
tccagggttccctcttgtga

SEQ ID NO: 3689 - DNA, 20 bp, synthetic construct
  misc_feature 1..20: note = Synthetic Construct
  source 1..20: mol_type = other DNA
tcctgggtgcagggtagact

SEQ ID NO: 3690 - DNA, 20 bp, synthetic construct
  misc_feature 1..20: note = Synthetic Construct
  source 1..20: mol_type = other DNA
tgaaacaacacgccctcagt

SEQ ID NO: 3691 - DNA, 26 bp, synthetic construct
  misc_feature 1..26: note = Synthetic Construct
  source 1..26: mol_type = other DNA
ctgaagcagaagttaactctttgctt

SEQ ID NO: 3692 - DNA, 19 bp, synthetic construct
  misc_feature 1..19: note = Synthetic Construct
  source 1..19: mol_type = other DNA
aggcagtcccgggctgact

SEQ ID NO: 3693 - DNA, 22 bp, synthetic construct
  misc_feature 1..22: note = Synthetic Construct
  source 1..22: mol_type = other DNA
tggtcttagaggcgtccagtct

SEQ ID NO: 3694 - DNA, 23 bp, synthetic construct
  misc_feature 1..23: note = Synthetic Construct
  source 1..23: mol_type = other DNA
aggggtctgtagagtagcgagat

SEQ ID NO: 3695 - DNA, 22 bp, synthetic construct
  misc_feature 1..22: note = Synthetic Construct
  source 1..22: mol_type = other DNA
gagtgttcagcagagcaccatt

SEQ ID NO: 3696 - DNA, 24 bp, synthetic construct
  misc_feature 1..24: note = Synthetic Construct
  source 1..24: mol_type = other DNA
ccaaaaccttcactctctgttgtc

SEQ ID NO: 3697 - DNA, 26 bp, synthetic construct
  misc_feature 1..26: note = Synthetic Construct
  source 1..26: mol_type = other DNA
ggagtaatgcccaactagaggttagg

SEQ ID NO: 3698 - DNA, 20 bp, synthetic construct
  misc_feature 1..20: note = Synthetic Construct
  source 1..20: mol_type = other DNA
aatgggcccttgctctgttt

SEQ ID NO: 3699 - DNA, 21 bp, synthetic construct
  misc_feature 1..21: note = Synthetic Construct
  source 1..21: mol_type = other DNA
aggatgggaaggctgtgagta

SEQ ID NO: 3700 - DNA, 21 bp, synthetic construct
  misc_feature 1..21: note = Synthetic Construct
  source 1..21: mol_type = other DNA
cagcccatccttcctgatgac

SEQ ID NO: 3701 - DNA, 24 bp, synthetic construct
  misc_feature 1..24: note = Synthetic Construct
  source 1..24: mol_type = other DNA
gaggtttcggctttagttgtgtga

SEQ ID NO: 3702 - DNA, 24 bp, synthetic construct
  misc_feature 1..24: note = Synthetic Construct
  source 1..24: mol_type = other DNA
aggagatgaccttcaaggctgtct

SEQ ID NO: 3703 - DNA, 21 bp, synthetic construct
  misc_feature 1..21: note = Synthetic Construct
  source 1..21: mol_type = other DNA
cagtggtgggaaagacagcaa

SEQ ID NO: 3704 - DNA, 24 bp, synthetic construct
  misc_feature 1..24: note = Synthetic Construct
  source 1..24: mol_type = other DNA
cctgttgggcactgcatacttttc

SEQ ID NO: 3705 - DNA, 22 bp, synthetic construct
  misc_feature 1..22: note = Synthetic Construct
  source 1..22: mol_type = other DNA
cctgattcacagaccccaagtt

SEQ ID NO: 3706 - DNA, 24 bp, synthetic construct
  misc_feature 1..24: note = Synthetic Construct
  source 1..24: mol_type = other DNA
agaaggaagtagggggagtgagat

SEQ ID NO: 3707 - DNA, 26 bp, synthetic construct
  misc_feature 1..26: note = Synthetic Construct
  source 1..26: mol_type = other DNA
tctttggcactccttccatcgagatg

SEQ ID NO: 3708 - DNA, 25 bp, synthetic construct
  misc_feature 1..25: note = Synthetic Construct
  source 1..25: mol_type = other DNA
ggacaggaattcatgacttgtggtt

SEQ ID NO: 3709 - DNA, 27 bp, synthetic construct
  misc_feature 1..27: note = Synthetic Construct
  source 1..27: mol_type = other DNA
cataggtaaaagctaggtgtggagaaa

SEQ ID NO: 3710 - DNA, 24 bp, synthetic construct
  misc_feature 1..24: note = Synthetic Construct
  source 1..24: mol_type = other DNA
ggagatttctcaccatgggaatct

SEQ ID NO: 3711 - DNA, 28 bp, synthetic construct
  misc_feature 1..28: note = Synthetic Construct
  source 1..28: mol_type = other DNA
agagatttagtttctcagttcgtaagga

SEQ ID NO: 3712 - DNA, 26 bp, synthetic construct
  misc_feature 1..26: note = Synthetic Construct
  source 1..26: mol_type = other DNA
caacctagcaaggattctactggtaa

SEQ ID NO: 3713 - DNA, 20 bp, synthetic construct
  misc_feature 1..20: note = Synthetic Construct
  source 1..20: mol_type = other DNA
ccttgctgttcctggaagct

SEQ ID NO: 3714 - DNA, 24 bp, synthetic construct
  misc_feature 1..24: note = Synthetic Construct
  source 1..24: mol_type = other DNA
ggagaaatgaggccttggagcttt

SEQ ID NO: 3715 - DNA, 27 bp, synthetic construct
  misc_feature 1..27: note = Synthetic Construct
  source 1..27: mol_type = other DNA
aagcacaatactaaacacagagtcaac

SEQ ID NO: 3716 - DNA, 26 bp, synthetic construct
  misc_feature 1..26: note = Synthetic Construct
  source 1..26: mol_type = other DNA
acaaggtgattggttctaactttggt

SEQ ID NO: 3717 - DNA, 22 bp, synthetic construct
  misc_feature 1..22: note = Synthetic Construct
  source 1..22: mol_type = other DNA
agaccacattgtaggccccata

SEQ ID NO: 3718 - DNA, 23 bp, synthetic construct
  misc_feature 1..23: note = Synthetic Construct
  source 1..23: mol_type = other DNA
tgggtcctgatctccacacttct

SEQ ID NO: 3719 - DNA, 24 bp, synthetic construct
  misc_feature 1..24: note = Synthetic Construct
  source 1..24: mol_type = other DNA
gatccctttggaggcattcaagga

SEQ ID NO: 3720 - DNA, 24 bp, synthetic construct
  misc_feature 1..24: note = Synthetic Construct
  source 1..24: mol_type = other DNA
cagcaatccagactctacctcttc

SEQ ID NO: 3721 - DNA, 26 bp, synthetic construct
  misc_feature 1..26: note = Synthetic Construct
  source 1..26: mol_type = other DNA
gccaacctttccattgtcatggttta

SEQ ID NO: 3722 - DNA, 23 bp, synthetic construct
  misc_feature 1..23: note = Synthetic Construct
  source 1..23: mol_type = other DNA
cacagaactgctcacagatagca

SEQ ID NO: 3723 - DNA, 21 bp, synthetic construct
  misc_feature 1..21: note = Synthetic Construct
  source 1..21: mol_type = other DNA
tctgcaaagtcccaccaaagg

SEQ ID NO: 3724 - DNA, 22 bp, synthetic construct
  misc_feature 1..22: note = Synthetic Construct
  source 1..22: mol_type = other DNA
ccactggggctaattgctacaa

SEQ ID NO: 3725 - DNA, 27 bp, synthetic construct
  misc_feature 1..27: note = Synthetic Construct
  source 1..27: mol_type = other DNA
gaggatacattttggggagataactgt

SEQ ID NO: 3726 - DNA, 23 bp, synthetic construct
  misc_feature 1..23: note = Synthetic Construct
  source 1..23: mol_type = other DNA
tctcagggtgcaacagacatttc

SEQ ID NO: 3727 - DNA, 20 bp, synthetic construct
  misc_feature 1..20: note = Synthetic Construct
  source 1..20: mol_type = other DNA
ggacaggcaagggagttgag

SEQ ID NO: 3728 - DNA, 23 bp, synthetic construct
  misc_feature 1..23: note = Synthetic Construct
  source 1..23: mol_type = other DNA
ctttttccagaccccagattcct

SEQ ID NO: 3729 - DNA, 24 bp, synthetic construct
  misc_feature 1..24: note = Synthetic Construct
  source 1..24: mol_type = other DNA
gaaaaggaagagccattccgtgta

SEQ ID NO: 3730 - DNA, 22 bp, synthetic construct
  misc_feature 1..22: note = Synthetic Construct
  source 1..22: mol_type = other DNA
gcaaccacaaagcagtttgttg

SEQ ID NO: 3731 - DNA, 23 bp, synthetic construct
  misc_feature 1..23: note = Synthetic Construct
  source 1..23: mol_type = other DNA
gcctgtagctagtgtctgtctct

SEQ ID NO: 3732 - DNA, 22 bp, synthetic construct
  misc_feature 1..22: note = Synthetic Construct
  source 1..22: mol_type = other DNA
tctcctgagcgtgaagttggtt

SEQ ID NO: 3733 - DNA, 21 bp, synthetic construct
  misc_feature 1..21: note = Synthetic Construct
  source 1..21: mol_type = other DNA
tggcaccatgtgttcctctct

SEQ ID NO: 3734 - DNA, 22 bp, synthetic construct
  misc_feature 1..22: note = Synthetic Construct
  source 1..22: mol_type = other DNA
gcccctttacacctgatcttga

SEQ ID NO: 3735 - DNA, 28 bp, synthetic construct
  misc_feature 1..28: note = Synthetic Construct
  source 1..28: mol_type = other DNA
gtttcaggcttagtacttaaaacagtca

SEQ ID NO: 3736 - DNA, 26 bp, synthetic construct
  misc_feature 1..26: note = Synthetic Construct
  source 1..26: mol_type = other DNA
tgaaggagtgtggattagtggttaac

SEQ ID NO: 3737 - DNA, 20 bp, synthetic construct
  misc_feature 1..20: note = Synthetic Construct
  source 1..20: mol_type = other DNA
aggtgtgtggtccagattgc

SEQ ID NO: 3738 - DNA, 21 bp, synthetic construct
  misc_feature 1..21: note = Synthetic Construct
  source 1..21: mol_type = other DNA
gccgatgtgttgcctcaagtt

SEQ ID NO: 3739 - DNA, 24 bp, synthetic construct
  misc_feature 1..24: note = Synthetic Construct
  source 1..24: mol_type = other DNA
cacagccttcaagttctgtttcca

SEQ ID NO: 3740 - DNA, 23 bp, synthetic construct
  misc_feature 1..23: note = Synthetic Construct
  source 1..23: mol_type = other DNA
gcaacgggagtaattgcatttgg

SEQ ID NO: 3741 - DNA, 22 bp, synthetic construct
  misc_feature 1..22: note = Synthetic Construct
  source 1..22: mol_type = other DNA
aagaggcagattgctggaagga

SEQ ID NO: 3742 - DNA, 20 bp, synthetic construct
  misc_feature 1..20: note = Synthetic Construct
  source 1..20: mol_type = other DNA
ggaagctgagctgcctctag

SEQ ID NO: 3743 - DNA, 24 bp, synthetic construct
  misc_feature 1..24: note = Synthetic Construct
  source 1..24: mol_type = other DNA
gtattacaacagcgagtggattgc

SEQ ID NO: 3744 - DNA, 23 bp, synthetic construct
  misc_feature 1..23: note = Synthetic Construct
  source 1..23: mol_type = other DNA
gatgtccacctacactggatctc

SEQ ID NO: 3745 - DNA, 24 bp, synthetic construct
  misc_feature 1..24: note = Synthetic Construct
  source 1..24: mol_type = other DNA
acagaagagagacttgggcaatag

SEQ ID NO: 3746 - DNA, 20 bp, synthetic construct
  misc_feature 1..20: note = Synthetic Construct
  source 1..20: mol_type = other DNA
ggagctgcctgatcccagat

SEQ ID NO: 3747 - DNA, 22 bp, synthetic construct
  misc_feature 1..22: note = Synthetic Construct
  source 1..22: mol_type = other DNA
tgatcccagatcaggctcaact

SEQ ID NO: 3748 - DNA, 23 bp, synthetic construct
  misc_feature 1..23: note = Synthetic Construct
  source 1..23: mol_type = other DNA
gtccttgggttcaaatcctagct

SEQ ID NO: 3749 - DNA, 22 bp, synthetic construct
  misc_feature 1..22: note = Synthetic Construct
  source 1..22: mol_type = other DNA
tgaggctccagttgaccttgac

SEQ ID NO: 3750 - DNA, 24 bp, synthetic construct
  misc_feature 1..24: note = Synthetic Construct
  source 1..24: mol_type = other DNA
tcttgcatatacaccactgaagca

SEQ ID NO: 3751 - DNA, 24 bp, synthetic construct
  misc_feature 1..24: note = Synthetic Construct
  source 1..24: mol_type = other DNA
tgtgcaatgaattcagcatgtgat

SEQ ID NO: 3752 - DNA, 20 bp, synthetic construct
  misc_feature 1..20: note = Synthetic Construct
  source 1..20: mol_type = other DNA
tgaagcactcgcagctcact

SEQ ID NO: 3753 - DNA, 23 bp, synthetic construct
  misc_feature 1..23: note = Synthetic Construct
  source 1..23: mol_type = other DNA
agctgaaccttgagaagagcaaa

SEQ ID NO: 3754 - DNA, 21 bp, synthetic construct
  misc_feature 1..21: note = Synthetic Construct
  source 1..21: mol_type = other DNA
aggggtggctctgactaagga

SEQ ID NO: 3755 - DNA, 29 bp, synthetic construct
  misc_feature 1..29: note = Synthetic Construct
  source 1..29: mol_type = other DNA
ccttgaaaataagctgttccaggtaaagg

SEQ ID NO: 3756 - DNA, 24 bp, synthetic construct
  misc_feature 1..24: note = Synthetic Construct
  source 1..24: mol_type = other DNA
ggagtggttactatgcagggtatg

SEQ ID NO: 3757 - DNA, 26 bp, synthetic construct
  misc_feature 1..26: note = Synthetic Construct
  source 1..26: mol_type = other DNA
ggactaggattaaaggagggcctact

SEQ ID NO: 3758 - DNA, 23 bp, synthetic construct
  misc_feature 1..23: note = Synthetic Construct
  source 1..23: mol_type = other DNA
agggttagctaagtaggctgagt

SEQ ID NO: 3759 - DNA, 25 bp, synthetic construct
  misc_feature 1..25: note = Synthetic Construct
  source 1..25: mol_type = other DNA
tggataggtgggcactatagtgtac

SEQ ID NO: 3760 - DNA, 26 bp, synthetic construct
  misc_feature 1..26: note = Synthetic Construct
  source 1..26: mol_type = other DNA
ggagggtgaggacagagtatttatcc

SEQ ID NO: 3761 - DNA, 26 bp, synthetic construct
  misc_feature 1..26: note = Synthetic Construct
  source 1..26: mol_type = other DNA
ccctcctgattctctctctcagatca

SEQ ID NO: 3762 - DNA, 24 bp, synthetic construct
  misc_feature 1..24: note = Synthetic Construct
  source 1..24: mol_type = other DNA
gcttccatgaacacggactgtatg

SEQ ID NO: 3763 - DNA, 24 bp, synthetic construct
  misc_feature 1..24: note = Synthetic Construct
  source 1..24: mol_type = other DNA
gtgggggttaagaggacaaagagt

SEQ ID NO: 3764 - DNA, 27 bp, synthetic construct
  misc_feature 1..27: note = Synthetic Construct
  source 1..27: mol_type = other DNA
ggagagagaatagtgttgcactttgtc

SEQ ID NO: 3765 - DNA, 25 bp, synthetic construct
  misc_feature 1..25: note = Synthetic Construct
  source 1..25: mol_type = other DNA
accccagggaaagtatagacttgag

SEQ ID NO: 3766 - DNA, 24 bp, synthetic construct
  misc_feature 1..24: note = Synthetic Construct
  source 1..24: mol_type = other DNA
gatgaacactacagctgacacact

SEQ ID NO: 3767 - DNA, 22 bp, synthetic construct
  misc_feature 1..22: note = Synthetic Construct
  source 1..22: mol_type = other DNA
aacacaccatgaacccactctt

SEQ ID NO: 3768 - DNA, 26 bp, synthetic construct
  misc_feature 1..26: note = Synthetic Construct
  source 1..26: mol_type = other DNA
gatgctgggaagttgatgaaacatac

SEQ ID NO: 3769 - DNA, 22 bp, synthetic construct
  misc_feature 1..22: note = Synthetic Construct
  source 1..22: mol_type = other DNA
ggttccatcgtctcaactgtgt

SEQ ID NO: 3770 - DNA, 19 bp, synthetic construct
  misc_feature 1..19: note = Synthetic Construct
  source 1..19: mol_type = other DNA
agaaggctgccaggatcca

SEQ ID NO: 3771 - DNA, 24 bp, synthetic construct
  misc_feature 1..24: note = Synthetic Construct
  source 1..24: mol_type = other DNA
tccacagtcgatttgcctatagag

SEQ ID NO: 3772 - DNA, 25 bp, synthetic construct
  misc_feature 1..25: note = Synthetic Construct
  source 1..25: mol_type = other DNA
cgtcttcagagagtttgctttctct

SEQ ID NO: 3773 - DNA, 26 bp, synthetic construct
  misc_feature 1..26: note = Synthetic Construct
  source 1..26: mol_type = other DNA
gctcagaaaaagagaagctgctgtga

SEQ ID NO: 3774 - DNA, 21 bp, synthetic construct
  misc_feature 1..21: note = Synthetic Construct
  source 1..21: mol_type = other DNA
gccttgaacaagtcgctttcc

SEQ ID NO: 3775 - DNA, 23 bp, synthetic construct
  misc_feature 1..23: note = Synthetic Construct
  source 1..23: mol_type = other DNA
ctgtgggttgatgtcttcaaagc

SEQ ID NO: 3776 - DNA, 21 bp, synthetic construct
  misc_feature 1..21: note = Synthetic Construct
  source 1..21: mol_type = other DNA
cccaagccaacatgtcaactg

SEQ ID NO: 3777 - DNA, 25 bp, synthetic construct
  misc_feature 1..25: note = Synthetic Construct
  source 1..25: mol_type = other DNA
ggctccttctcaatacaggtgattc

SEQ ID NO: 3778 - DNA, 21 bp, synthetic construct
  misc_feature 1..21: note = Synthetic Construct
  source 1..21: mol_type = other DNA
agttcagcacctgcagatctg

SEQ ID NO: 3779 - DNA, 18 bp, synthetic construct
  misc_feature 1..18: note = Synthetic Construct
  source 1..18: mol_type = other DNA
cccgcacacacacagact

SEQ ID NO: 3780 - DNA, 24 bp, synthetic construct
  misc_feature 1..24: note = Synthetic Construct
  source 1..24: mol_type = other DNA
tgtgacgctattgttggtgataga

SEQ ID NO: 3781 - DNA, 23 bp, synthetic construct
  misc_feature 1..23: note = Synthetic Construct
  source 1..23: mol_type = other DNA
ctacagccaccttacacctttgt

SEQ ID NO: 3782 - DNA, 24 bp, synthetic construct
  misc_feature 1..24: note = Synthetic Construct
  source 1..24: mol_type = other DNA
ctccagaggaaactgagcttttgg

SEQ ID NO: 3783 - DNA, 25 bp, synthetic construct
  misc_feature 1..25: note = Synthetic Construct
  source 1..25: mol_type = other DNA
gaataaaactgagcaatgccttcca

SEQ ID NO: 3784 - DNA, 26 bp, synthetic construct
  misc_feature 1..26: note = Synthetic Construct
  source 1..26: mol_type = other DNA
ccatacactttgcctatccattgttt

SEQ ID NO: 3785 - DNA, 25 bp, synthetic construct
  misc_feature 1..25: note = Synthetic Construct
  source 1..25: mol_type = other DNA
gggaagttaatctcagccattttgg

SEQ ID NO: 3786 - DNA, 20 bp, synthetic construct
  misc_feature 1..20: note = Synthetic Construct
  source 1..20: mol_type = other DNA
aagcttgcatcccacatcca

SEQ ID NO: 3787 - DNA, 25 bp, synthetic construct
  misc_feature 1..25: note = Synthetic Construct
  source 1..25: mol_type = other DNA
ggaaacgattctaacagagcatctg

SEQ ID NO: 3788 - DNA, 25 bp, synthetic construct
  misc_feature 1..25: note = Synthetic Construct
  source 1..25: mol_type = other DNA
ggtaaggacagggaaaaggattagc

SEQ ID NO: 3789 - DNA, 20 bp, synthetic construct
  misc_feature 1..20: note = Synthetic Construct
  source 1..20: mol_type = other DNA
ccagagccccacagtctaca

SEQ ID NO: 3790 - DNA, 24 bp, synthetic construct
  misc_feature 1..24: note = Synthetic Construct
  source 1..24: mol_type = other DNA
tgagagagaactcttgcctctctt

SEQ ID NO: 3791 - DNA, 21 bp, synthetic construct
  misc_feature 1..21: note = Synthetic Construct
  source 1..21: mol_type = other DNA
atgtctgatgggctgctttgc

SEQ ID NO: 3792 - DNA, 20 bp, synthetic construct
  misc_feature 1..20: note = Synthetic Construct
  source 1..20: mol_type = other DNA
agggttgggcagacagagat

SEQ ID NO: 3793 - DNA, 21 bp, synthetic construct
  misc_feature 1..21: note = Synthetic Construct
  source 1..21: mol_type = other DNA
aggctacagggagggaatgca

SEQ ID NO: 3794 - DNA, 24 bp, synthetic construct
  misc_feature 1..24: note = Synthetic Construct
  source 1..24: mol_type = other DNA
gctctagagacctacaggacacta

SEQ ID NO: 3795 - DNA, 27 bp, synthetic construct
  misc_feature 1..27: note = Synthetic Construct
  source 1..27: mol_type = other DNA
aaatcctcaaaactcattcctggaatg

SEQ ID NO: 3796 - DNA, 20 bp, synthetic construct
  misc_feature 1..20: note = Synthetic Construct
  source 1..20: mol_type = other DNA
cggagtagccctcactctct

SEQ ID NO: 3797 - DNA, 22 bp, synthetic construct
  misc_feature 1..22: note = Synthetic Construct
  source 1..22: mol_type = other DNA
cagagcccgtttttccaacatg

SEQ ID NO: 3798 - DNA, 22 bp, synthetic construct
  misc_feature 1..22: note = Synthetic Construct
  source 1..22: mol_type = other DNA
ctggcagtggagggaaaacaaa

SEQ ID NO: 3799 - DNA, 23 bp, synthetic construct
  misc_feature 1..23: note = Synthetic Construct
  source 1..23: mol_type = other DNA
gggctgtctacatgtagctgaga

SEQ ID NO: 3800 - DNA, 20 bp, synthetic construct
  misc_feature 1..20: note = Synthetic Construct
  source 1..20: mol_type = other DNA
agctgaacctgtggggatgt

SEQ ID NO: 3801 - DNA, 21 bp, synthetic construct
  misc_feature 1..21: note = Synthetic Construct
  source 1..21: mol_type = other DNA
tgggacacacaggaggagaga

SEQ ID NO: 3802 - DNA, 23 bp, synthetic construct
  misc_feature 1..23: note = Synthetic Construct
  source 1..23: mol_type = other DNA
gctcttcatgtggctggattaca

SEQ ID NO: 3803 - DNA, 24 bp, synthetic construct
  misc_feature 1..24: note = Synthetic Construct
  source 1..24: mol_type = other DNA
tgactatggtcaggtcacttgtct

SEQ ID NO: 3804 - DNA, 25 bp, synthetic construct
  misc_feature 1..25: note = Synthetic Construct
  source 1..25: mol_type = other DNA
aagtgtaaagagagctggagttcaa

SEQ ID NO: 3805 - DNA, 26 bp, synthetic construct
  misc_feature 1..26: note = Synthetic Construct
  source 1..26: mol_type = other DNA
gcaaactctcatgcaaccaggaataa

SEQ ID NO: 3806 - DNA, 26 bp, synthetic construct
  misc_feature 1..26: note = Synthetic Construct
  source 1..26: mol_type = other DNA
gtgaaatttaccaccaatgccctgat

SEQ ID NO: 3807 - DNA, 24 bp, synthetic construct
  misc_feature 1..24: note = Synthetic Construct
  source 1..24: mol_type = other DNA
gcgatggggagacaattactcagt

SEQ ID NO: 3808 - DNA, 20 bp, synthetic construct
  misc_feature 1..20: note = Synthetic Construct
  source 1..20: mol_type = other DNA
agggctccaacctcaagcta

SEQ ID NO: 3809 - DNA, 20 bp, synthetic construct
  misc_feature 1..20: note = Synthetic Construct
  source 1..20: mol_type = other DNA
ctgtgtgcatctggctgaca

SEQ ID NO: 3810 - DNA, 19 bp, synthetic construct
  misc_feature 1..19: note = Synthetic Construct
  source 1..19: mol_type = other DNA
agtgccacccagcctagct

SEQ ID NO: 3811 - DNA, 26 bp, synthetic construct
  misc_feature 1..26: note = Synthetic Construct
  source 1..26: mol_type = other DNA
ggcaactctagaatgacaaaggctta

SEQ ID NO: 3812 - DNA, 22 bp, synthetic construct
  misc_feature 1..22: note = Synthetic Construct
  source 1..22: mol_type = other DNA
ctcttcactgggatgcttcctt

SEQ ID NO: 3813 - DNA, 24 bp, synthetic construct
  misc_feature 1..24: note = Synthetic Construct
  source 1..24: mol_type = other DNA
ccccagccgacttacttttgaaga

SEQ ID NO: 3814 - DNA, 22 bp, synthetic construct
  misc_feature 1..22: note = Synthetic Construct
  source 1..22: mol_type = other DNA
gctgactcttagccctgacttc

SEQ ID NO: 3815 - DNA, 24 bp, synthetic construct
  misc_feature 1..24: note = Synthetic Construct
  source 1..24: mol_type = other DNA
ctctgtgctttctcactcatttcc

SEQ ID NO: 3816 - DNA, 20 bp, synthetic construct
  misc_feature 1..20: note = Synthetic Construct
  source 1..20: mol_type = other DNA
ttgggtgccacttgggagaa

SEQ ID NO: 3817 - DNA, 29 bp, synthetic construct
  misc_feature 1..29: note = Synthetic Construct
  source 1..29: mol_type = other DNA
ctccttagagtgctgaaatattcttagca

SEQ ID NO: 3818 - DNA, 22 bp, synthetic construct
  misc_feature 1..22: note = Synthetic Construct
  source 1..22: mol_type = other DNA
gggaggctttttgtggtacaga

SEQ ID NO: 3819 - DNA, 28 bp, synthetic construct
  misc_feature 1..28: note = Synthetic Construct
  source 1..28: mol_type = other DNA
gctagactatctctaagccagtctccta

SEQ ID NO: 3820 - DNA, 20 bp, synthetic construct
  misc_feature 1..20: note = Synthetic Construct
  source 1..20: mol_type = other DNA
gcggcgtggtcaatctctca

SEQ ID NO: 3821 - DNA, 22 bp, synthetic construct
  misc_feature 1..22: note = Synthetic Construct
  source 1..22: mol_type = other DNA
gcaagtaactgaaggcagcaaa

SEQ ID NO: 3822 - DNA, 25 bp, synthetic construct
  misc_feature 1..25: note = Synthetic Construct
  source 1..25: mol_type = other DNA
ggtatgtggggcgatttatctcaag

SEQ ID NO: 3823 - DNA, 19 bp, synthetic construct
  misc_feature 1..19: note = Synthetic Construct
  source 1..19: mol_type = other DNA
tcgctggcttgcctaacac

SEQ ID NO: 3824 - DNA, 24 bp, synthetic construct
  misc_feature 1..24: note = Synthetic Construct
  source 1..24: mol_type = other DNA
gcttggtctcagataggcctgatt

SEQ ID NO: 3825 - DNA, 24 bp, synthetic construct
  misc_feature 1..24: note = Synthetic Construct
  source 1..24: mol_type = other DNA
tcctaatcaccccatggccaaatc

SEQ ID NO: 3826 - DNA, 22 bp, synthetic construct
  misc_feature 1..22: note = Synthetic Construct
  source 1..22: mol_type = other DNA
cgctacctcagtgatgtccatt

SEQ ID NO: 3827 - DNA, 28 bp, synthetic construct
  misc_feature 1..28: note = Synthetic Construct
  source 1..28: mol_type = other DNA
ggcaaacaggttagaatttacacaggaa

SEQ ID NO: 3828 - DNA, 26 bp, synthetic construct
  misc_feature 1..26: note = Synthetic Construct
  source 1..26: mol_type = other DNA
aggggattactgagggtgaggattac

SEQ ID NO: 3829 - DNA, 20 bp, synthetic construct
  misc_feature 1..20: note = Synthetic Construct
  source 1..20: mol_type = other DNA
aatgcccgcctctgaggaat

SEQ ID NO: 3830 - DNA, 24 bp, synthetic construct
  misc_feature 1..24: note = Synthetic Construct
  source 1..24: mol_type = other DNA
tgctgagagaaagctgatttggta

SEQ ID NO: 3831 - DNA, 20 bp, synthetic construct
  misc_feature 1..20: note = Synthetic Construct
  source 1..20: mol_type = other DNA
tgaggccagaagcagtgcta

SEQ ID NO: 3832 - DNA, 26 bp, synthetic construct
  misc_feature 1..26: note = Synthetic Construct
  source 1..26: mol_type = other DNA
aaggctgctattatccaaaagtgttg

SEQ ID NO: 3833 - DNA, 22 bp, synthetic construct
  misc_feature 1..22: note = Synthetic Construct
  source 1..22: mol_type = other DNA
tgcctccttgtggcataccatt

SEQ ID NO: 3834 - DNA, 24 bp, synthetic construct
  misc_feature 1..24: note = Synthetic Construct
  source 1..24: mol_type = other DNA
gttctctccttgaccttccttctg

SEQ ID NO: 3835 - DNA, 21 bp, synthetic construct
  misc_feature 1..21: note = Synthetic Construct
  source 1..21: mol_type = other DNA
gtctgtcaggttggacactgt

SEQ ID NO: 3836 - DNA, 26 bp, synthetic construct
  misc_feature 1..26: note = Synthetic Construct
  source 1..26: mol_type = other DNA
cgtgagcttatgtctctggtgttgag

SEQ ID NO: 3837 - DNA, 27 bp, synthetic construct
  misc_feature 1..27: note = Synthetic Construct
  source 1..27: mol_type = other DNA
ctgatgttgaagctcacattgtttgag

SEQ ID NO: 3838 - DNA, 26 bp, synthetic construct
  misc_feature 1..26: note = Synthetic Construct
  source 1..26: mol_type = other DNA
cagatattctctaatgccccttgagt

SEQ ID NO: 3839 - DNA, 21 bp, synthetic construct
  misc_feature 1..21: note = Synthetic Construct
  source 1..21: mol_type = other DNA
agcacagaggagcaggagtgt

SEQ ID NO: 3840 - DNA, 27 bp, synthetic construct
  misc_feature 1..27: note = Synthetic Construct
  source 1..27: mol_type = other DNA
gctgccaaatgaaaattgaccttcatg

SEQ ID NO: 3841 - DNA, 25 bp, synthetic construct
  misc_feature 1..25: note = Synthetic Construct
  source 1..25: mol_type = other DNA
ccgtgacctaatgctgtatttctga

SEQ ID NO: 3842 - DNA, 22 bp, synthetic construct
  misc_feature 1..22: note = Synthetic Construct
  source 1..22: mol_type = other DNA
gcaagatccactccctctctgt

SEQ ID NO: 3843 - DNA, 24 bp, synthetic construct
  misc_feature 1..24: note = Synthetic Construct
  source 1..24: mol_type = other DNA
ctttaaaccaccagcctgacaaag

SEQ ID NO: 3844 - DNA, 24 bp, synthetic construct
  misc_feature 1..24: note = Synthetic Construct
  source 1..24: mol_type = other DNA
ccgggtatgtcgtgatgaactaag

SEQ ID NO: 3845 - DNA, 26 bp, synthetic construct
  misc_feature 1..26: note = Synthetic Construct
  source 1..26: mol_type = other DNA
gcaccagagacaaatttgcctcaaac

SEQ ID NO: 3846 - DNA, 19 bp, synthetic construct
  misc_feature 1..19: note = Synthetic Construct
  source 1..19: mol_type = other DNA
agccagaccctgagcaagt

SEQ ID NO: 3847 - DNA, 21 bp, synthetic construct
  misc_feature 1..21: note = Synthetic Construct
  source 1..21: mol_type = other DNA
tctgggcatctctgagcatca

SEQ ID NO: 3848 - DNA, 22 bp, synthetic construct
  misc_feature 1..22: note = Synthetic Construct
  source 1..22: mol_type = other DNA
atcttcgtgcctcccaggttga

SEQ ID NO: 3849 - DNA, 27 bp, synthetic construct
  misc_feature 1..27: note = Synthetic Construct
  source 1..27: mol_type = other DNA
cagcagtcccataatattcttggctta

SEQ ID NO: 3850 - DNA, 20 bp, synthetic construct
  misc_feature 1..20: note = Synthetic Construct
  source 1..20: mol_type = other DNA
ctgccccttccgaggctact

SEQ ID NO: 3851 - DNA, 24 bp, synthetic construct
  misc_feature 1..24: note = Synthetic Construct
  source 1..24: mol_type = other DNA
gaaaacatgggacacctgagtcat

SEQ ID NO: 3852 - DNA, 22 bp, synthetic construct
  misc_feature 1..22: note = Synthetic Construct
  source 1..22: mol_type = other DNA
gagaggccatgtacacaaggtt

SEQ ID NO: 3853 - DNA, 24 bp, synthetic construct
  misc_feature 1..24: note = Synthetic Construct
  source 1..24: mol_type = other DNA
ggcattagcagaagagggaacagt

SEQ ID NO: 3854 - DNA, 22 bp, synthetic construct
  misc_feature 1..22: note = Synthetic Construct
  source 1..22: mol_type = other DNA
cttgcaaactgcccttctcagt

SEQ ID NO: 3855 - DNA, 19 bp, synthetic construct
  misc_feature 1..19: note = Synthetic Construct
  source 1..19: mol_type = other DNA
aggggaggggcatcttagc

SEQ ID NO: 3856 - DNA, 24 bp, synthetic construct
  misc_feature 1..24: note = Synthetic Construct
  source 1..24: mol_type = other DNA
gcctccaaaaccatccaaaatcca

SEQ ID NO: 3857 - DNA, 28 bp, synthetic construct
  misc_feature 1..28: note = Synthetic Construct
  source 1..28: mol_type = other DNA
caaggaaagtatgcttgtaattggagtt

SEQ ID NO: 3858 - DNA, 23 bp, synthetic construct
  misc_feature 1..23: note = Synthetic Construct
  source 1..23: mol_type = other DNA
ggtgttccctctctgtctctcta

SEQ ID NO: 3859 - DNA, 21 bp, synthetic construct
  misc_feature 1..21: note = Synthetic Construct
  source 1..21: mol_type = other DNA
gctcatacagctggcaaaagg

SEQ ID NO: 3860 - DNA, 22 bp, synthetic construct
  misc_feature 1..22: note = Synthetic Construct
  source 1..22: mol_type = other DNA
tccttgacaggctcttgctttg

SEQ ID NO: 3861 - DNA, 23 bp, synthetic construct
  misc_feature 1..23: note = Synthetic Construct
  source 1..23: mol_type = other DNA
aaattgctgactcttgggacctt

SEQ ID NO: 3862 - DNA, 20 bp, synthetic construct
  misc_feature 1..20: note = Synthetic Construct
  source 1..20: mol_type = other DNA
ctggagtgtgcctgcgttct

SEQ ID NO: 3863 - DNA, 22 bp, synthetic construct
  misc_feature 1..22: note = Synthetic Construct
  source 1..22: mol_type = other DNA
ctccaaggcctagtttgctgaa

SEQ ID NO: 3864 - DNA, 18 bp, synthetic construct
  misc_feature 1..18: note = Synthetic Construct
  source 1..18: mol_type = other DNA
cgcggctctcagtggaaa

SEQ ID NO: 3865 - DNA, 22 bp, synthetic construct
  misc_feature 1..22: note = Synthetic Construct
  source 1..22: mol_type = other DNA
aaggtactgcctgtgtctacca

SEQ ID NO: 3866 - DNA, 24 bp, synthetic construct
  misc_feature 1..24: note = Synthetic Construct
  source 1..24: mol_type = other DNA
gaatactttgagggctgacgtcaa

SEQ ID NO: 3867 - DNA, 20 bp, synthetic construct
  misc_feature 1..20: note = Synthetic Construct
  source 1..20: mol_type = other DNA
gggttggggaagccctagtc

SEQ ID NO: 3868 - DNA, 26 bp, synthetic construct
  misc_feature 1..26: note = Synthetic Construct
  source 1..26: mol_type = other DNA
tgagactgtcaccaaataagcctatc

SEQ ID NO: 3869 - DNA, 24 bp, synthetic construct
  misc_feature 1..24: note = Synthetic Construct
  source 1..24: mol_type = other DNA
gggatcattgggtggtttctgtca

SEQ ID NO: 3870 - DNA, 23 bp, synthetic construct
  misc_feature 1..23: note = Synthetic Construct
  source 1..23: mol_type = other DNA
accaccccagagattcagttgga

SEQ ID NO: 3871 - DNA, 22 bp, synthetic construct
  misc_feature 1..22: note = Synthetic Construct
  source 1..22: mol_type = other DNA
gtgcccaagtggagtcatgttt

SEQ ID NO: 3872 - DNA, 23 bp, synthetic construct
  misc_feature 1..23: note = Synthetic Construct
  source 1..23: mol_type = other DNA
ggagcgtaagagcctaactttgg

SEQ ID NO: 3873 - DNA, 27 bp, synthetic construct
  misc_feature 1..27: note = Synthetic Construct
  source 1..27: mol_type = other DNA
ggttattgaagtccttgtcatggatga

SEQ ID NO: 3874 - DNA, 30 bp, synthetic construct
  misc_feature 1..30: note = Synthetic Construct
  source 1..30: mol_type = other DNA
cctctttactaggatatctcccaggaatgt

SEQ ID NO: 3875 - DNA, 27 bp, synthetic construct
  misc_feature 1..27: note = Synthetic Construct
  source 1..27: mol_type = other DNA
gcttagaatgagcatagtctacatgca

SEQ ID NO: 3876 - DNA, 24 bp, synthetic construct
  misc_feature 1..24: note = Synthetic Construct
  source 1..24: mol_type = other DNA
cacccacctgttttggagatgttc

SEQ ID NO: 3877 - DNA, 18 bp, synthetic construct
  misc_feature 1..18: note = Synthetic Construct
  source 1..18: mol_type = other DNA
gggcaggggtgcaaagca

SEQ ID NO: 3878 - DNA, 23 bp, synthetic construct
  misc_feature 1..23: note = Synthetic Construct
  source 1..23: mol_type = other DNA
gcatctgcaactgtgtgatcttg

SEQ ID NO: 3879 - DNA, 21 bp, synthetic construct
  misc_feature 1..21: note = Synthetic Construct
  source 1..21: mol_type = other DNA
aggcagaacccaaggatcctt

SEQ ID NO: 3880 - DNA, 20 bp, synthetic construct
  misc_feature 1..20: note = Synthetic Construct
  source 1..20: mol_type = other DNA
agggaggatggcctgacatc

SEQ ID NO: 3881 - DNA, 25 bp, synthetic construct
  misc_feature 1..25: note = Synthetic Construct
  source 1..25: mol_type = other DNA
cacttcccaaaaaggttccattgat

SEQ ID NO: 3882 - DNA, 24 bp, synthetic construct
  misc_feature 1..24: note = Synthetic Construct
  source 1..24: mol_type = other DNA
ttcatcccttctgctttgtgaaga

SEQ ID NO: 3883 - DNA, 23 bp, synthetic construct
  misc_feature 1..23: note = Synthetic Construct
  source 1..23: mol_type = other DNA
gatggtctctagggggctctatt

SEQ ID NO: 3884 - DNA, 25 bp, synthetic construct
  misc_feature 1..25: note = Synthetic Construct
  source 1..25: mol_type = other DNA
ccactgaggctattcccctacaatt

SEQ ID NO: 3885 - DNA, 21 bp, synthetic construct
  misc_feature 1..21: note = Synthetic Construct
  source 1..21: mol_type = other DNA
tgagtgggtggagagcttcct

SEQ ID NO: 3886 - DNA, 25 bp, synthetic construct
  misc_feature 1..25: note = Synthetic Construct
  source 1..25: mol_type = other DNA
gagtcctctttttctctgcaatcct

SEQ ID NO: 3887 - DNA, 23 bp, synthetic construct
  misc_feature 1..23: note = Synthetic Construct
  source 1..23: mol_type = other DNA
ctccgttcctcagtttaccacaa

SEQ ID NO: 3888 - DNA, 21 bp, synthetic construct
  misc_feature 1..21: note = Synthetic Construct
  source 1..21: mol_type = other DNA
cctgaacagccacatgatgca

SEQ ID NO: 3889 - DNA, 22 bp, synthetic construct
  misc_feature 1..22: note = Synthetic Construct
  source 1..22: mol_type = other DNA
agaccttagactggctggaagt

SEQ ID NO: 3890 - DNA, 24 bp, synthetic construct
  misc_feature 1..24: note = Synthetic Construct
  source 1..24: mol_type = other DNA
ggggaagtatcactgatgcaagca

SEQ ID NO: 3891 - DNA, 23 bp, synthetic construct
  misc_feature 1..23: note = Synthetic Construct
  source 1..23: mol_type = other DNA
gattggttgccaaagaggtcatc

SEQ ID NO: 3892 - DNA, 22 bp, synthetic construct
  misc_feature 1..22: note = Synthetic Construct
  source 1..22: mol_type = other DNA
ccctgtgtcttcctctctccta

SEQ ID NO: 3893 - DNA, 23 bp, synthetic construct
  misc_feature 1..23: note = Synthetic Construct
  source 1..23: mol_type = other DNA
caatttccctgtgtctggtgaca

SEQ ID NO: 3894 - DNA, 20 bp, synthetic construct
  misc_feature 1..20: note = Synthetic Construct
  source 1..20: mol_type = other DNA
agccaggaacagagccaaga

SEQ ID NO: 3895 - DNA, 22 bp, synthetic construct
  misc_feature 1..22: note = Synthetic Construct
  source 1..22: mol_type = other DNA
tggtccactgactggcatttgg

SEQ ID NO: 3896 - DNA, 25 bp, synthetic construct
  misc_feature 1..25: note = Synthetic Construct
  source 1..25: mol_type = other DNA
tgccttcctaattaaccatcacact

SEQ ID NO: 3897 - DNA, 24 bp, synthetic construct
  misc_feature 1..24: note = Synthetic Construct
  source 1..24: mol_type = other DNA
actccccaagacctttcagagatg

SEQ ID NO: 3898 - DNA, 19 bp, synthetic construct
  misc_feature 1..19: note = Synthetic Construct
  source 1..19: mol_type = other DNA
gtgctgagcctgagatgct

SEQ ID NO: 3899 - DNA, 24 bp, synthetic construct
  misc_feature 1..24: note = Synthetic Construct
  source 1..24: mol_type = other DNA
ctctgtttcaccttaggtcagtga

SEQ ID NO: 3900 - DNA, 22 bp, synthetic construct
  misc_feature 1..22: note = Synthetic Construct
  source 1..22: mol_type = other DNA
ttcatgcatgaggctggatgaa

SEQ ID NO: 3901 - DNA, 19 bp, synthetic construct
  misc_feature 1..19: note = Synthetic Construct
  source 1..19: mol_type = other DNA
agcacttccccagctgtga

SEQ ID NO: 3902 - DNA, 22 bp, synthetic construct
  misc_feature 1..22: note = Synthetic Construct
  source 1..22: mol_type = other DNA
tttggcaggggaatggaaagat

SEQ ID NO: 3903 - DNA, 25 bp, synthetic construct
  misc_feature 1..25: note = Synthetic Construct
  source 1..25: mol_type = other DNA
ggcacaattagagcagctactgtct

SEQ ID NO: 3904 - DNA, 25 bp, synthetic construct
  misc_feature 1..25: note = Synthetic Construct
  source 1..25: mol_type = other DNA
tggcccatctatatctcagtgtgta

SEQ ID NO: 3905 - DNA, 23 bp, synthetic construct
  misc_feature 1..23: note = Synthetic Construct
  source 1..23: mol_type = other DNA
gctgctttatgccaagagtgtac

SEQ ID NO: 3906 - DNA, 23 bp, synthetic construct
  misc_feature 1..23: note = Synthetic Construct
  source 1..23: mol_type = other DNA
aggtggttcggtcagtccttaga

SEQ ID NO: 3907 - DNA, 19 bp, synthetic construct
  misc_feature 1..19: note = Synthetic Construct
  source 1..19: mol_type = other DNA
tgctgctcttggcttggtt

SEQ ID NO: 3908 - DNA, 21 bp, synthetic construct
  misc_feature 1..21: note = Synthetic Construct
  source 1..21: mol_type = other DNA
tcagcctgaacccaagtccaa

SEQ ID NO: 3909 - DNA, 22 bp, synthetic construct
  misc_feature 1..22: note = Synthetic Construct
  source 1..22: mol_type = other DNA
aggtgacgcaaggtaacagttg

SEQ ID NO: 3910 - DNA, 28 bp, synthetic construct
  misc_feature 1..28: note = Synthetic Construct
  source 1..28: mol_type = other DNA
ccccacaaatcattaagaggtctttacg

SEQ ID NO: 3911 - DNA, 24 bp, synthetic construct
  misc_feature 1..24: note = Synthetic Construct
  source 1..24: mol_type = other DNA
gcacagtaatgtcaggagagtttg

SEQ ID NO: 3912 - DNA, 25 bp, synthetic construct
  misc_feature 1..25: note = Synthetic Construct
  source 1..25: mol_type = other DNA
ggagacagttcttccttcaagatca

SEQ ID NO: 3913 - DNA, 26 bp, synthetic construct
  misc_feature 1..26: note = Synthetic Construct
  source 1..26: mol_type = other DNA
tgtttccatgtcagttgatagaacct

SEQ ID NO: 3914 - DNA, 24 bp, synthetic construct
  misc_feature 1..24: note = Synthetic Construct
  source 1..24: mol_type = other DNA
cagggacagtctgaagaactgatg

SEQ ID NO: 3915 - DNA, 25 bp, synthetic construct
  misc_feature 1..25: note = Synthetic Construct
  source 1..25: mol_type = other DNA
aacagacatgtacattccccagaaa

SEQ ID NO: 3916 - DNA, 19 bp, synthetic construct
  misc_feature 1..19: note = Synthetic Construct
  source 1..19: mol_type = other DNA
tgccctctgctgacacaga

SEQ ID NO: 3917 - DNA, 20 bp, synthetic construct
  misc_feature 1..20: note = Synthetic Construct
  source 1..20: mol_type = other DNA
cctgcctctcagcctgaagt

SEQ ID NO: 3918 - DNA, 22 bp, synthetic construct
  misc_feature 1..22: note = Synthetic Construct
  source 1..22: mol_type = other DNA
cacaggcagaagagcatctttg

SEQ ID NO: 3919 - DNA, 24 bp, synthetic construct
  misc_feature 1..24: note = Synthetic Construct
  source 1..24: mol_type = other DNA
actgtaggtggtttgtaggagttg

SEQ ID NO: 3920 - DNA, 25 bp, synthetic construct
  misc_feature 1..25: note = Synthetic Construct
  source 1..25: mol_type = other DNA
cctgtaccccagcctatttaattct

SEQ ID NO: 3921 - DNA, 27 bp, synthetic construct
  misc_feature 1..27: note = Synthetic Construct
  source 1..27: mol_type = other DNA
cacactgtattagaatcagtgctgttt

SEQ ID NO: 3922 - DNA, 26 bp, synthetic construct
  misc_feature 1..26: note = Synthetic Construct
  source 1..26: mol_type = other DNA
gccttcaatgacctttgacagctttc

SEQ ID NO: 3923 - DNA, 25 bp, synthetic construct
  misc_feature 1..25: note = Synthetic Construct
  source 1..25: mol_type = other DNA
gtccaccctcacatggtttctattc

SEQ ID NO: 3924 - DNA, 20 bp, synthetic construct
  misc_feature 1..20: note = Synthetic Construct
  source 1..20: mol_type = other DNA
tgctgcttggacaggtacct

SEQ ID NO: 3925 - DNA, 19 bp, synthetic construct
  misc_feature 1..19: note = Synthetic Construct
  source 1..19: mol_type = other DNA
gggtggggaagcctctaca

SEQ ID NO: 3926 - DNA, 22 bp, synthetic construct
  misc_feature 1..22: note = Synthetic Construct
  source 1..22: mol_type = other DNA
cctgagtgtccaagatgggttt

SEQ ID NO: 3927 - DNA, 21 bp, synthetic construct
  misc_feature 1..21: note = Synthetic Construct
  source 1..21: mol_type = other DNA
ctatgcaccagcctccttctc

SEQ ID NO: 3928 - DNA, 19 bp, synthetic construct
  misc_feature 1..19: note = Synthetic Construct
  source 1..19: mol_type = other DNA
ccctcgcgtgctgataagg

SEQ ID NO: 3929 - DNA, 23 bp, synthetic construct
  misc_feature 1..23: note = Synthetic Construct
  source 1..23: mol_type = other DNA
gaccttttgccacttgagacgat

SEQ ID NO: 3930 - DNA, 23 bp, synthetic construct
  misc_feature 1..23: note = Synthetic Construct
  source 1..23: mol_type = other DNA
caaacataagcatgagcgaaggt

SEQ ID NO: 3931 - DNA, 21 bp, synthetic construct
  misc_feature 1..21: note = Synthetic Construct
  source 1..21: mol_type = other DNA
ttgtgaggccactgtgtctca

SEQ ID NO: 3932 - DNA, 22 bp, synthetic construct
  misc_feature 1..22: note = Synthetic Construct
  source 1..22: mol_type = other DNA
tgctagaccctcagttctccat

SEQ ID NO: 3933 - DNA, 27 bp, synthetic construct
  misc_feature 1..27: note = Synthetic Construct
  source 1..27: mol_type = other DNA
tgattatgacttgctttggtcaaaagg

SEQ ID NO: 3934 - DNA, 22 bp, synthetic construct
  misc_feature 1..22: note = Synthetic Construct
  source 1..22: mol_type = other DNA
acagcacagcttttgagggaaa

SEQ ID NO: 3935 - DNA, 27 bp, synthetic construct
  misc_feature 1..27: note = Synthetic Construct
  source 1..27: mol_type = other DNA
atcaatacatggtggttttgtttcctt

SEQ ID NO: 3936 - DNA, 24 bp, synthetic construct
  misc_feature 1..24: note = Synthetic Construct
  source 1..24: mol_type = other DNA
gctctaaagcccactaccatgcaa

SEQ ID NO: 3937 - DNA, 25 bp, synthetic construct
  misc_feature 1..25: note = Synthetic Construct
  source 1..25: mol_type = other DNA
cccgctaatgtgagtgcaggataaa

SEQ ID NO: 3938 - DNA, 27 bp, synthetic construct
  misc_feature 1..27: note = Synthetic Construct
  source 1..27: mol_type = other DNA
ggaaagcaaaagatggaagagggaaaa

SEQ ID NO: 3939 - DNA, 24 bp, synthetic construct
  misc_feature 1..24: note = Synthetic Construct
  source 1..24: mol_type = other DNA
ctgctgataacttttggtcaacgt

SEQ ID NO: 3940 - DNA, 23 bp, synthetic construct
  misc_feature 1..23: note = Synthetic Construct
  source 1..23: mol_type = other DNA
cctcctgcaatagaaggcaaact

SEQ ID NO: 3941 - DNA, 22 bp, synthetic construct
  misc_feature 1..22: note = Synthetic Construct
  source 1..22: mol_type = other DNA
ccagacaaaggtcagccctaat

SEQ ID NO: 3942 - DNA, 20 bp, synthetic construct
  misc_feature 1..20: note = Synthetic Construct
  source 1..20: mol_type = other DNA
tccacgtctgtgtgctgatc

SEQ ID NO: 3943 - DNA, 19 bp, synthetic construct
  misc_feature 1..19: note = Synthetic Construct
  source 1..19: mol_type = other DNA
tgctgggacccatgaacca

SEQ ID NO: 3944 - DNA, 21 bp, synthetic construct
  misc_feature 1..21: note = Synthetic Construct
  source 1..21: mol_type = other DNA
ttagccaggcctcctcttctc

SEQ ID NO: 3945 - DNA, 27 bp, synthetic construct
  misc_feature 1..27: note = Synthetic Construct
  source 1..27: mol_type = other DNA
tgtctcactggcaattaaactctaact

SEQ ID NO: 3946 - DNA, 19 bp, synthetic construct
  misc_feature 1..19: note = Synthetic Construct
  source 1..19: mol_type = other DNA
accatggccaagcctgtca

SEQ ID NO: 3947 - DNA, 24 bp, synthetic construct
  misc_feature 1..24: note = Synthetic Construct
  source 1..24: mol_type = other DNA
tgctgaagagtacccccagttttg

SEQ ID NO: 3948 - DNA, 20 bp, synthetic construct
  misc_feature 1..20: note = Synthetic Construct
  source 1..20: mol_type = other DNA
cagctcacaggaagcagtca

SEQ ID NO: 3949 - DNA, 26 bp, synthetic construct
  misc_feature 1..26: note = Synthetic Construct
  source 1..26: mol_type = other DNA
gtgaatttcttgtaggcagcagatag

SEQ ID NO: 3950 - DNA, 22 bp, synthetic construct
  misc_feature 1..22: note = Synthetic Construct
  source 1..22: mol_type = other DNA
gctaaggcagccagtcctggaa

SEQ ID NO: 3951 - DNA, 28 bp, synthetic construct
  misc_feature 1..28: note = Synthetic Construct
  source 1..28: mol_type = other DNA
gcttttgttttcaagtggcagaaaacac

SEQ ID NO: 3952 - DNA, 23 bp, synthetic construct
  misc_feature 1..23: note = Synthetic Construct
  source 1..23: mol_type = other DNA
tcatggaatggtatccacaagca

SEQ ID NO: 3953 - DNA, 25 bp, synthetic construct
  misc_feature 1..25: note = Synthetic Construct
  source 1..25: mol_type = other DNA
ggaaccagctgcagtagatctatag

SEQ ID NO: 3954 - DNA, 20 bp, synthetic construct
  misc_feature 1..20: note = Synthetic Construct
  source 1..20: mol_type = other DNA
gattggtgcccaggaaacct

SEQ ID NO: 3955 - DNA, 24 bp, synthetic construct
  misc_feature 1..24: note = Synthetic Construct
  source 1..24: mol_type = other DNA
gccctctttgccatctctacactt

SEQ ID NO: 3956 - DNA, 20 bp, synthetic construct
  misc_feature 1..20: note = Synthetic Construct
  source 1..20: mol_type = other DNA
actccagccaggcaattcct

SEQ ID NO: 3957 - DNA, 22 bp, synthetic construct
  misc_feature 1..22: note = Synthetic Construct
  source 1..22: mol_type = other DNA
ccatgcagcaacatctgtagtg

SEQ ID NO: 3958 - DNA, 22 bp, synthetic construct
  misc_feature 1..22: note = Synthetic Construct
  source 1..22: mol_type = other DNA
caacttcaagtccctggagcaa

SEQ ID NO: 3959 - DNA, 21 bp, synthetic construct
  misc_feature 1..21: note = Synthetic Construct
  source 1..21: mol_type = other DNA
ccagctgtgttctccagacaa

SEQ ID NO: 3960 - DNA, 19 bp, synthetic construct
  misc_feature 1..19: note = Synthetic Construct
  source 1..19: mol_type = other DNA
gggctggagctcaggatca

SEQ ID NO: 3961 - DNA, 19 bp, synthetic construct
  misc_feature 1..19: note = Synthetic Construct
  source 1..19: mol_type = other DNA
tccacctgcccctcagcaa

SEQ ID NO: 3962 - DNA, 27 bp, synthetic construct
  misc_feature 1..27: note = Synthetic Construct
  source 1..27: mol_type = other DNA
gcagggaaagggtacacagttgtatag

SEQ ID NO: 3963 - DNA, 26 bp, synthetic construct
  misc_feature 1..26: note = Synthetic Construct
  source 1..26: mol_type = other DNA
tttggttcaccttcatatcagtttcg

SEQ ID NO: 3964 - DNA, 22 bp, synthetic construct
  misc_feature 1..22: note = Synthetic Construct
  source 1..22: mol_type = other DNA
tccaaaaccagctcctcctgaa

SEQ ID NO: 3965 - DNA, 24 bp, synthetic construct
  misc_feature 1..24: note = Synthetic Construct
  source 1..24: mol_type = other DNA
gcactcccagaggtatgaacagat

SEQ ID NO: 3966 - DNA, 24 bp, synthetic construct
  misc_feature 1..24: note = Synthetic Construct
  source 1..24: mol_type = other DNA
tgctctgagctacccatctccatt

SEQ ID NO: 3967 - DNA, 25 bp, synthetic construct
  misc_feature 1..25: note = Synthetic Construct
  source 1..25: mol_type = other DNA
ggacaggacagtgatgattgctaga

SEQ ID NO: 3968 - DNA, 22 bp, synthetic construct
  misc_feature 1..22: note = Synthetic Construct
  source 1..22: mol_type = other DNA
agggtgtggaggtatcgaagct

SEQ ID NO: 3969 - DNA, 24 bp, synthetic construct
  misc_feature 1..24: note = Synthetic Construct
  source 1..24: mol_type = other DNA
cagagccctaggaacactatgtct

SEQ ID NO: 3970 - DNA, 24 bp, synthetic construct
  misc_feature 1..24: note = Synthetic Construct
  source 1..24: mol_type = other DNA
gattagcatgagtgggaactgagt

SEQ ID NO: 3971 - DNA, 20 bp, synthetic construct
  misc_feature 1..20: note = Synthetic Construct
  source 1..20: mol_type = other DNA
acccaagatggctgccaaca

SEQ ID NO: 3972 - DNA, 22 bp, synthetic construct
  misc_feature 1..22: note = Synthetic Construct
  source 1..22: mol_type = other DNA
gctgacatgttgcccaagacta

SEQ ID NO: 3973 - DNA, 23 bp, synthetic construct
  misc_feature 1..23: note = Synthetic Construct
  source 1..23: mol_type = other DNA
ccctagccttctgcatcataagg

SEQ ID NO: 3974 - DNA, 24 bp, synthetic construct
  misc_feature 1..24: note = Synthetic Construct
  source 1..24: mol_type = other DNA
cctctctggtttggtgaagttacg

SEQ ID NO: 3975 - DNA, 23 bp, synthetic construct
  misc_feature 1..23: note = Synthetic Construct
  source 1..23: mol_type = other DNA
gtagtgcctcccaaaatgtgact

SEQ ID NO: 3976 - DNA, 23 bp, synthetic construct
  misc_feature 1..23: note = Synthetic Construct
  source 1..23: mol_type = other DNA
gacttgccccaaatctctgatca

SEQ ID NO: 3977 - DNA, 20 bp, synthetic construct
  misc_feature 1..20: note = Synthetic Construct
  source 1..20: mol_type = other DNA
tcatggcttgcccttcaaca

SEQ ID NO: 3978 - DNA, 23 bp, synthetic construct
  misc_feature 1..23: note = Synthetic Construct
  source 1..23: mol_type = other DNA
gtttcctgctagcactactctgt

SEQ ID NO: 3979 - DNA, 22 bp, synthetic construct
  misc_feature 1..22: note = Synthetic Construct
  source 1..22: mol_type = other DNA
ggtcacagctgattggaccaaa

SEQ ID NO: 3980 - DNA, 23 bp, synthetic construct
  misc_feature 1..23: note = Synthetic Construct
  source 1..23: mol_type = other DNA
gagaggagaagtctctggaaggt

SEQ ID NO: 3981 - DNA, 25 bp, synthetic construct
  misc_feature 1..25: note = Synthetic Construct
  source 1..25: mol_type = other DNA
cccattttgcagtgaccttttactg

SEQ ID NO: 3982 - DNA, 26 bp, synthetic construct
  misc_feature 1..26: note = Synthetic Construct
  source 1..26: mol_type = other DNA
ttattctgcccaccgagaatattaca

SEQ ID NO: 3983 - DNA, 21 bp, synthetic construct
  misc_feature 1..21: note = Synthetic Construct
  source 1..21: mol_type = other DNA
aaaccttgccttcacctggaa

SEQ ID NO: 3984 - DNA, 24 bp, synthetic construct
  misc_feature 1..24: note = Synthetic Construct
  source 1..24: mol_type = other DNA
tgctgagggatatttggggagagt

SEQ ID NO: 3985 - DNA, 22 bp, synthetic construct
  misc_feature 1..22: note = Synthetic Construct
  source 1..22: mol_type = other DNA
ccttgaatctggctgacttggt

SEQ ID NO: 3986 - DNA, 22 bp, synthetic construct
  misc_feature 1..22: note = Synthetic Construct
  source 1..22: mol_type = other DNA
tcttccaccccatatcccatca

SEQ ID NO: 3987 - DNA, 24 bp, synthetic construct
  misc_feature 1..24: note = Synthetic Construct
  source 1..24: mol_type = other DNA
gcttcctaggaggtagtgaatgtc

SEQ ID NO: 3988 - DNA, 24 bp, synthetic construct
  misc_feature 1..24: note = Synthetic Construct
  source 1..24: mol_type = other DNA
ccaccaattcaggaagctctccat

SEQ ID NO: 3989 - DNA, 24 bp, synthetic construct
  misc_feature 1..24: note = Synthetic Construct
  source 1..24: mol_type = other DNA
ggatgaaggcagatccctgaaaca

SEQ ID NO: 3990 - DNA, 22 bp, synthetic construct
  misc_feature 1..22: note = Synthetic Construct
  source 1..22: mol_type = other DNA
tgagatctgggatgcgtgcttt

SEQ ID NO: 3991 - DNA, 24 bp, synthetic construct
  misc_feature 1..24: note = Synthetic Construct
  source 1..24: mol_type = other DNA
tggtgcaagagagggttacttcac

SEQ ID NO: 3992 - DNA, 21 bp, synthetic construct
  misc_feature 1..21: note = Synthetic Construct
  source 1..21: mol_type = other DNA
agagtggagaagcaggacaga

SEQ ID NO: 3993 - DNA, 22 bp, synthetic construct
  misc_feature 1..22: note = Synthetic Construct
  source 1..22: mol_type = other DNA
gagactcaatcctggcacttgt

SEQ ID NO: 3994 - DNA, 27 bp, synthetic construct
  misc_feature 1..27: note = Synthetic Construct
  source 1..27: mol_type = other DNA
gacattggatagttcagagcaaatcca

SEQ ID NO: 3995 - DNA, 23 bp, synthetic construct
  misc_feature 1..23: note = Synthetic Construct
  source 1..23: mol_type = other DNA
tgaatgttccaggcagaaggaat

SEQ ID NO: 3996 - DNA, 25 bp, synthetic construct
  misc_feature 1..25: note = Synthetic Construct
  source 1..25: mol_type = other DNA
ggctttgaacaggaacacactatcc

SEQ ID NO: 3997 - DNA, 18 bp, synthetic construct
  misc_feature 1..18: note = Synthetic Construct
  source 1..18: mol_type = other DNA
agctgctcctgggttcca

SEQ ID NO: 3998 - DNA, 26 bp, synthetic construct
  misc_feature 1..26: note = Synthetic Construct
  source 1..26: mol_type = other DNA
tgctaatctaaacatggacctgagtt

SEQ ID NO: 3999 - DNA, 24 bp, synthetic construct
  misc_feature 1..24: note = Synthetic Construct
  source 1..24: mol_type = other DNA
cctgattctgagccactgttccat

SEQ ID NO: 4000 - DNA, 26 bp, synthetic construct
  misc_feature 1..26: note = Synthetic Construct
  source 1..26: mol_type = other DNA
cttatattgctgccatctggattcag

SEQ ID NO: 4001 - DNA, 20 bp, synthetic construct
  misc_feature 1..20: note = Synthetic Construct
  source 1..20: mol_type = other DNA
accatagggcctctgttggt

SEQ ID NO: 4002 - DNA, 28 bp, synthetic construct
  misc_feature 1..28: note = Synthetic Construct
  source 1..28: mol_type = other DNA
ttcatgtgtgtctttagtttcaaacact

SEQ ID NO: 4003 - DNA, 24 bp, synthetic construct
  misc_feature 1..24: note = Synthetic Construct
  source 1..24: mol_type = other DNA
ggaagttctactcaaggcagagaa

SEQ ID NO: 4004 - DNA, 23 bp, synthetic construct
  misc_feature 1..23: note = Synthetic Construct
  source 1..23: mol_type = other DNA
ctctctgaatgctccctcacatt

SEQ ID NO: 4005 - DNA, 27 bp, synthetic construct
  misc_feature 1..27: note = Synthetic Construct
  source 1..27: mol_type = other DNA
agaaaagttttgttaccacttgcaatg

SEQ ID NO: 4006 - DNA, 21 bp, synthetic construct
  misc_feature 1..21: note = Synthetic Construct
  source 1..21: mol_type = other DNA
ccaccactgccctgatatgac

SEQ ID NO: 4007 - DNA, 22 bp, synthetic construct
  misc_feature 1..22: note = Synthetic Construct
  source 1..22: mol_type = other DNA
gctgagggtttgaatggggaaa

SEQ ID NO: 4008 - DNA, 27 bp, synthetic construct
  misc_feature 1..27: note = Synthetic Construct
  source 1..27: mol_type = other DNA
gtagatgactgggttggttatgaaaac

SEQ ID NO: 4009 - DNA, 20 bp, synthetic construct
  misc_feature 1..20: note = Synthetic Construct
  source 1..20: mol_type = other DNA
ccacagccagcagaaccata

SEQ ID NO: 4010 - DNA, 25 bp, synthetic construct
  misc_feature 1..25: note = Synthetic Construct
  source 1..25: mol_type = other DNA
gactatgctcctcttcacaatttgg

SEQ ID NO: 4011 - DNA, 20 bp, synthetic construct
  misc_feature 1..20: note = Synthetic Construct
  source 1..20: mol_type = other DNA
cacctcacaggatgcaccat

SEQ ID NO: 4012 - DNA, 22 bp, synthetic construct
  misc_feature 1..22: note = Synthetic Construct
  source 1..22: mol_type = other DNA
acccagcccgaattctttgctt

SEQ ID NO: 4013 - DNA, 24 bp, synthetic construct
  misc_feature 1..24: note = Synthetic Construct
  source 1..24: mol_type = other DNA
acagatagcgcttgtaaagttcca

SEQ ID NO: 4014 - DNA, 21 bp, synthetic construct
  misc_feature 1..21: note = Synthetic Construct
  source 1..21: mol_type = other DNA
cgcaaagggcacttgttggat

SEQ ID NO: 4015 - DNA, 27 bp, synthetic construct
  misc_feature 1..27: note = Synthetic Construct
  source 1..27: mol_type = other DNA
ctgctgaatttttaaggagaggaaggt

SEQ ID NO: 4016 - DNA, 22 bp, synthetic construct
  misc_feature 1..22: note = Synthetic Construct
  source 1..22: mol_type = other DNA
ccagggtcacaaaaagcagaca

SEQ ID NO: 4017 - DNA, 25 bp, synthetic construct
  misc_feature 1..25: note = Synthetic Construct
  source 1..25: mol_type = other DNA
ggcagatcaaaggaaccaggttttg

SEQ ID NO: 4018 - DNA, 25 bp, synthetic construct
  misc_feature 1..25: note = Synthetic Construct
  source 1..25: mol_type = other DNA
gggatgacagtcaggaagtttttgg

SEQ ID NO: 4019 - DNA, 22 bp, synthetic construct
  misc_feature 1..22: note = Synthetic Construct
  source 1..22: mol_type = other DNA
gcagttgggcagcagatattgt

SEQ ID NO: 4020 - DNA, 18 bp, synthetic construct
  misc_feature 1..18: note = Synthetic Construct
  source 1..18: mol_type = other DNA
tgcccagccccacactgt

SEQ ID NO: 4021 - DNA, 19 bp, synthetic construct
  misc_feature 1..19: note = Synthetic Construct
  source 1..19: mol_type = other DNA
agtaggggaggggcacatg

SEQ ID NO: 4022 - DNA, 24 bp, synthetic construct
  misc_feature 1..24: note = Synthetic Construct
  source 1..24: mol_type = other DNA
gcttttaccaaagaacggctgttg

SEQ ID NO: 4023 - DNA, 20 bp, synthetic construct
  misc_feature 1..20: note = Synthetic Construct
  source 1..20: mol_type = other DNA
atgggctctttgtgccacaa

SEQ ID NO: 4024 - DNA, 22 bp, synthetic construct
  misc_feature 1..22: note = Synthetic Construct
  source 1..22: mol_type = other DNA
cctttatcccccatggcaagtt

SEQ ID NO: 4025 - DNA, 21 bp, synthetic construct
  misc_feature 1..21: note = Synthetic Construct
  source 1..21: mol_type = other DNA
atcagcattggccagttctgt

SEQ ID NO: 4026 - DNA, 22 bp, synthetic construct
  misc_feature 1..22: note = Synthetic Construct
  source 1..22: mol_type = other DNA
tgggccccactggatgtaaagt

SEQ ID NO: 4027 - DNA, 22 bp, synthetic construct
  misc_feature 1..22: note = Synthetic Construct
  source 1..22: mol_type = other DNA
actcacaagggtgcaaggaatg

SEQ ID NO: 4028 - DNA, 23 bp, synthetic construct
  misc_feature 1..23: note = Synthetic Construct
  source 1..23: mol_type = other DNA
agagcttcagaccctactgactt

SEQ ID NO: 4029 - DNA, 24 bp, synthetic construct
  misc_feature 1..24: note = Synthetic Construct
  source 1..24: mol_type = other DNA
caagtgcaaaacatcatggttgga

SEQ ID NO: 4030 - DNA, 21 bp, synthetic construct
  misc_feature 1..21: note = Synthetic Construct
  source 1..21: mol_type = other DNA
acggtggtcatgtctctacca

SEQ ID NO: 4031 - DNA, 22 bp, synthetic construct
  misc_feature 1..22: note = Synthetic Construct
  source 1..22: mol_type = other DNA
tggccacacaacaggctcattt

SEQ ID NO: 4032 - DNA, 21 bp, synthetic construct
  misc_feature 1..21: note = Synthetic Construct
  source 1..21: mol_type = other DNA
gccagttagtcacctgtgtga

SEQ ID NO: 4033 - DNA, 19 bp, synthetic construct
  misc_feature 1..19: note = Synthetic Construct
  source 1..19: mol_type = other DNA
cacacccaggggcatgctt

SEQ ID NO: 4034 - DNA, 22 bp, synthetic construct
  misc_feature 1..22: note = Synthetic Construct
  source 1..22: mol_type = other DNA
gcgctttctccacactctgttt

SEQ ID NO: 4035 - DNA, 22 bp, synthetic construct
  misc_feature 1..22: note = Synthetic Construct
  source 1..22: mol_type = other DNA
tcctgcagtgaggcaaaacttc

SEQ ID NO: 4036 - DNA, 28 bp, synthetic construct
  misc_feature 1..28: note = Synthetic Construct
  source 1..28: mol_type = other DNA
gagatcttaaggtgtcattgttcatagc

SEQ ID NO: 4037 - DNA, 25 bp, synthetic construct
  misc_feature 1..25: note = Synthetic Construct
  source 1..25: mol_type = other DNA
cagaaggggtagaaaacagcctttc

SEQ ID NO: 4038 - DNA, 27 bp, synthetic construct
  misc_feature 1..27: note = Synthetic Construct
  source 1..27: mol_type = other DNA
cctgagacacacttagtcactcctact

SEQ ID NO: 4039 - DNA, 21 bp, synthetic construct
  misc_feature 1..21: note = Synthetic Construct
  source 1..21: mol_type = other DNA
tcaactgcagacccagaaacc

SEQ ID NO: 4040 - DNA, 22 bp, synthetic construct
  misc_feature 1..22: note = Synthetic Construct
  source 1..22: mol_type = other DNA
tcttcagcaggtgtcaccagat

SEQ ID NO: 4041 - DNA, 22 bp, synthetic construct
  misc_feature 1..22: note = Synthetic Construct
  source 1..22: mol_type = other DNA
atggctacagaccaggaaaagg

SEQ ID NO: 4042 - DNA, 22 bp, synthetic construct
  misc_feature 1..22: note = Synthetic Construct
  source 1..22: mol_type = other DNA
tcaggtacagctcaacccatca

SEQ ID NO: 4043 - DNA, 21 bp, synthetic construct
  misc_feature 1..21: note = Synthetic Construct
  source 1..21: mol_type = other DNA
ggggctgccaaaagtaaaacc

SEQ ID NO: 4044 - DNA, 27 bp, synthetic construct
  misc_feature 1..27: note = Synthetic Construct
  source 1..27: mol_type = other DNA
cctgccaactgttctttgatcctctag

SEQ ID NO: 4045 - DNA, 21 bp, synthetic construct
  misc_feature 1..21: note = Synthetic Construct
  source 1..21: mol_type = other DNA
agcagcaagcagcctattctg

SEQ ID NO: 4046 - DNA, 24 bp, synthetic construct
  misc_feature 1..24: note = Synthetic Construct
  source 1..24: mol_type = other DNA
agcagggatcacagcattatactc

SEQ ID NO: 4047 - DNA, 19 bp, synthetic construct
  misc_feature 1..19: note = Synthetic Construct
  source 1..19: mol_type = other DNA
aggcccacacaccccatga

SEQ ID NO: 4048 - DNA, 24 bp, synthetic construct
  misc_feature 1..24: note = Synthetic Construct
  source 1..24: mol_type = other DNA
tcactggcttcttccctgagtaag

SEQ ID NO: 4049 - DNA, 21 bp, synthetic construct
  misc_feature 1..21: note = Synthetic Construct
  source 1..21: mol_type = other DNA
gttgtttctgtgccccttcca

SEQ ID NO: 4050 - DNA, 22 bp, synthetic construct
  misc_feature 1..22: note = Synthetic Construct
  source 1..22: mol_type = other DNA
tgttgtggagtgagtgcaagtt

SEQ ID NO: 4051 - DNA, 23 bp, synthetic construct
  misc_feature 1..23: note = Synthetic Construct
  source 1..23: mol_type = other DNA
aacactggtctctggtagaagga

SEQ ID NO: 4052 - DNA, 22 bp, synthetic construct
  misc_feature 1..22: note = Synthetic Construct
  source 1..22: mol_type = other DNA
tgacccctctggctatcacatt

SEQ ID NO: 4053 - DNA, 21 bp, synthetic construct
  misc_feature 1..21: note = Synthetic Construct
  source 1..21: mol_type = other DNA
cactgggaggggtaacaagga

SEQ ID NO: 4054 - DNA, 22 bp, synthetic construct
  misc_feature 1..22: note = Synthetic Construct
  source 1..22: mol_type = other DNA
acaactctgaagtgagcgttgt

SEQ ID NO: 4055 - DNA, 22 bp, synthetic construct
  misc_feature 1..22: note = Synthetic Construct
  source 1..22: mol_type = other DNA
gcctgacatacatcctgggaaa

SEQ ID NO: 4056 - DNA, 20 bp, synthetic construct
  misc_feature 1..20: note = Synthetic Construct
  source 1..20: mol_type = other DNA
ccctgcctccccaacagtga

SEQ ID NO: 4057 - DNA, 23 bp, synthetic construct
  misc_feature 1..23: note = Synthetic Construct
  source 1..23: mol_type = other DNA
aggctacactcgagggatcttct

SEQ ID NO: 4058 - DNA, 25 bp, synthetic construct
  misc_feature 1..25: note = Synthetic Construct
  source 1..25: mol_type = other DNA
tcattcatagcagtgcaagaatgga

SEQ ID NO: 4059 - DNA, 22 bp, synthetic construct
  misc_feature 1..22: note = Synthetic Construct
  source 1..22: mol_type = other DNA
accttgcctggtatgggttgaa

SEQ ID NO: 4060 - DNA, 24 bp, synthetic construct
  misc_feature 1..24: note = Synthetic Construct
  source 1..24: mol_type = other DNA
aataaaagtcctctgccgaagaca

SEQ ID NO: 4061 - DNA, 24 bp, synthetic construct
  misc_feature 1..24: note = Synthetic Construct
  source 1..24: mol_type = other DNA
cctcttccctttcctactgtcaca

SEQ ID NO: 4062 - DNA, 24 bp, synthetic construct
  misc_feature 1..24: note = Synthetic Construct
  source 1..24: mol_type = other DNA
atgaatcctgccatgtaggtgtag

SEQ ID NO: 4063 - DNA, 25 bp, synthetic construct
  misc_feature 1..25: note = Synthetic Construct
  source 1..25: mol_type = other DNA
catgtatagcccttcctcctttctt

SEQ ID NO: 4064 - DNA, 23 bp, synthetic construct
  misc_feature 1..23: note = Synthetic Construct
  source 1..23: mol_type = other DNA
cagcatgggaatttgggtagaca

SEQ ID NO: 4065 - DNA, 24 bp, synthetic construct
  misc_feature 1..24: note = Synthetic Construct
  source 1..24: mol_type = other DNA
ggtctcagactaggcagaatttgg

SEQ ID NO: 4066 - DNA, 27 bp, synthetic construct
  misc_feature 1..27: note = Synthetic Construct
  source 1..27: mol_type = other DNA
tgtggactttatttgaatggagactga

SEQ ID NO: 4067 - DNA, 20 bp, synthetic construct
  misc_feature 1..20: note = Synthetic Construct
  source 1..20: mol_type = other DNA
tctgcaggccatctctgcat

SEQ ID NO: 4068 - DNA, 24 bp, synthetic construct
  misc_feature 1..24: note = Synthetic Construct
  source 1..24: mol_type = other DNA
accagagccctccattcctaaact

SEQ ID NO: 4069 - DNA, 18 bp, synthetic construct
  misc_feature 1..18: note = Synthetic Construct
  source 1..18: mol_type = other DNA
ccaggaggcgggaatcac

SEQ ID NO: 4070 - DNA, 29 bp, synthetic construct
  misc_feature 1..29: note = Synthetic Construct
  source 1..29: mol_type = other DNA
ctgatcaaatttagtctggatgtgaccaa

SEQ ID NO: 4071 - DNA, 20 bp, synthetic construct
  misc_feature 1..20: note = Synthetic Construct
  source 1..20: mol_type = other DNA
taggtgccatggcccagaca

SEQ ID NO: 4072 - DNA, 20 bp, synthetic construct
  misc_feature 1..20: note = Synthetic Construct
  source 1..20: mol_type = other DNA
gcagaggctctgtgctatgt

SEQ ID NO: 4073 - DNA, 23 bp, synthetic construct
  misc_feature 1..23: note = Synthetic Construct
  source 1..23: mol_type = other DNA
tgggggaatgaatggaagatgag

SEQ ID NO: 4074 - DNA, 24 bp, synthetic construct
  misc_feature 1..24: note = Synthetic Construct
  source 1..24: mol_type = other DNA
gactaccctttgcaattggaagca

SEQ ID NO: 4075 - DNA, 22 bp, synthetic construct
  misc_feature 1..22: note = Synthetic Construct
  source 1..22: mol_type = other DNA
caacagacctggctaggagcta

SEQ ID NO: 4076 - DNA, 18 bp, synthetic construct
  misc_feature 1..18: note = Synthetic Construct
  source 1..18: mol_type = other DNA
agccctgtggtgccaaac

SEQ ID NO: 4077 - DNA, 25 bp, synthetic construct
  misc_feature 1..25: note = Synthetic Construct
  source 1..25: mol_type = other DNA
ctgcatgaagtattctgcactactg

SEQ ID NO: 4078 - DNA, 24 bp, synthetic construct
  misc_feature 1..24: note = Synthetic Construct
  source 1..24: mol_type = other DNA
caaactccctttggctagagagaa

SEQ ID NO: 4079 - DNA, 22 bp, synthetic construct
  misc_feature 1..22: note = Synthetic Construct
  source 1..22: mol_type = other DNA
cactgggttagatcgccagttt

SEQ ID NO: 4080 - DNA, 22 bp, synthetic construct
  misc_feature 1..22: note = Synthetic Construct
  source 1..22: mol_type = other DNA
tcctggtgatgtgggggaatat

SEQ ID NO: 4081 - DNA, 24 bp, synthetic construct
  misc_feature 1..24: note = Synthetic Construct
  source 1..24: mol_type = other DNA
gctaggattcctgggtgttctgtt

SEQ ID NO: 4082 - DNA, 22 bp, synthetic construct
  misc_feature 1..22: note = Synthetic Construct
  source 1..22: mol_type = other DNA
tctgggagccgaaattccttct

SEQ ID NO: 4083 - DNA, 24 bp, synthetic construct
  misc_feature 1..24: note = Synthetic Construct
  source 1..24: mol_type = other DNA
gaacttaccaaggtagccagatgt

SEQ ID NO: 4084 - DNA, 22 bp, synthetic construct
  misc_feature 1..22: note = Synthetic Construct
  source 1..22: mol_type = other DNA
caagatgctcaccccatacctt

SEQ ID NO: 4085 - DNA, 24 bp, synthetic construct
  misc_feature 1..24: note = Synthetic Construct
  source 1..24: mol_type = other DNA
cccggccatcctgaattttattgc

SEQ ID NO: 4086 - DNA, 22 bp, synthetic construct
  misc_feature 1..22: note = Synthetic Construct
  source 1..22: mol_type = other DNA
agaggactgggctcttgctatt

SEQ ID NO: 4087 - DNA, 20 bp, synthetic construct
  misc_feature 1..20: note = Synthetic Construct
  source 1..20: mol_type = other DNA
ctggggccagtcatccctat

SEQ ID NO: 4088 - DNA, 20 bp, synthetic construct
  misc_feature 1..20: note = Synthetic Construct
  source 1..20: mol_type = other DNA
tgaggcagggtgggctatca

SEQ ID NO: 4089 - DNA, 20 bp, synthetic construct
  misc_feature 1..20: note = Synthetic Construct
  source 1..20: mol_type = other DNA
tgctcagttccacccaaacc

SEQ ID NO: 4090 - DNA, 25 bp, synthetic construct
  misc_feature 1..25: note = Synthetic Construct
  source 1..25: mol_type = other DNA
aggctatatgagagcaggctaatct

SEQ ID NO: 4091 - DNA, 22 bp, synthetic construct
  misc_feature 1..22: note = Synthetic Construct
  source 1..22: mol_type = other DNA
gcaacgggagggaaaagtttct

SEQ ID NO: 4092 - DNA, 22 bp, synthetic construct
  misc_feature 1..22: note = Synthetic Construct
  source 1..22: mol_type = other DNA
tcccacctcctgtctcttgaga

SEQ ID NO: 4093 - DNA, 24 bp, synthetic construct
  misc_feature 1..24: note = Synthetic Construct
  source 1..24: mol_type = other DNA
cccattggccataactcagctaca

SEQ ID NO: 4094 - DNA, 24 bp, synthetic construct
  misc_feature 1..24: note = Synthetic Construct
  source 1..24: mol_type = other DNA
ggggccataacttctggattgtgt

SEQ ID NO: 4095 - DNA, 20 bp, synthetic construct
  misc_feature 1..20: note = Synthetic Construct
  source 1..20: mol_type = other DNA
acctctgaggcaaggacctt

SEQ ID NO: 4096 - DNA, 25 bp, synthetic construct
  misc_feature 1..25: note = Synthetic Construct
  source 1..25: mol_type = other DNA
ctaactgcacagagaagagcaaatg

SEQ ID NO: 4097 - DNA, 22 bp, synthetic construct
  misc_feature 1..22: note = Synthetic Construct
  source 1..22: mol_type = other DNA
cgctgttcctgaatgccattag

SEQ ID NO: 4098 - DNA, 26 bp, synthetic construct
  misc_feature 1..26: note = Synthetic Construct
  source 1..26: mol_type = other DNA
ctgagtaggacagtgatgttgtcaga

SEQ ID NO: 4099 - DNA, 22 bp, synthetic construct
  misc_feature 1..22: note = Synthetic Construct
  source 1..22: mol_type = other DNA
agacctcttcgcctctttgttc

SEQ ID NO: 4100 - DNA, 27 bp, synthetic construct
  misc_feature 1..27: note = Synthetic Construct
  source 1..27: mol_type = other DNA
gcaaaatgagagtaaaatgctgctgaa

SEQ ID NO: 4101 - DNA, 24 bp, synthetic construct
  misc_feature 1..24: note = Synthetic Construct
  source 1..24: mol_type = other DNA
cctcctaaaaagccagtccctctt

SEQ ID NO: 4102 - DNA, 22 bp, synthetic construct
  misc_feature 1..22: note = Synthetic Construct
  source 1..22: mol_type = other DNA
aacccagagacacacctatcct

SEQ ID NO: 4103 - DNA, 26 bp, synthetic construct
  misc_feature 1..26: note = Synthetic Construct
  source 1..26: mol_type = other DNA
gcaggtctatacaatcctacccacaa

SEQ ID NO: 4104 - DNA, 22 bp, synthetic construct
  misc_feature 1..22: note = Synthetic Construct
  source 1..22: mol_type = other DNA
tccctgtccttgacgcttaact

SEQ ID NO: 4105 - DNA, 24 bp, synthetic construct
  misc_feature 1..24: note = Synthetic Construct
  source 1..24: mol_type = other DNA
cagagggtaataagtggcgcctta

SEQ ID NO: 4106 - DNA, 21 bp, synthetic construct
  misc_feature 1..21: note = Synthetic Construct
  source 1..21: mol_type = other DNA
acccacgtggtctcagagtct

SEQ ID NO: 4107 - DNA, 22 bp, synthetic construct
  misc_feature 1..22: note = Synthetic Construct
  source 1..22: mol_type = other DNA
aagcattcccttcctcctgcaa

SEQ ID NO: 4108 - DNA, 22 bp, synthetic construct
  misc_feature 1..22: note = Synthetic Construct
  source 1..22: mol_type = other DNA
acccctcacttccaaccttttg

SEQ ID NO: 4109 - DNA, 24 bp, synthetic construct
  misc_feature 1..24: note = Synthetic Construct
  source 1..24: mol_type = other DNA
ctggtggcatgagcaacttatagt

SEQ ID NO: 4110 - DNA, 24 bp, synthetic construct
  misc_feature 1..24: note = Synthetic Construct
  source 1..24: mol_type = other DNA
ctgacttcctcccctcaattttct

SEQ ID NO: 4111 - DNA, 22 bp, synthetic construct
  misc_feature 1..22: note = Synthetic Construct
  source 1..22: mol_type = other DNA
aggaaacgtcccctgctcacta

SEQ ID NO: 4112 - DNA, 24 bp, synthetic construct
  misc_feature 1..24: note = Synthetic Construct
  source 1..24: mol_type = other DNA
gagtagattggaaggggcaaacag

SEQ ID NO: 4113 - DNA, 21 bp, synthetic construct
  misc_feature 1..21: note = Synthetic Construct
  source 1..21: mol_type = other DNA
ctgacaacactcccagcaagt

SEQ ID NO: 4114 - DNA, 20 bp, synthetic construct
  misc_feature 1..20: note = Synthetic Construct
  source 1..20: mol_type = other DNA
ggatgaaggccaggctgtag

SEQ ID NO: 4115 - DNA, 27 bp, synthetic construct
  misc_feature 1..27: note = Synthetic Construct
  source 1..27: mol_type = other DNA
cgcttaagtgttcattgcctataacac

SEQ ID NO: 4116 - DNA, 23 bp, synthetic construct
  misc_feature 1..23: note = Synthetic Construct
  source 1..23: mol_type = other DNA
cctctcctcagatgcctgtttct

SEQ ID NO: 4117 - DNA, 24 bp, synthetic construct
  misc_feature 1..24: note = Synthetic Construct
  source 1..24: mol_type = other DNA
agacctactcatcccttgcttaga

SEQ ID NO: 4118 - DNA, 23 bp, synthetic construct
  misc_feature 1..23: note = Synthetic Construct
  source 1..23: mol_type = other DNA
gttcaaacggtgctagcttagac

SEQ ID NO: 4119 - DNA, 26 bp, synthetic construct
  misc_feature 1..26: note = Synthetic Construct
  source 1..26: mol_type = other DNA
acaacggtaagtgtatgatcatgtct

SEQ ID NO: 4120 - DNA, 22 bp, synthetic construct
  misc_feature 1..22: note = Synthetic Construct
  source 1..22: mol_type = other DNA
aagttggtcagggaaggcagat

SEQ ID NO: 4121 - DNA, 22 bp, synthetic construct
  misc_feature 1..22: note = Synthetic Construct
  source 1..22: mol_type = other DNA
cttggcactgtcccagttctaa

SEQ ID NO: 4122 - DNA, 26 bp, synthetic construct
  misc_feature 1..26: note = Synthetic Construct
  source 1..26: mol_type = other DNA
catgactcatagaccctctactcaac

SEQ ID NO: 4123 - DNA, 22 bp, synthetic construct
  misc_feature 1..22: note = Synthetic Construct
  source 1..22: mol_type = other DNA
gcaggcttcttgaggtcaagga

SEQ ID NO: 4124 - DNA, 20 bp, synthetic construct
  misc_feature 1..20: note = Synthetic Construct
  source 1..20: mol_type = other DNA
atggtgactcgtggggtcat

SEQ ID NO: 4125 - DNA, 22 bp, synthetic construct
  misc_feature 1..22: note = Synthetic Construct
  source 1..22: mol_type = other DNA
agctggatcctccggacaaaga

SEQ ID NO: 4126 - DNA, 24 bp, synthetic construct
  misc_feature 1..24: note = Synthetic Construct
  source 1..24: mol_type = other DNA
gccttctcgacccatctgtgataa

SEQ ID NO: 4127 - DNA, 24 bp, synthetic construct
  misc_feature 1..24: note = Synthetic Construct
  source 1..24: mol_type = other DNA
cctttaccttgacacgggacaaac

SEQ ID NO: 4128 - DNA, 24 bp, synthetic construct
  misc_feature 1..24: note = Synthetic Construct
  source 1..24: mol_type = other DNA
tcccatgaaccacttttcctaagg

SEQ ID NO: 4129 - DNA, 22 bp, synthetic construct
  misc_feature 1..22: note = Synthetic Construct
  source 1..22: mol_type = other DNA
tgtagagagccatgtccctgaa

SEQ ID NO: 4130 - DNA, 25 bp, synthetic construct
  misc_feature 1..25: note = Synthetic Construct
  source 1..25: mol_type = other DNA
tgttccctgcagataccagttattg

SEQ ID NO: 4131 - DNA, 20 bp, synthetic construct
  misc_feature 1..20: note = Synthetic Construct
  source 1..20: mol_type = other DNA
atgcaggctctggatttgca

SEQ ID NO: 4132 - DNA, 23 bp, synthetic construct
  misc_feature 1..23: note = Synthetic Construct
  source 1..23: mol_type = other DNA
ggtgagaggcaagagaaagtctt

SEQ ID NO: 4133 - DNA, 26 bp, synthetic construct
  misc_feature 1..26: note = Synthetic Construct
  source 1..26: mol_type = other DNA
gggggaggctttattcaaaaggagaa

SEQ ID NO: 4134 - DNA, 24 bp, synthetic construct
  misc_feature 1..24: note = Synthetic Construct
  source 1..24: mol_type = other DNA
ggcagatagggaagagtctagact

SEQ ID NO: 4135 - DNA, 21 bp, synthetic construct
  misc_feature 1..21: note = Synthetic Construct
  source 1..21: mol_type = other DNA
tggctcctgaactttggcttt

SEQ ID NO: 4136 - DNA, 21 bp, synthetic construct
  misc_feature 1..21: note = Synthetic Construct
  source 1..21: mol_type = other DNA
tggcttctagtggccttttcc

SEQ ID NO: 4137 - DNA, 22 bp, synthetic construct
  misc_feature 1..22: note = Synthetic Construct
  source 1..22: mol_type = other DNA
gccccttggtctctactcagta

SEQ ID NO: 4138 - DNA, 24 bp, synthetic construct
  misc_feature 1..24: note = Synthetic Construct
  source 1..24: mol_type = other DNA
tctacacttcctacacagcttcac

SEQ ID NO: 4139 - DNA, 23 bp, synthetic construct
  misc_feature 1..23: note = Synthetic Construct
  source 1..23: mol_type = other DNA
tgggaggatgttcacttctagct

SEQ ID NO: 4140 - DNA, 24 bp, synthetic construct
  misc_feature 1..24: note = Synthetic Construct
  source 1..24: mol_type = other DNA
accggtaaagcagtactacaggta

SEQ ID NO: 4141 - DNA, 24 bp, synthetic construct
  misc_feature 1..24: note = Synthetic Construct
  source 1..24: mol_type = other DNA
gctacctcgatccactttctaaca

SEQ ID NO: 4142 - DNA, 21 bp, synthetic construct
  misc_feature 1..21: note = Synthetic Construct
  source 1..21: mol_type = other DNA
ttagcacccctgcggctttca

SEQ ID NO: 4143 - DNA, 22 bp, synthetic construct
  misc_feature 1..22: note = Synthetic Construct
  source 1..22: mol_type = other DNA
gacagctgaaagggttggatgt

SEQ ID NO: 4144 - DNA, 24 bp, synthetic construct
  misc_feature 1..24: note = Synthetic Construct
  source 1..24: mol_type = other DNA
gcacagctaatatgagggcagagt

SEQ ID NO: 4145 - DNA, 22 bp, synthetic construct
  misc_feature 1..22: note = Synthetic Construct
  source 1..22: mol_type = other DNA
aaagccacaggactggaagaga

SEQ ID NO: 4146 - DNA, 26 bp, synthetic construct
  misc_feature 1..26: note = Synthetic Construct
  source 1..26: mol_type = other DNA
gtgagggtagaaccagaatcaattcc

SEQ ID NO: 4147 - DNA, 26 bp, synthetic construct
  misc_feature 1..26: note = Synthetic Construct
  source 1..26: mol_type = other DNA
gactggcattacatcttagtcactgt

SEQ ID NO: 4148 - DNA, 24 bp, synthetic construct
  misc_feature 1..24: note = Synthetic Construct
  source 1..24: mol_type = other DNA
ggttttcttcctgttctccttggt

SEQ ID NO: 4149 - DNA, 24 bp, synthetic construct
  misc_feature 1..24: note = Synthetic Construct
  source 1..24: mol_type = other DNA
gctttgtttgctactgatgcattg

SEQ ID NO: 4150 - DNA, 27 bp, synthetic construct
  misc_feature 1..27: note = Synthetic Construct
  source 1..27: mol_type = other DNA
ctgcagctttatttttacacacttgct

SEQ ID NO: 4151 - DNA, 25 bp, synthetic construct
  misc_feature 1..25: note = Synthetic Construct
  source 1..25: mol_type = other DNA
ctcatcaatgcctccttccttgaac

SEQ ID NO: 4152 - DNA, 26 bp, synthetic construct
  misc_feature 1..26: note = Synthetic Construct
  source 1..26: mol_type = other DNA
cccaccaaatacaggatagctttgag

SEQ ID NO: 4153 - DNA, 27 bp, synthetic construct
  misc_feature 1..27: note = Synthetic Construct
  source 1..27: mol_type = other DNA
cctgtcctatgcacccaaaattatgct

SEQ ID NO: 4154 - DNA, 23 bp, synthetic construct
  misc_feature 1..23: note = Synthetic Construct
  source 1..23: mol_type = other DNA
ccacctgtaccctgtggtatgaa

SEQ ID NO: 4155 - DNA, 23 bp, synthetic construct
  misc_feature 1..23: note = Synthetic Construct
  source 1..23: mol_type = other DNA
tttcccccatgtcttccataacc

SEQ ID NO: 4156 - DNA, 20 bp, synthetic construct
  misc_feature 1..20: note = Synthetic Construct
  source 1..20: mol_type = other DNA
gccagaagccaggtgtcctt

SEQ ID NO: 4157 - DNA, 21 bp, synthetic construct
  misc_feature 1..21: note = Synthetic Construct
  source 1..21: mol_type = other DNA
agtccctgtgtgagtccaact

SEQ ID NO: 4158 - DNA, 22 bp, synthetic construct
  misc_feature 1..22: note = Synthetic Construct
  source 1..22: mol_type = other DNA
cacctatgcccacatacacaca

SEQ ID NO: 4159 - DNA, 23 bp, synthetic construct
  misc_feature 1..23: note = Synthetic Construct
  source 1..23: mol_type = other DNA
gccttctatgtttctggccaact

SEQ ID NO: 4160 - DNA, 23 bp, synthetic construct
  misc_feature 1..23: note = Synthetic Construct
  source 1..23: mol_type = other DNA
acatgctttgagctctgatggtt

SEQ ID NO: 4161 - DNA, 25 bp, synthetic construct
  misc_feature 1..25: note = Synthetic Construct
  source 1..25: mol_type = other DNA
gcctcaagctatgtcttgtctgcat

SEQ ID NO: 4162 - DNA, 24 bp, synthetic construct
  misc_feature 1..24: note = Synthetic Construct
  source 1..24: mol_type = other DNA
gcattgcaacctccatttctagct

SEQ ID NO: 4163 - DNA, 24 bp, synthetic construct
  misc_feature 1..24: note = Synthetic Construct
  source 1..24: mol_type = other DNA
caaatcctcaccctttaggcatca

SEQ ID NO: 4164 - DNA, 20 bp, synthetic construct
  misc_feature 1..20: note = Synthetic Construct
  source 1..20: mol_type = other DNA
gtcactgccagccaaatcct

SEQ ID NO: 4165 - DNA, 26 bp, synthetic construct
  misc_feature 1..26: note = Synthetic Construct
  source 1..26: mol_type = other DNA
gctcatctttgtatctccagcagtga

SEQ ID NO: 4166 - DNA, 24 bp, synthetic construct
  misc_feature 1..24: note = Synthetic Construct
  source 1..24: mol_type = other DNA
ctcagcttcctcatctcacaagga

SEQ ID NO: 4167 - DNA, 20 bp, synthetic construct
  misc_feature 1..20: note = Synthetic Construct
  source 1..20: mol_type = other DNA
gatcccccagttccctccaa

SEQ ID NO: 4168 - DNA, 24 bp, synthetic construct
  misc_feature 1..24: note = Synthetic Construct
  source 1..24: mol_type = other DNA
ggagattccttgaacatggagtct

SEQ ID NO: 4169 - DNA, 20 bp, synthetic construct
  misc_feature 1..20: note = Synthetic Construct
  source 1..20: mol_type = other DNA
gcccactcagctccacacaa

SEQ ID NO: 4170 - DNA, 24 bp, synthetic construct
  misc_feature 1..24: note = Synthetic Construct
  source 1..24: mol_type = other DNA
actcccagtgatccgacaaactat

SEQ ID NO: 4171 - DNA, 22 bp, synthetic construct
  misc_feature 1..22: note = Synthetic Construct
  source 1..22: mol_type = other DNA
cctctgcacttgcttgttacgt

SEQ ID NO: 4172 - DNA, 21 bp, synthetic construct
  misc_feature 1..21: note = Synthetic Construct
  source 1..21: mol_type = other DNA
aaaacctcctggtcccttcca

SEQ ID NO: 4173 - DNA, 24 bp, synthetic construct
  misc_feature 1..24: note = Synthetic Construct
  source 1..24: mol_type = other DNA
ctggaaaattctgtggcaggctat

SEQ ID NO: 4174 - DNA, 24 bp, synthetic construct
  misc_feature 1..24: note = Synthetic Construct
  source 1..24: mol_type = other DNA
gaaggtgtctgactatgccagttc

SEQ ID NO: 4175 - DNA, 20 bp, synthetic construct
  misc_feature 1..20: note = Synthetic Construct
  source 1..20: mol_type = other DNA
agggatggggaacagaagca

SEQ ID NO: 4176 - DNA, 22 bp, synthetic construct
  misc_feature 1..22: note = Synthetic Construct
  source 1..22: mol_type = other DNA
accccagaggaccctgatctta

SEQ ID NO: 4177 - DNA, 21 bp, synthetic construct
  misc_feature 1..21: note = Synthetic Construct
  source 1..21: mol_type = other DNA
acctctcccctcccagaacat

SEQ ID NO: 4178 - DNA, 23 bp, synthetic construct
  misc_feature 1..23: note = Synthetic Construct
  source 1..23: mol_type = other DNA
tgaaatcccgtgaaaccctgtga

SEQ ID NO: 4179 - DNA, 25 bp, synthetic construct
  misc_feature 1..25: note = Synthetic Construct
  source 1..25: mol_type = other DNA
ccccactccctatgttttaggacat

SEQ ID NO: 4180 - DNA, 22 bp, synthetic construct
  misc_feature 1..22: note = Synthetic Construct
  source 1..22: mol_type = other DNA
ggaaacctgctctccattgtga

SEQ ID NO: 4181 - DNA, 22 bp, synthetic construct
  misc_feature 1..22: note = Synthetic Construct
  source 1..22: mol_type = other DNA
gggtgtccctaagatgcatcac

SEQ ID NO: 4182 - DNA, 20 bp, synthetic construct
  misc_feature 1..20: note = Synthetic Construct
  source 1..20: mol_type = other DNA
ccttagtgctggtgctcgtt

SEQ ID NO: 4183 - DNA, 20 bp, synthetic construct
  misc_feature 1..20: note = Synthetic Construct
  source 1..20: mol_type = other DNA
tggctgccaagtggatgctt

SEQ ID NO: 4184 - DNA, 22 bp, synthetic construct
  misc_feature 1..22: note = Synthetic Construct
  source 1..22: mol_type = other DNA
tgcttccggatgtctacaccaa

SEQ ID NO: 4185 - DNA, 21 bp, synthetic construct
  misc_feature 1..21: note = Synthetic Construct
  source 1..21: mol_type = other DNA
gcctcaggcacaagtgttgct

SEQ ID NO: 4186 - DNA, 25 bp, synthetic construct
  misc_feature 1..25: note = Synthetic Construct
  source 1..25: mol_type = other DNA
ccgtcctacctctaaacacagaaca

SEQ ID NO: 4187 - DNA, 22 bp, synthetic construct
  misc_feature 1..22: note = Synthetic Construct
  source 1..22: mol_type = other DNA
agaaggaacctgacagctctgt

SEQ ID NO: 4188 - DNA, 18 bp, synthetic construct
  misc_feature 1..18: note = Synthetic Construct
  source 1..18: mol_type = other DNA
ccagggggaggccactta

SEQ ID NO: 4189 - DNA, 22 bp, synthetic construct
  misc_feature 1..22: note = Synthetic Construct
  source 1..22: mol_type = other DNA
gtggcatgcagtctaggaactt

SEQ ID NO: 4190 - DNA, 20 bp, synthetic construct
  misc_feature 1..20: note = Synthetic Construct
  source 1..20: mol_type = other DNA
gcagccttcccagctgaaga

SEQ ID NO: 4191 - DNA, 22 bp, synthetic construct
  misc_feature 1..22: note = Synthetic Construct
  source 1..22: mol_type = other DNA
ccccctgaaaagcttgtccaat

SEQ ID NO: 4192 - DNA, 20 bp, synthetic construct
  misc_feature 1..20: note = Synthetic Construct
  source 1..20: mol_type = other DNA
cctgcacagggctctgctat

SEQ ID NO: 4193 - DNA, 23 bp, synthetic construct
  misc_feature 1..23: note = Synthetic Construct
  source 1..23: mol_type = other DNA
acctaagactagtgccgtgaagt

SEQ ID NO: 4194 - DNA, 27 bp, synthetic construct
  misc_feature 1..27: note = Synthetic Construct
  source 1..27: mol_type = other DNA
gccaactgacagttatctggtgaagtc

SEQ ID NO: 4195 - DNA, 24 bp, synthetic construct
  misc_feature 1..24: note = Synthetic Construct
  source 1..24: mol_type = other DNA
gctctttttgcccactcttcttca

SEQ ID NO: 4196 - DNA, 20 bp, synthetic construct
  misc_feature 1..20: note = Synthetic Construct
  source 1..20: mol_type = other DNA
tccaagcaacccaacttgca

SEQ ID NO: 4197 - DNA, 24 bp, synthetic construct
  misc_feature 1..24: note = Synthetic Construct
  source 1..24: mol_type = other DNA
gctggaacttcaaagtcccagagt

SEQ ID NO: 4198 - DNA, 27 bp, synthetic construct
  misc_feature 1..27: note = Synthetic Construct
  source 1..27: mol_type = other DNA
tcaaccaatcaccagataactgttgat

SEQ ID NO: 4199 - DNA, 28 bp, synthetic construct
  misc_feature 1..28: note = Synthetic Construct
  source 1..28: mol_type = other DNA
gcaaatagtgctgtgtgtagtgaataca

SEQ ID NO: 4200 - DNA, 22 bp, synthetic construct
  misc_feature 1..22: note = Synthetic Construct
  source 1..22: mol_type = other DNA
gggtgattccgatgctcactta

SEQ ID NO: 4201 - DNA, 26 bp, synthetic construct
  misc_feature 1..26: note = Synthetic Construct
  source 1..26: mol_type = other DNA
ccaacaaccacatgagtttggttgag

SEQ ID NO: 4202 - DNA, 18 bp, synthetic construct
  misc_feature 1..18: note = Synthetic Construct
  source 1..18: mol_type = other DNA
atgcgggcttgctgcata

SEQ ID NO: 4203 - DNA, 24 bp, synthetic construct
  misc_feature 1..24: note = Synthetic Construct
  source 1..24: mol_type = other DNA
gggccacttactcaaagcttcttg

SEQ ID NO: 4204 - DNA, 21 bp, synthetic construct
  misc_feature 1..21: note = Synthetic Construct
  source 1..21: mol_type = other DNA
ttctcctcctgagggcttgct

SEQ ID NO: 4205 - DNA, 23 bp, synthetic construct
  misc_feature 1..23: note = Synthetic Construct
  source 1..23: mol_type = other DNA
caagccatgtctagaaggaaggt

SEQ ID NO: 4206 - DNA, 23 bp, synthetic construct
  misc_feature 1..23: note = Synthetic Construct
  source 1..23: mol_type = other DNA
ctgtcctgcagattccctttgat

SEQ ID NO: 4207 - DNA, 23 bp, synthetic construct
  misc_feature 1..23: note = Synthetic Construct
  source 1..23: mol_type = other DNA
cccaatgaagagagcatggcatt

SEQ ID NO: 4208 - DNA, 23 bp, synthetic construct
  misc_feature 1..23: note = Synthetic Construct
  source 1..23: mol_type = other DNA
ggctaagcaacacacatgtctac

SEQ ID NO: 4209 - DNA, 24 bp, synthetic construct
  misc_feature 1..24: note = Synthetic Construct
  source 1..24: mol_type = other DNA
gcacattctgccccccagatattt

SEQ ID NO: 4210 - DNA, 28 bp, synthetic construct
  misc_feature 1..28: note = Synthetic Construct
  source 1..28: mol_type = other DNA
caatatgggaatcagagggacttaaaac

SEQ ID NO: 4211 - DNA, 21 bp, synthetic construct
  misc_feature 1..21: note = Synthetic Construct
  source 1..21: mol_type = other DNA
tgtcctggtgctctcaatgtc

SEQ ID NO: 4212 - DNA, 25 bp, synthetic construct
  misc_feature 1..25: note = Synthetic Construct
  source 1..25: mol_type = other DNA
ggttgtaactcctgaccgtaatacg

SEQ ID NO: 4213 - DNA, 18 bp, synthetic construct
  misc_feature 1..18: note = Synthetic Construct
  source 1..18: mol_type = other DNA
gggccactgtcgtttgca

SEQ ID NO: 4214 - DNA, 22 bp, synthetic construct
  misc_feature 1..22: note = Synthetic Construct
  source 1..22: mol_type = other DNA
aggccctgaaggagtgagttca

SEQ ID NO: 4215 - DNA, 26 bp, synthetic construct
  misc_feature 1..26: note = Synthetic Construct
  source 1..26: mol_type = other DNA
gagatagtgtcctttgtgtctgaaca

SEQ ID NO: 4216 - DNA, 22 bp, synthetic construct
  misc_feature 1..22: note = Synthetic Construct
  source 1..22: mol_type = other DNA
ggcgtgttgggattttaaacca

SEQ ID NO: 4217 - DNA, 28 bp, synthetic construct
  misc_feature 1..28: note = Synthetic Construct
  source 1..28: mol_type = other DNA
gtgatctatcagttgcaattcagatagc

SEQ ID NO: 4218 - DNA, 27 bp, synthetic construct
  misc_feature 1..27: note = Synthetic Construct
  source 1..27: mol_type = other DNA
tgtggaccaggttaattacattgtctt

SEQ ID NO: 4219 - DNA, 18 bp, synthetic construct
  misc_feature 1..18: note = Synthetic Construct
  source 1..18: mol_type = other DNA
gcgctgccctactttgct

SEQ ID NO: 4220 - DNA, 25 bp, synthetic construct
  misc_feature 1..25: note = Synthetic Construct
  source 1..25: mol_type = other DNA
acaagcagagggagaaataggtcta

SEQ ID NO: 4221 - DNA, 24 bp, synthetic construct
  misc_feature 1..24: note = Synthetic Construct
  source 1..24: mol_type = other DNA
cagttgttaggcagacatcggata

SEQ ID NO: 4222 - DNA, 21 bp, synthetic construct
  misc_feature 1..21: note = Synthetic Construct
  source 1..21: mol_type = other DNA
caccccactcccattgtttga

SEQ ID NO: 4223 - DNA, 24 bp, synthetic construct
  misc_feature 1..24: note = Synthetic Construct
  source 1..24: mol_type = other DNA
cctcccacaattttacccatgtct

SEQ ID NO: 4224 - DNA, 26 bp, synthetic construct
  misc_feature 1..26: note = Synthetic Construct
  source 1..26: mol_type = other DNA
actctgagttgtgtcaaactatcact

SEQ ID NO: 4225 - DNA, 24 bp, synthetic construct
  misc_feature 1..24: note = Synthetic Construct
  source 1..24: mol_type = other DNA
cagtagtttccccaacctcaatgg

SEQ ID NO: 4226 - DNA, 23 bp, synthetic construct
  misc_feature 1..23: note = Synthetic Construct
  source 1..23: mol_type = other DNA
ggcaatgcgaatgagttcctaca

SEQ ID NO: 4227 - DNA, 26 bp, synthetic construct
  misc_feature 1..26: note = Synthetic Construct
  source 1..26: mol_type = other DNA
ccataggtaatcatacgccctgaatc

SEQ ID NO: 4228 - DNA, 27 bp, synthetic construct
  misc_feature 1..27: note = Synthetic Construct
  source 1..27: mol_type = other DNA
gagtttttgagcctagaatgtaaagct

SEQ ID NO: 4229 - DNA, 23 bp, synthetic construct
  misc_feature 1..23: note = Synthetic Construct
  source 1..23: mol_type = other DNA
ggcctgacccatgatgaatagtt

SEQ ID NO: 4230 - DNA, 25 bp, synthetic construct
  misc_feature 1..25: note = Synthetic Construct
  source 1..25: mol_type = other DNA
ccaggtttaaacccacactttatcc

SEQ ID NO: 4231 - DNA, 20 bp, synthetic construct
  misc_feature 1..20: note = Synthetic Construct
  source 1..20: mol_type = other DNA
tggcacagagcagtcactgt

SEQ ID NO: 4232 - DNA, 22 bp, synthetic construct
  misc_feature 1..22: note = Synthetic Construct
  source 1..22: mol_type = other DNA
tgcgaccacagaagtgcaaagt

SEQ ID NO: 4233 - DNA, 21 bp, synthetic construct
  misc_feature 1..21: note = Synthetic Construct
  source 1..21: mol_type = other DNA
aaaacctgtgagggagttgca

SEQ ID NO: 4234 - DNA, 24 bp, synthetic construct
  misc_feature 1..24: note = Synthetic Construct
  source 1..24: mol_type = other DNA
cgggggtactatttctgagatgag

SEQ ID NO: 4235 - DNA, 22 bp, synthetic construct
  misc_feature 1..22: note = Synthetic Construct
  source 1..22: mol_type = other DNA
ctcaaactaccggtctcaagca

SEQ ID NO: 4236 - DNA, 22 bp, synthetic construct
  misc_feature 1..22: note = Synthetic Construct
  source 1..22: mol_type = other DNA
tggcagttggtactagctgcta

SEQ ID NO: 4237 - DNA, 23 bp, synthetic construct
  misc_feature 1..23: note = Synthetic Construct
  source 1..23: mol_type = other DNA
agctgctgcttcacctctttagc

SEQ ID NO: 4238 - DNA, 22 bp, synthetic construct
  misc_feature 1..22: note = Synthetic Construct
  source 1..22: mol_type = other DNA
agcaagctcaaaccccagaagt

SEQ ID NO: 4239 - DNA, 24 bp, synthetic construct
  misc_feature 1..24: note = Synthetic Construct
  source 1..24: mol_type = other DNA
ctctgccaattgttactccagcaa

SEQ ID NO: 4240 - DNA, 21 bp, synthetic construct
  misc_feature 1..21: note = Synthetic Construct
  source 1..21: mol_type = other DNA
tcctgcaatgctgggaaagtg

SEQ ID NO: 4241 - DNA, 25 bp, synthetic construct
  misc_feature 1..25: note = Synthetic Construct
  source 1..25: mol_type = other DNA
ctgaaattccagagggaggtctaag

SEQ ID NO: 4242 - DNA, 25 bp, synthetic construct
  misc_feature 1..25: note = Synthetic Construct
  source 1..25: mol_type = other DNA
gactcgtcttgataggtgatttcca

SEQ ID NO: 4243 - DNA, 23 bp, synthetic construct
  misc_feature 1..23: note = Synthetic Construct
  source 1..23: mol_type = other DNA
ctgttcctaaactgcagcaaagg

SEQ ID NO: 4244 - DNA, 30 bp, synthetic construct
  misc_feature 1..30: note = Synthetic Construct
  source 1..30: mol_type = other DNA
ctctgttgatgaaggtatattccctatagc

SEQ ID NO: 4245 - DNA, 25 bp, synthetic construct
  misc_feature 1..25: note = Synthetic Construct
  source 1..25: mol_type = other DNA
gcctactaacactgggttacaaagg

SEQ ID NO: 4246 - DNA, 21 bp, synthetic construct
  misc_feature 1..21: note = Synthetic Construct
  source 1..21: mol_type = other DNA
tgacaaggagctgacctacct

SEQ ID NO: 4247 - DNA, 27 bp, synthetic construct
  misc_feature 1..27: note = Synthetic Construct
  source 1..27: mol_type = other DNA
cccgcatagaaaagatgattccttggt

SEQ ID NO: 4248 - DNA, 25 bp, synthetic construct
  misc_feature 1..25: note = Synthetic Construct
  source 1..25: mol_type = other DNA
gactgacgttctcaatgtatgcatt

SEQ ID NO: 4249 - DNA, 27 bp, synthetic construct
  misc_feature 1..27: note = Synthetic Construct
  source 1..27: mol_type = other DNA
gaaagttctccttaagtgtctttgcaa

SEQ ID NO: 4250 - DNA, 26 bp, synthetic construct
  misc_feature 1..26: note = Synthetic Construct
  source 1..26: mol_type = other DNA
gccttagaactccatctagacctgta

SEQ ID NO: 4251 - DNA, 25 bp, synthetic construct
  misc_feature 1..25: note = Synthetic Construct
  source 1..25: mol_type = other DNA
gtgccagaaaaacttggtcatttgg

SEQ ID NO: 4252 - DNA, 25 bp, synthetic construct
  misc_feature 1..25: note = Synthetic Construct
  source 1..25: mol_type = other DNA
ccctgtgataaggagggttgttttg

SEQ ID NO: 4253 - DNA, 22 bp, synthetic construct
  misc_feature 1..22: note = Synthetic Construct
  source 1..22: mol_type = other DNA
tgtgacagagaggacagacact

SEQ ID NO: 4254 - DNA, 25 bp, synthetic construct
  misc_feature 1..25: note = Synthetic Construct
  source 1..25: mol_type = other DNA
ctctttttgggtgcacatactcttg

SEQ ID NO: 4255 - DNA, 26 bp, synthetic construct
  misc_feature 1..26: note = Synthetic Construct
  source 1..26: mol_type = other DNA
tgtcttagcatgtctttgttcctaca

SEQ ID NO: 4256 - DNA, 22 bp, synthetic construct
  misc_feature 1..22: note = Synthetic Construct
  source 1..22: mol_type = other DNA
tgtcaggagggcactttcctat

SEQ ID NO: 4257 - DNA, 24 bp, synthetic construct
  misc_feature 1..24: note = Synthetic Construct
  source 1..24: mol_type = other DNA
gcaaatgtgaccctaggcagaaac

SEQ ID NO: 4258 - DNA, 22 bp, synthetic construct
  misc_feature 1..22: note = Synthetic Construct
  source 1..22: mol_type = other DNA
ttgactaacacgtcacgacact

SEQ ID NO: 4259 - DNA, 24 bp, synthetic construct
  misc_feature 1..24: note = Synthetic Construct
  source 1..24: mol_type = other DNA
ccagagtcattacttctgcatgca

SEQ ID NO: 4260 - DNA, 28 bp, synthetic construct
  misc_feature 1..28: note = Synthetic Construct
  source 1..28: mol_type = other DNA
gcagtctaggttttgttggttattcagt

SEQ ID NO: 4261 - DNA, 20 bp, synthetic construct
  misc_feature 1..20: note = Synthetic Construct
  source 1..20: mol_type = other DNA
gccagtgtttgcaccttgga

SEQ ID NO: 4262 - DNA, 24 bp, synthetic construct
  misc_feature 1..24: note = Synthetic Construct
  source 1..24: mol_type = other DNA
gagagccatattccacaagcaaca

SEQ ID NO: 4263 - DNA, 27 bp, synthetic construct
  misc_feature 1..27: note = Synthetic Construct
  source 1..27: mol_type = other DNA
ggaactatttcctggagcctactgttt

SEQ ID NO: 4264 - DNA, 23 bp, synthetic construct
  misc_feature 1..23: note = Synthetic Construct
  source 1..23: mol_type = other DNA
agacgtgttgtgttcaatgcatt

SEQ ID NO: 4265 - DNA, 20 bp, synthetic construct
  misc_feature 1..20: note = Synthetic Construct
  source 1..20: mol_type = other DNA
atggggcagagggagaagca

SEQ ID NO: 4266 - DNA, 21 bp, synthetic construct
  misc_feature 1..21: note = Synthetic Construct
  source 1..21: mol_type = other DNA
tggcctgaaaggatggttctg

SEQ ID NO: 4267 - DNA, 20 bp, synthetic construct
  misc_feature 1..20: note = Synthetic Construct
  source 1..20: mol_type = other DNA
ctgccacatccttgctagct

SEQ ID NO: 4268 - DNA, 20 bp, synthetic construct
  misc_feature 1..20: note = Synthetic Construct
  source 1..20: mol_type = other DNA
tctcccacccactgtaacca

SEQ ID NO: 4269 - DNA, 23 bp, synthetic construct
  misc_feature 1..23: note = Synthetic Construct
  source 1..23: mol_type = other DNA
gcaaatcagtggaacatgttggt

SEQ ID NO: 4270 - DNA, 22 bp, synthetic construct
  misc_feature 1..22: note = Synthetic Construct
  source 1..22: mol_type = other DNA
tgatagctgaggccaggtcata

SEQ ID NO: 4271 - DNA, 20 bp, synthetic construct
  misc_feature 1..20: note = Synthetic Construct
  source 1..20: mol_type = other DNA
tcaatggcttggccctctga

SEQ ID NO: 4272 - DNA, 24 bp, synthetic construct
  misc_feature 1..24: note = Synthetic Construct
  source 1..24: mol_type = other DNA
gcaaatggaccagaggaacagatg

SEQ ID NO: 4273 - DNA, 23 bp, synthetic construct
  misc_feature 1..23: note = Synthetic Construct
  source 1..23: mol_type = other DNA
ggccctttcgcaacctttttttg

SEQ ID NO: 4274 - DNA, 21 bp, synthetic construct
  misc_feature 1..21: note = Synthetic Construct
  source 1..21: mol_type = other DNA
cttcctccagcctctctgtga

SEQ ID NO: 4275 - DNA, 22 bp, synthetic construct
  misc_feature 1..22: note = Synthetic Construct
  source 1..22: mol_type = other DNA
gtacccctgtgctaatgtggtt

SEQ ID NO: 4276 - DNA, 24 bp, synthetic construct
  misc_feature 1..24: note = Synthetic Construct
  source 1..24: mol_type = other DNA
cagccttgcgaatagacaagacta

SEQ ID NO: 4277 - DNA, 25 bp, synthetic construct
  misc_feature 1..25: note = Synthetic Construct
  source 1..25: mol_type = other DNA
gtctggtttcagtgtgactttagct

SEQ ID NO: 4278 - DNA, 23 bp, synthetic construct
  misc_feature 1..23: note = Synthetic Construct
  source 1..23: mol_type = other DNA
tctcctgtccatttgtggaatgc

SEQ ID NO: 4279 - DNA, 18 bp, synthetic construct
  misc_feature 1..18: note = Synthetic Construct
  source 1..18: mol_type = other DNA
gagcgcggcaatgtcgtt

SEQ ID NO: 4280 - DNA, 22 bp, synthetic construct
  misc_feature 1..22: note = Synthetic Construct
  source 1..22: mol_type = other DNA
cgaaggttcaaagcccaaacac

SEQ ID NO: 4281 - DNA, 24 bp, synthetic construct
  misc_feature 1..24: note = Synthetic Construct
  source 1..24: mol_type = other DNA
tggagtttgttccctgaattagca

SEQ ID NO: 4282 - DNA, 27 bp, synthetic construct
  misc_feature 1..27: note = Synthetic Construct
  source 1..27: mol_type = other DNA
ccctctctctagattcaacccagaact

SEQ ID NO: 4283 - DNA, 21 bp, synthetic construct
  misc_feature 1..21: note = Synthetic Construct
  source 1..21: mol_type = other DNA
tggctgcatggcaacttctca

SEQ ID NO: 4284 - DNA, 24 bp, synthetic construct
  misc_feature 1..24: note = Synthetic Construct
  source 1..24: mol_type = other DNA
tgttcaatcagttggcagactttc

SEQ ID NO: 4285 - DNA, 21 bp, synthetic construct
  misc_feature 1..21: note = Synthetic Construct
  source 1..21: mol_type = other DNA
aaagctgtggaggggtccttt

SEQ ID NO: 4286 - DNA, 23 bp, synthetic construct
  misc_feature 1..23: note = Synthetic Construct
  source 1..23: mol_type = other DNA
ccttggcccagttatgttcttga

SEQ ID NO: 4287 - DNA, 28 bp, synthetic construct
  misc_feature 1..28: note = Synthetic Construct
  source 1..28: mol_type = other DNA
ggaaattaggcccttcatgcatttctaa

SEQ ID NO: 4288 - DNA, 26 bp, synthetic construct
  misc_feature 1..26: note = Synthetic Construct
  source 1..26: mol_type = other DNA
ggcagattttcaatctttggcttgca

SEQ ID NO: 4289 - DNA, 24 bp, synthetic construct
  misc_feature 1..24: note = Synthetic Construct
  source 1..24: mol_type = other DNA
ggctcacccttaggctgatgataa

SEQ ID NO: 4290 - DNA, 24 bp, synthetic construct
  misc_feature 1..24: note = Synthetic Construct
  source 1..24: mol_type = other DNA
ggcctatccttcctggtgattgta

SEQ ID NO: 4291 - DNA, 25 bp, synthetic construct
  misc_feature 1..25: note = Synthetic Construct
  source 1..25: mol_type = other DNA
cacaacctagcaacctcttttacag

SEQ ID NO: 4292 - DNA, 26 bp, synthetic construct
  misc_feature 1..26: note = Synthetic Construct
  source 1..26: mol_type = other DNA
ccaactagtctgtcctgcactttaga

SEQ ID NO: 4293 - DNA, 23 bp, synthetic construct
  misc_feature 1..23: note = Synthetic Construct
  source 1..23: mol_type = other DNA
tgggttttaaagaccgtcgtcaa

SEQ ID NO: 4294 - DNA, 18 bp, synthetic construct
  misc_feature 1..18: note = Synthetic Construct
  source 1..18: mol_type = other DNA
gccccagctgctgtgtgt

SEQ ID NO: 4295 - DNA, 22 bp, synthetic construct
  misc_feature 1..22: note = Synthetic Construct
  source 1..22: mol_type = other DNA
ttgatgcctgctcgagacattg

SEQ ID NO: 4296 - DNA, 23 bp, synthetic construct
  misc_feature 1..23: note = Synthetic Construct
  source 1..23: mol_type = other DNA
tgtggctacaattggctcttgag

SEQ ID NO: 4297 - DNA, 20 bp, synthetic construct
  misc_feature 1..20: note = Synthetic Construct
  source 1..20: mol_type = other DNA
agttccgctcaccagtgcta

SEQ ID NO: 4298 - DNA, 23 bp, synthetic construct
  misc_feature 1..23: note = Synthetic Construct
  source 1..23: mol_type = other DNA
gaagagtgaagagtgaccagcat

SEQ ID NO: 4299 - DNA, 21 bp, synthetic construct
  misc_feature 1..21: note = Synthetic Construct
  source 1..21: mol_type = other DNA
agggcaggtgtttcaggaagt

SEQ ID NO: 4300 - DNA, 24 bp, synthetic construct
  misc_feature 1..24: note = Synthetic Construct
  source 1..24: mol_type = other DNA
ccacagttcagtgaatgggagcat

SEQ ID NO: 4301 - DNA, 26 bp, synthetic construct
  misc_feature 1..26: note = Synthetic Construct
  source 1..26: mol_type = other DNA
ctaatacccctgcaatttctcttcct

SEQ ID NO: 4302 - DNA, 20 bp, synthetic construct
  misc_feature 1..20: note = Synthetic Construct
  source 1..20: mol_type = other DNA
agcaatctgccgccaggatt

SEQ ID NO: 4303 - DNA, 25 bp, synthetic construct
  misc_feature 1..25: note = Synthetic Construct
  source 1..25: mol_type = other DNA
caggtcttggcttaaatgtcaacac

SEQ ID NO: 4304 - DNA, 23 bp, synthetic construct
  misc_feature 1..23: note = Synthetic Construct
  source 1..23: mol_type = other DNA
tgcagtgggatcagctaccagta

SEQ ID NO: 4305 - DNA, 23 bp, synthetic construct
  misc_feature 1..23: note = Synthetic Construct
  source 1..23: mol_type = other DNA
gccactgagaagactctgtcctt

SEQ ID NO: 4306 - DNA, 25 bp, synthetic construct
  misc_feature 1..25: note = Synthetic Construct
  source 1..25: mol_type = other DNA
ggccaagactcctaaatctgaagct

SEQ ID NO: 4307 - DNA, 24 bp, synthetic construct
  misc_feature 1..24: note = Synthetic Construct
  source 1..24: mol_type = other DNA
ggtgtgcctcaggtgtaagatgat

SEQ ID NO: 4308 - DNA, 25 bp, synthetic construct
  misc_feature 1..25: note = Synthetic Construct
  source 1..25: mol_type = other DNA
tgacaatctcatcacgtctgacaag

SEQ ID NO: 4309 - DNA, 25 bp, synthetic construct
  misc_feature 1..25: note = Synthetic Construct
  source 1..25: mol_type = other DNA
tcacacacatcagtctaaacctgaa

SEQ ID NO: 4310 - DNA, 24 bp, synthetic construct
  misc_feature 1..24: note = Synthetic Construct
  source 1..24: mol_type = other DNA
cccaactgtctcactgttcatgga

SEQ ID NO: 4311 - DNA, 25 bp, synthetic construct
  misc_feature 1..25: note = Synthetic Construct
  source 1..25: mol_type = other DNA
aagtgtagccacataaactggtgat

SEQ ID NO: 4312 - DNA, 22 bp, synthetic construct
  misc_feature 1..22: note = Synthetic Construct
  source 1..22: mol_type = other DNA
tgccctaacctccgtttacaac

SEQ ID NO: 4313 - DNA, 25 bp, synthetic construct
  misc_feature 1..25: note = Synthetic Construct
  source 1..25: mol_type = other DNA
cctatgtaatggccaaagacacttg

SEQ ID NO: 4314 - DNA, 20 bp, synthetic construct
  misc_feature 1..20: note = Synthetic Construct
  source 1..20: mol_type = other DNA
tgggcatgttgtgtgatgct

SEQ ID NO: 4315 - DNA, 26 bp, synthetic construct
  misc_feature 1..26: note = Synthetic Construct
  source 1..26: mol_type = other DNA
attttggttgccttttcccactatag

SEQ ID NO: 4316 - DNA, 22 bp, synthetic construct
  misc_feature 1..22: note = Synthetic Construct
  source 1..22: mol_type = other DNA
tgctgaagaggctctgagtcat

SEQ ID NO: 4317 - DNA, 27 bp, synthetic construct
  misc_feature 1..27: note = Synthetic Construct
  source 1..27: mol_type = other DNA
agtggtattcatgtcagcaagaaattg

SEQ ID NO: 4318 - DNA, 23 bp, synthetic construct
  misc_feature 1..23: note = Synthetic Construct
  source 1..23: mol_type = other DNA
ggatcctgcactagtacaaagca

SEQ ID NO: 4319 - DNA, 20 bp, synthetic construct
  misc_feature 1..20: note = Synthetic Construct
  source 1..20: mol_type = other DNA
catctggccacctgaacaca

SEQ ID NO: 4320 - DNA, 24 bp, synthetic construct
  misc_feature 1..24: note = Synthetic Construct
  source 1..24: mol_type = other DNA
gaaagccagaagacatgtcatgag

SEQ ID NO: 4321 - DNA, 22 bp, synthetic construct
  misc_feature 1..22: note = Synthetic Construct
  source 1..22: mol_type = other DNA
acctgagagccattgcctccta

SEQ ID NO: 4322 - DNA, 30 bp, synthetic construct
  misc_feature 1..30: note = Synthetic Construct
  source 1..30: mol_type = other DNA
gcctaaggactgtgtaagaaggaaatacag

SEQ ID NO: 4323 - DNA, 26 bp, synthetic construct
  misc_feature 1..26: note = Synthetic Construct
  source 1..26: mol_type = other DNA
gtgtcctctgaccactaaactatacc

SEQ ID NO: 4324 - DNA, 21 bp, synthetic construct
  misc_feature 1..21: note = Synthetic Construct
  source 1..21: mol_type = other DNA
tctgtctcctgcatgcaactc

SEQ ID NO: 4325 - DNA, 26 bp, synthetic construct
  misc_feature 1..26: note = Synthetic Construct
  source 1..26: mol_type = other DNA
ccacctatactgaacttaggggaaga

SEQ ID NO: 4326 - DNA, 26 bp, synthetic construct
  misc_feature 1..26: note = Synthetic Construct
  source 1..26: mol_type = other DNA
agctggaaaggagtttattgaaagga

SEQ ID NO: 4327 - DNA, 20 bp, synthetic construct
  misc_feature 1..20: note = Synthetic Construct
  source 1..20: mol_type = other DNA
tcaaggcaccctttccgttt

SEQ ID NO: 4328 - DNA, 23 bp, synthetic construct
  misc_feature 1..23: note = Synthetic Construct
  source 1..23: mol_type = other DNA
gtgaggtaccagtggaggatctt

SEQ ID NO: 4329 - DNA, 21 bp, synthetic construct
  misc_feature 1..21: note = Synthetic Construct
  source 1..21: mol_type = other DNA
acagtactgggccagatggaa

SEQ ID NO: 4330 - DNA, 24 bp, synthetic construct
  misc_feature 1..24: note = Synthetic Construct
  source 1..24: mol_type = other DNA
aggatagcatacaccctacacagt

SEQ ID NO: 4331 - DNA, 22 bp, synthetic construct
  misc_feature 1..22: note = Synthetic Construct
  source 1..22: mol_type = other DNA
ctcagcccctccacgtgggaat

SEQ ID NO: 4332 - DNA, 21 bp, synthetic construct
  misc_feature 1..21: note = Synthetic Construct
  source 1..21: mol_type = other DNA
atggctgaagaggaccatgtg

SEQ ID NO: 4333 - DNA, 22 bp, synthetic construct
  misc_feature 1..22: note = Synthetic Construct
  source 1..22: mol_type = other DNA
ccatgcctaccaagagctagtg

SEQ ID NO: 4334 - DNA, 20 bp, synthetic construct
  misc_feature 1..20: note = Synthetic Construct
  source 1..20: mol_type = other DNA
ggggtacaggctggggattt

SEQ ID NO: 4335 - DNA, 24 bp, synthetic construct
  misc_feature 1..24: note = Synthetic Construct
  source 1..24: mol_type = other DNA
gcactaggattgccttctgttctg

SEQ ID NO: 4336 - DNA, 27 bp, synthetic construct
  misc_feature 1..27: note = Synthetic Construct
  source 1..27: mol_type = other DNA
ccacaatttaagactaaccaccatgct

SEQ ID NO: 4337 - DNA, 26 bp, synthetic construct
  misc_feature 1..26: note = Synthetic Construct
  source 1..26: mol_type = other DNA
ttcagaaggtgtgaaagtgtatggta

SEQ ID NO: 4338 - DNA, 25 bp, synthetic construct
  misc_feature 1..25: note = Synthetic Construct
  source 1..25: mol_type = other DNA
gtctcaagtagggttacgctgtatt

SEQ ID NO: 4339 - DNA, 25 bp, synthetic construct
  misc_feature 1..25: note = Synthetic Construct
  source 1..25: mol_type = other DNA
tgatcaccatgcaggggtttattac

SEQ ID NO: 4340 - DNA, 30 bp, synthetic construct
  misc_feature 1..30: note = Synthetic Construct
  source 1..30: mol_type = other DNA
catcaactatgactggtatttcagagttct

SEQ ID NO: 4341 - DNA, 21 bp, synthetic construct
  misc_feature 1..21: note = Synthetic Construct
  source 1..21: mol_type = other DNA
ccttggcactgtggagcaaga

SEQ ID NO: 4342 - DNA, 27 bp, synthetic construct
  misc_feature 1..27: note = Synthetic Construct
  source 1..27: mol_type = other DNA
ggtcatggtttcaaggaaatggattgg

SEQ ID NO: 4343 - DNA, 22 bp, synthetic construct
  misc_feature 1..22: note = Synthetic Construct
  source 1..22: mol_type = other DNA
gggcagctgatgtaacaattcc

SEQ ID NO: 4344 - DNA, 22 bp, synthetic construct
  misc_feature 1..22: note = Synthetic Construct
  source 1..22: mol_type = other DNA
tctggcagcttgttggagaaag

SEQ ID NO: 4345 - DNA, 22 bp, synthetic construct
  misc_feature 1..22: note = Synthetic Construct
  source 1..22: mol_type = other DNA
aggacatctgggagcagaaaga

SEQ ID NO: 4346 - DNA, 23 bp, synthetic construct
  misc_feature 1..23: note = Synthetic Construct
  source 1..23: mol_type = other DNA
gggaaagtacaccccatttctga

SEQ ID NO: 4347 - DNA, 27 bp, synthetic construct
  misc_feature 1..27: note = Synthetic Construct
  source 1..27: mol_type = other DNA
gggacagttttcctgaaagtagagcta

SEQ ID NO: 4348 - DNA, 27 bp, synthetic construct
  misc_feature 1..27: note = Synthetic Construct
  source 1..27: mol_type = other DNA
gtctgatttgaactgttatctgctgtt

SEQ ID NO: 4349 - DNA, 22 bp, synthetic construct
  misc_feature 1..22: note = Synthetic Construct
  source 1..22: mol_type = other DNA
ggactaccagcctatgccatct

SEQ ID NO: 4350 - DNA, 19 bp, synthetic construct
  misc_feature 1..19: note = Synthetic Construct
  source 1..19: mol_type = other DNA
agggctcgtcctcctgctt

SEQ ID NO: 4351 - DNA, 22 bp, synthetic construct
  misc_feature 1..22: note = Synthetic Construct
  source 1..22: mol_type = other DNA
gctccttacagctccagcaaga

SEQ ID NO: 4352 - DNA, 22 bp, synthetic construct
  misc_feature 1..22: note = Synthetic Construct
  source 1..22: mol_type = other DNA
tgtggggaactagagacccaaa

SEQ ID NO: 4353 - DNA, 25 bp, synthetic construct
  misc_feature 1..25: note = Synthetic Construct
  source 1..25: mol_type = other DNA
tgagaactgtcctctcttcattctg

SEQ ID NO: 4354 - DNA, 25 bp, synthetic construct
  misc_feature 1..25: note = Synthetic Construct
  source 1..25: mol_type = other DNA
agtagctggtgtattcaaggaacag

SEQ ID NO: 4355 - DNA, 22 bp, synthetic construct
  misc_feature 1..22: note = Synthetic Construct
  source 1..22: mol_type = other DNA
aacacgcccttgatggatgaga

SEQ ID NO: 4356 - DNA, 24 bp, synthetic construct
  misc_feature 1..24: note = Synthetic Construct
  source 1..24: mol_type = other DNA
gcatagctgtggtcaccaaacaac

SEQ ID NO: 4357 - DNA, 22 bp, synthetic construct
  misc_feature 1..22: note = Synthetic Construct
  source 1..22: mol_type = other DNA
tcaaagccttgcctcagcttct

SEQ ID NO: 4358 - DNA, 24 bp, synthetic construct
  misc_feature 1..24: note = Synthetic Construct
  source 1..24: mol_type = other DNA
tgctctgtttgtgggttagtttca

SEQ ID NO: 4359 - DNA, 26 bp, synthetic construct
  misc_feature 1..26: note = Synthetic Construct
  source 1..26: mol_type = other DNA
caagaaggctttcccagtatcaactg

SEQ ID NO: 4360 - DNA, 23 bp, synthetic construct
  misc_feature 1..23: note = Synthetic Construct
  source 1..23: mol_type = other DNA
cactgtctccagccatccctata

SEQ ID NO: 4361 - DNA, 21 bp, synthetic construct
  misc_feature 1..21: note = Synthetic Construct
  source 1..21: mol_type = other DNA
ctccttacccatgggtttgct

SEQ ID NO: 4362 - DNA, 22 bp, synthetic construct
  misc_feature 1..22: note = Synthetic Construct
  source 1..22: mol_type = other DNA
acggggtaggaaatgtcacctt

SEQ ID NO: 4363 - DNA, 25 bp, synthetic construct
  misc_feature 1..25: note = Synthetic Construct
  source 1..25: mol_type = other DNA
ggagtgttaacagcttctgccattc

SEQ ID NO: 4364 - DNA, 27 bp, synthetic construct
  misc_feature 1..27: note = Synthetic Construct
  source 1..27: mol_type = other DNA
gtggataaggtatagggagtacaggat

SEQ ID NO: 4365 - DNA, 24 bp, synthetic construct
  misc_feature 1..24: note = Synthetic Construct
  source 1..24: mol_type = other DNA
ggctacaacaatgagggggaaatg

SEQ ID NO: 4366 - DNA, 22 bp, synthetic construct
  misc_feature 1..22: note = Synthetic Construct
  source 1..22: mol_type = other DNA
ggtggtgcagtgtgccaaataa

SEQ ID NO: 4367 - DNA, 20 bp, synthetic construct
  misc_feature 1..20: note = Synthetic Construct
  source 1..20: mol_type = other DNA
ccaggtaccctcaccactct

SEQ ID NO: 4368 - DNA, 24 bp, synthetic construct
  misc_feature 1..24: note = Synthetic Construct
  source 1..24: mol_type = other DNA
gggaagcgaccattggaattagga

SEQ ID NO: 4369 - DNA, 23 bp, synthetic construct
  misc_feature 1..23: note = Synthetic Construct
  source 1..23: mol_type = other DNA
tgttagcaaaagaccagggtgtt

SEQ ID NO: 4370 - DNA, 25 bp, synthetic construct
  misc_feature 1..25: note = Synthetic Construct
  source 1..25: mol_type = other DNA
tcatatgtggagaacttggcatcaa

SEQ ID NO: 4371 - DNA, 20 bp, synthetic construct
  misc_feature 1..20: note = Synthetic Construct
  source 1..20: mol_type = other DNA
ccttgcaatggtccccagat

SEQ ID NO: 4372 - DNA, 28 bp, synthetic construct
  misc_feature 1..28: note = Synthetic Construct
  source 1..28: mol_type = other DNA
ggatcaggatcctacctttagactcctt

SEQ ID NO: 4373 - DNA, 27 bp, synthetic construct
  misc_feature 1..27: note = Synthetic Construct
  source 1..27: mol_type = other DNA
tttgcatctgtgttcacattacactag

SEQ ID NO: 4374 - DNA, 24 bp, synthetic construct
  misc_feature 1..24: note = Synthetic Construct
  source 1..24: mol_type = other DNA
ttgggtaataccaggactcccata

SEQ ID NO: 4375 - DNA, 22 bp, synthetic construct
  misc_feature 1..22: note = Synthetic Construct
  source 1..22: mol_type = other DNA
tggtgggttgatgaggacaaga

SEQ ID NO: 4376 - DNA, 22 bp, synthetic construct
  misc_feature 1..22: note = Synthetic Construct
  source 1..22: mol_type = other DNA
agctgctgcccatctttttcct

SEQ ID NO: 4377 - DNA, 21 bp, synthetic construct
  misc_feature 1..21: note = Synthetic Construct
  source 1..21: mol_type = other DNA
tgtgaagcaaagccaccacaa

SEQ ID NO: 4378 - DNA, 24 bp, synthetic construct
  misc_feature 1..24: note = Synthetic Construct
  source 1..24: mol_type = other DNA
gtgtcctcatagtctcaccttgca

SEQ ID NO: 4379 - DNA, 21 bp, synthetic construct
  misc_feature 1..21: note = Synthetic Construct
  source 1..21: mol_type = other DNA
gcgtacctccgagaacacact

SEQ ID NO: 4380 - DNA, 26 bp, synthetic construct
  misc_feature 1..26: note = Synthetic Construct
  source 1..26: mol_type = other DNA
actggtggttctttggtatttttcac

SEQ ID NO: 4381 - DNA, 24 bp, synthetic construct
  misc_feature 1..24: note = Synthetic Construct
  source 1..24: mol_type = other DNA
cctggataaggcaagagacttgtc

SEQ ID NO: 4382 - DNA, 21 bp, synthetic construct
  misc_feature 1..21: note = Synthetic Construct
  source 1..21: mol_type = other DNA
acaaacccaagggcacgtagt

SEQ ID NO: 4383 - DNA, 20 bp, synthetic construct
  misc_feature 1..20: note = Synthetic Construct
  source 1..20: mol_type = other DNA
ccccatggcctggattaagc

SEQ ID NO: 4384 - DNA, 25 bp, synthetic construct
  misc_feature 1..25: note = Synthetic Construct
  source 1..25: mol_type = other DNA
gcgctgatgatatttctggtgtgtt

SEQ ID NO: 4385 - DNA, 26 bp, synthetic construct
  misc_feature 1..26: note = Synthetic Construct
  source 1..26: mol_type = other DNA
ggacctgttgactgaagaaatgatga

SEQ ID NO: 4386 - DNA, 24 bp, synthetic construct
  misc_feature 1..24: note = Synthetic Construct
  source 1..24: mol_type = other DNA
ctttgaagtctctgcacctcagtt

SEQ ID NO: 4387 - DNA, 18 bp, synthetic construct
  misc_feature 1..18: note = Synthetic Construct
  source 1..18: mol_type = other DNA
tcctgctggctgcacaca

SEQ ID NO: 4388 - DNA, 23 bp, synthetic construct
  misc_feature 1..23: note = Synthetic Construct
  source 1..23: mol_type = other DNA
gaggaaacccagagtcaggaact

SEQ ID NO: 4389 - DNA, 25 bp, synthetic construct
  misc_feature 1..25: note = Synthetic Construct
  source 1..25: mol_type = other DNA
catgcatcaggtgtacattaagctt

SEQ ID NO: 4390 - DNA, 26 bp, synthetic construct
  misc_feature 1..26: note = Synthetic Construct
  source 1..26: mol_type = other DNA
gggtctcagtatcaagctgactgttg

SEQ ID NO: 4391 - DNA, 24 bp, synthetic construct
  misc_feature 1..24: note = Synthetic Construct
  source 1..24: mol_type = other DNA
cctgaacctactccatctgttcct

SEQ ID NO: 4392 - DNA, 24 bp, synthetic construct
  misc_feature 1..24: note = Synthetic Construct
  source 1..24: mol_type = other DNA
ctgagctgaggtcatgttcttcct

SEQ ID NO: 4393 - DNA, 27 bp, synthetic construct
  misc_feature 1..27: note = Synthetic Construct
  source 1..27: mol_type = other DNA
aggaggtttatattgtgctcagacatt

SEQ ID NO: 4394 - DNA, 20 bp, synthetic construct
  misc_feature 1..20: note = Synthetic Construct
  source 1..20: mol_type = other DNA
tggatccccccaccactctt

SEQ ID NO: 4395 - DNA, 18 bp, synthetic construct
  misc_feature 1..18: note = Synthetic Construct
  source 1..18: mol_type = other DNA
tggccgtgctcctcagta

SEQ ID NO: 4396 - DNA, 22 bp, synthetic construct
  misc_feature 1..22: note = Synthetic Construct
  source 1..22: mol_type = other DNA
ggtttggggttgctcctttagt

SEQ ID NO: 4397 - DNA, 23 bp, synthetic construct
  misc_feature 1..23: note = Synthetic Construct
  source 1..23: mol_type = other DNA
ctctgtggggcatgtttagaact

SEQ ID NO: 4398 - DNA, 20 bp, synthetic construct
  misc_feature 1..20: note = Synthetic Construct
  source 1..20: mol_type = other DNA
gaggtggtgagcacaaagga

SEQ ID NO: 4399 - DNA, 25 bp, synthetic construct
  misc_feature 1..25: note = Synthetic Construct
  source 1..25: mol_type = other DNA
ctgctaaaaccctccaatggcttac

SEQ ID NO: 4400 - DNA, 21 bp, synthetic construct
  misc_feature 1..21: note = Synthetic Construct
  source 1..21: mol_type = other DNA
gctgggacatggtgttagtgt

SEQ ID NO: 4401 - DNA, 22 bp, synthetic construct
  misc_feature 1..22: note = Synthetic Construct
  source 1..22: mol_type = other DNA
actgaggctgactccattgaga

SEQ ID NO: 4402 - DNA, 20 bp, synthetic construct
  misc_feature 1..20: note = Synthetic Construct
  source 1..20: mol_type = other DNA
gctggcgggaagtcacacaa

SEQ ID NO: 4403 - DNA, 26 bp, synthetic construct
  misc_feature 1..26: note = Synthetic Construct
  source 1..26: mol_type = other DNA
gtgttatcactgccataatggtcaag

SEQ ID NO: 4404 - DNA, 22 bp, synthetic construct
  misc_feature 1..22: note = Synthetic Construct
  source 1..22: mol_type = other DNA
tgtttctggcgtgtgaaagtga

SEQ ID NO: 4405 - DNA, 25 bp, synthetic construct
  misc_feature 1..25: note = Synthetic Construct
  source 1..25: mol_type = other DNA
cagaactcagaggctagtctaggta

SEQ ID NO: 4406 - DNA, 19 bp, synthetic construct
  misc_feature 1..19: note = Synthetic Construct
  source 1..19: mol_type = other DNA
cctcaggcagctggtgtct

SEQ ID NO: 4407 - DNA, 26 bp, synthetic construct
  misc_feature 1..26: note = Synthetic Construct
  source 1..26: mol_type = other DNA
gatctcaaggtaggaatgtgtctcaa

SEQ ID NO: 4408 - DNA, 25 bp, synthetic construct
  misc_feature 1..25: note = Synthetic Construct
  source 1..25: mol_type = other DNA
gtttccccaagtctgcctcatattt

SEQ ID NO: 4409 - DNA, 26 bp, synthetic construct
  misc_feature 1..26: note = Synthetic Construct
  source 1..26: mol_type = other DNA
cactttgatctccttatgctgctagt

SEQ ID NO: 4410 - DNA, 28 bp, synthetic construct
  misc_feature 1..28: note = Synthetic Construct
  source 1..28: mol_type = other DNA
catcttttaccacaagctaacagtacag

SEQ ID NO: 4411 - DNA, 24 bp, synthetic construct
  misc_feature 1..24: note = Synthetic Construct
  source 1..24: mol_type = other DNA
ggtgatttgccaaccattcttgac

SEQ ID NO: 4412 - DNA, 23 bp, synthetic construct
  misc_feature 1..23: note = Synthetic Construct
  source 1..23: mol_type = other DNA
agcaccccagaaaacttcttgag

SEQ ID NO: 4413 - DNA, 23 bp, synthetic construct
  misc_feature 1..23: note = Synthetic Construct
  source 1..23: mol_type = other DNA
tctctctagagcaagcagacaca

SEQ ID NO: 4414 - DNA, 23 bp, synthetic construct
  misc_feature 1..23: note = Synthetic Construct
  source 1..23: mol_type = other DNA
tggctcatgcttctgggaatgtg

SEQ ID NO: 4415 - DNA, 25 bp, synthetic construct
  misc_feature 1..25: note = Synthetic Construct
  source 1..25: mol_type = other DNA
cagattcctaactcaccttcagcaa

SEQ ID NO: 4416 - DNA, 21 bp, synthetic construct
  misc_feature 1..21: note = Synthetic Construct
  source 1..21: mol_type = other DNA
ggactgctgcagagactcttc

SEQ ID NO: 4417 - DNA, 19 bp, synthetic construct
  misc_feature 1..19: note = Synthetic Construct
  source 1..19: mol_type = other DNA
tgccgtgagcgtgtgttca

SEQ ID NO: 4418 - DNA, 26 bp, synthetic construct
  misc_feature 1..26: note = Synthetic Construct
  source 1..26: mol_type = other DNA
gagaagaaaaacgccatgaagaaacc

SEQ ID NO: 4419 - DNA, 26 bp, synthetic construct
  misc_feature 1..26: note = Synthetic Construct
  source 1..26: mol_type = other DNA
gctgagagggcctcggaattatattg

SEQ ID NO: 4420 - DNA, 22 bp, synthetic construct
  misc_feature 1..22: note = Synthetic Construct
  source 1..22: mol_type = other DNA
gaccactgtagctgcttttgtc

SEQ ID NO: 4421 - DNA, 22 bp, synthetic construct
  misc_feature 1..22: note = Synthetic Construct
  source 1..22: mol_type = other DNA
gggtgaagtgggtgcatctaat

SEQ ID NO: 4422 - DNA, 24 bp, synthetic construct
  misc_feature 1..24: note = Synthetic Construct
  source 1..24: mol_type = other DNA
tttgaagggtgcatttgtgatgtt

SEQ ID NO: 4423 - DNA, 28 bp, synthetic construct
  misc_feature 1..28: note = Synthetic Construct
  source 1..28: mol_type = other DNA
gggattctgtgtcctagcacttttatgg

SEQ ID NO: 4424 - DNA, 22 bp, synthetic construct
  misc_feature 1..22: note = Synthetic Construct
  source 1..22: mol_type = other DNA
cgcgctggaagttaatgcagta

SEQ ID NO: 4425 - DNA, 25 bp, synthetic construct
  misc_feature 1..25: note = Synthetic Construct
  source 1..25: mol_type = other DNA
gcaatgaaaagtcttgcagtttgag

SEQ ID NO: 4426 - DNA, 24 bp, synthetic construct
  misc_feature 1..24: note = Synthetic Construct
  source 1..24: mol_type = other DNA
agcagtctgagtcaccctatcctt

SEQ ID NO: 4427 - DNA, 25 bp, synthetic construct
  misc_feature 1..25: note = Synthetic Construct
  source 1..25: mol_type = other DNA
tcctaggtaggcttccattcctatc

SEQ ID NO: 4428 - DNA, 27 bp, synthetic construct
  misc_feature 1..27: note = Synthetic Construct
  source 1..27: mol_type = other DNA
aaggaaatgcaattgtatgtacagcat

SEQ ID NO: 4429 - DNA, 22 bp, synthetic construct
  misc_feature 1..22: note = Synthetic Construct
  source 1..22: mol_type = other DNA
gggagccaaaggttttcaggaa

SEQ ID NO: 4430 - DNA, 28 bp, synthetic construct
  misc_feature 1..28: note = Synthetic Construct
  source 1..28: mol_type = other DNA
gcttgtgtttgtccagggattttagttg

SEQ ID NO: 4431 - DNA, 25 bp, synthetic construct
  misc_feature 1..25: note = Synthetic Construct
  source 1..25: mol_type = other DNA
agaacgcgattgacccattttaaac

SEQ ID NO: 4432 - DNA, 24 bp, synthetic construct
  misc_feature 1..24: note = Synthetic Construct
  source 1..24: mol_type = other DNA
catcagaatttgctgcagcttaga

SEQ ID NO: 4433 - DNA, 22 bp, synthetic construct
  misc_feature 1..22: note = Synthetic Construct
  source 1..22: mol_type = other DNA
cgcagcaagtcaagcaatggaa

SEQ ID NO: 4434 - DNA, 22 bp, synthetic construct
  misc_feature 1..22: note = Synthetic Construct
  source 1..22: mol_type = other DNA
aggtaaggtgtctgccttcaca

SEQ ID NO: 4435 - DNA, 21 bp, synthetic construct
  misc_feature 1..21: note = Synthetic Construct
  source 1..21: mol_type = other DNA
agggcagcaccagaagctaga

SEQ ID NO: 4436 - DNA, 22 bp, synthetic construct
  misc_feature 1..22: note = Synthetic Construct
  source 1..22: mol_type = other DNA
ggagagtggttgattgggctaa

SEQ ID NO: 4437 - DNA, 22 bp, synthetic construct
  misc_feature 1..22: note = Synthetic Construct
  source 1..22: mol_type = other DNA
ctctgcccacattctggttcaa

SEQ ID NO: 4438 - DNA, 21 bp, synthetic construct
  misc_feature 1..21: note = Synthetic Construct
  source 1..21: mol_type = other DNA
cgatcttcctgtcgcctttcc

SEQ ID NO: 4439 - DNA, 23 bp, synthetic construct
  misc_feature 1..23: note = Synthetic Construct
  source 1..23: mol_type = other DNA
ggccaccatcacttgatacttca

SEQ ID NO: 4440 - DNA, 29 bp, synthetic construct
  misc_feature 1..29: note = Synthetic Construct
  source 1..29: mol_type = other DNA
gagataatgggaatagaagccttcatcag

SEQ ID NO: 4441 - DNA, 24 bp, synthetic construct
  misc_feature 1..24: note = Synthetic Construct
  source 1..24: mol_type = other DNA
gtgtctggaacacctaaggactca

SEQ ID NO: 4442 - DNA, 23 bp, synthetic construct
  misc_feature 1..23: note = Synthetic Construct
  source 1..23: mol_type = other DNA
aggctgccatactccagttagca

SEQ ID NO: 4443 - DNA, 26 bp, synthetic construct
  misc_feature 1..26: note = Synthetic Construct
  source 1..26: mol_type = other DNA
ttaagccttactctgagccactttat

SEQ ID NO: 4444 - DNA, 20 bp, synthetic construct
  misc_feature 1..20: note = Synthetic Construct
  source 1..20: mol_type = other DNA
ttggtgcccctcccctctat

SEQ ID NO: 4445 - DNA, 23 bp, synthetic construct
  misc_feature 1..23: note = Synthetic Construct
  source 1..23: mol_type = other DNA
ctgaataggagggaggactcaca

SEQ ID NO: 4446 - DNA, 21 bp, synthetic construct
  misc_feature 1..21: note = Synthetic Construct
  source 1..21: mol_type = other DNA
tgactcgggccaactgaaatg

SEQ ID NO: 4447 - DNA, 27 bp, synthetic construct
  misc_feature 1..27: note = Synthetic Construct
  source 1..27: mol_type = other DNA
cactgtgggccatattatgagagtata

SEQ ID NO: 4448 - DNA, 24 bp, synthetic construct
  misc_feature 1..24: note = Synthetic Construct
  source 1..24: mol_type = other DNA
ggggattaactcagtcacggcaat

SEQ ID NO: 4449 - DNA, 24 bp, synthetic construct
  misc_feature 1..24: note = Synthetic Construct
  source 1..24: mol_type = other DNA
cggtttgtgacagcactactctca

SEQ ID NO: 4450 - DNA, 21 bp, synthetic construct
  misc_feature 1..21: note = Synthetic Construct
  source 1..21: mol_type = other DNA
aggacttcctgggcagtgaaa

SEQ ID NO: 4451 - DNA, 27 bp, synthetic construct
  misc_feature 1..27: note = Synthetic Construct
  source 1..27: mol_type = other DNA
tccatggatccacatgtctatccttat

SEQ ID NO: 4452 - DNA, 26 bp, synthetic construct
  misc_feature 1..26: note = Synthetic Construct
  source 1..26: mol_type = other DNA
ccctagctaaaaaggtgatgcatcca

SEQ ID NO: 4453 - DNA, 21 bp, synthetic construct
  misc_feature 1..21: note = Synthetic Construct
  source 1..21: mol_type = other DNA
cccagtgcacaatcccaattg

SEQ ID NO: 4454 - DNA, 22 bp, synthetic construct
  misc_feature 1..22: note = Synthetic Construct
  source 1..22: mol_type = other DNA
ccacaaagcaggcgacactaaa

SEQ ID NO: 4455 - DNA, 21 bp, synthetic construct
  misc_feature 1..21: note = Synthetic Construct
  source 1..21: mol_type = other DNA
ggtcccaagatgactgcaaga

SEQ ID NO: 4456 - DNA, 23 bp, synthetic construct
  misc_feature 1..23: note = Synthetic Construct
  source 1..23: mol_type = other DNA
cagtcactgcttgaacaccatgt

SEQ ID NO: 4457 - DNA, 23 bp, synthetic construct
  misc_feature 1..23: note = Synthetic Construct
  source 1..23: mol_type = other DNA
cccaagttctcttgcccatttga

SEQ ID NO: 4458 - DNA, 19 bp, synthetic construct
  misc_feature 1..19: note = Synthetic Construct
  source 1..19: mol_type = other DNA
tgcactgctgagccacaga

SEQ ID NO: 4459 - DNA, 21 bp, synthetic construct
  misc_feature 1..21: note = Synthetic Construct
  source 1..21: mol_type = other DNA
cacacacagctgcacagattg

SEQ ID NO: 4460 - DNA, 23 bp, synthetic construct
  misc_feature 1..23: note = Synthetic Construct
  source 1..23: mol_type = other DNA
cctgcttatcagtgcctggtgat

SEQ ID NO: 4461 - DNA, 25 bp, synthetic construct
  misc_feature 1..25: note = Synthetic Construct
  source 1..25: mol_type = other DNA
gcaaatgcaaaggttctgaggcaaa

SEQ ID NO: 4462 - DNA, 20 bp, synthetic construct
  misc_feature 1..20: note = Synthetic Construct
  source 1..20: mol_type = other DNA
tgagcagtcctggtgctgta

SEQ ID NO: 4463 - DNA, 23 bp, synthetic construct
  misc_feature 1..23: note = Synthetic Construct
  source 1..23: mol_type = other DNA
agaggagcagtgagtcctagttg

SEQ ID NO: 4464 - DNA, 24 bp, synthetic construct
  misc_feature 1..24: note = Synthetic Construct
  source 1..24: mol_type = other DNA
cacgtgaaatgaattgccttctgt

SEQ ID NO: 4465 - DNA, 23 bp, synthetic construct
  misc_feature 1..23: note = Synthetic Construct
  source 1..23: mol_type = other DNA
gcccaggactctctgacttaagc

SEQ ID NO: 4466 - DNA, 22 bp, synthetic construct
  misc_feature 1..22: note = Synthetic Construct
  source 1..22: mol_type = other DNA
ttccacctcacattggcttctg

SEQ ID NO: 4467 - DNA, 22 bp, synthetic construct
  misc_feature 1..22: note = Synthetic Construct
  source 1..22: mol_type = other DNA
gttgaggtctgctgtggtctaa

SEQ ID NO: 4468 - DNA, 29 bp, synthetic construct
  misc_feature 1..29: note = Synthetic Construct
  source 1..29: mol_type = other DNA
cgaaagtgagacattatcagcatatatgg

SEQ ID NO: 4469 - DNA, 21 bp, synthetic construct
  misc_feature 1..21: note = Synthetic Construct
  source 1..21: mol_type = other DNA
gaagaatggggcagacatgga

SEQ ID NO: 4470 - DNA, 21 bp, synthetic construct
  misc_feature 1..21: note = Synthetic Construct
  source 1..21: mol_type = other DNA
actcctgcagctctctagtca

SEQ ID NO: 4471 - DNA, 22 bp, synthetic construct
  misc_feature 1..22: note = Synthetic Construct
  source 1..22: mol_type = other DNA
tggcaatacagcagggcttcaa

SEQ ID NO: 4472 - DNA, 26 bp, synthetic construct
  misc_feature 1..26: note = Synthetic Construct
  source 1..26: mol_type = other DNA
cccgtgaaagtcaagctattgattgc

SEQ ID NO: 4473 - DNA, 21 bp, synthetic construct
  misc_feature 1..21: note = Synthetic Construct
  source 1..21: mol_type = other DNA
tgctgtcctggaggtgttgaa

SEQ ID NO: 4474 - DNA, 22 bp, synthetic construct
  misc_feature 1..22: note = Synthetic Construct
  source 1..22: mol_type = other DNA
tgggcgcctaaacttcatcaca

SEQ ID NO: 4475 - DNA, 23 bp, synthetic construct
  misc_feature 1..23: note = Synthetic Construct
  source 1..23: mol_type = other DNA
gacatgcatcacttctgctcaca

SEQ ID NO: 4476 - DNA, 20 bp, synthetic construct
  misc_feature 1..20: note = Synthetic Construct
  source 1..20: mol_type = other DNA
ctcccccgaaacacctctct

SEQ ID NO: 4477 - DNA, 24 bp, synthetic construct
  misc_feature 1..24: note = Synthetic Construct
  source 1..24: mol_type = other DNA
agataaggactccacagggactct

SEQ ID NO: 4478 - DNA, 22 bp, synthetic construct
  misc_feature 1..22: note = Synthetic Construct
  source 1..22: mol_type = other DNA
ttgcccctgtttcagtgatgct

SEQ ID NO: 4479 - DNA, 21 bp, synthetic construct
  misc_feature 1..21: note = Synthetic Construct
  source 1..21: mol_type = other DNA
cctggcacaagctgacacttt

SEQ ID NO: 4480 - DNA, 22 bp, synthetic construct
  misc_feature 1..22: note = Synthetic Construct
  source 1..22: mol_type = other DNA
gtggtaggcgatgcatcttcaa

SEQ ID NO: 4481 - DNA, 20 bp, synthetic construct
  misc_feature 1..20: note = Synthetic Construct
  source 1..20: mol_type = other DNA
aagcggagggggctttgtct

SEQ ID NO: 4482 - DNA, 21 bp, synthetic construct
  misc_feature 1..21: note = Synthetic Construct
  source 1..21: mol_type = other DNA
gctgggtagcactcccttact

SEQ ID NO: 4483 - DNA, 22 bp, synthetic construct
  misc_feature 1..22: note = Synthetic Construct
  source 1..22: mol_type = other DNA
gagagcggacttttctcccaat

SEQ ID NO: 4484 - DNA, 28 bp, synthetic construct
  misc_feature 1..28: note = Synthetic Construct
  source 1..28: mol_type = other DNA
agtatgcgttgttagatgtttcaattcc

SEQ ID NO: 4485 - DNA, 26 bp, synthetic construct
  misc_feature 1..26: note = Synthetic Construct
  source 1..26: mol_type = other DNA
catcatggttcatcatggttctcctt

SEQ ID NO: 4486 - DNA, 22 bp, synthetic construct
  misc_feature 1..22: note = Synthetic Construct
  source 1..22: mol_type = other DNA
caccaagtcaccttctcccttt

SEQ ID NO: 4487 - DNA, 24 bp, synthetic construct
  misc_feature 1..24: note = Synthetic Construct
  source 1..24: mol_type = other DNA
ctccctcttaacccaaggatacca

SEQ ID NO: 4488 - DNA, 26 bp, synthetic construct
  misc_feature 1..26: note = Synthetic Construct
  source 1..26: mol_type = other DNA
ggctaccctgacaacttaaacagtct

SEQ ID NO: 4489 - DNA, 24 bp, synthetic construct
  misc_feature 1..24: note = Synthetic Construct
  source 1..24: mol_type = other DNA
acctgtgaaagaccactgcatacc

SEQ ID NO: 4490 - DNA, 24 bp, synthetic construct
  misc_feature 1..24: note = Synthetic Construct
  source 1..24: mol_type = other DNA
agctagacagagctgcacaagatg

SEQ ID NO: 4491 - DNA, 20 bp, synthetic construct
  misc_feature 1..20: note = Synthetic Construct
  source 1..20: mol_type = other DNA
caacctcatggctggcatgt

SEQ ID NO: 4492 - DNA, 18 bp, synthetic construct
  misc_feature 1..18: note = Synthetic Construct
  source 1..18: mol_type = other DNA
tcttcacccgcccatcca

SEQ ID NO: 4493 - DNA, 26 bp, synthetic construct
  misc_feature 1..26: note = Synthetic Construct
  source 1..26: mol_type = other DNA
ggtcttcacccttgagagatgtaggt

SEQ ID NO: 4494 - DNA, 22 bp, synthetic construct
  misc_feature 1..22: note = Synthetic Construct
  source 1..22: mol_type = other DNA
gctccacaaatcttgcccctat

SEQ ID NO: 4495 - DNA, 21 bp, synthetic construct
  misc_feature 1..21: note = Synthetic Construct
  source 1..21: mol_type = other DNA
agcgccctagtccaaagacaa

SEQ ID NO: 4496 - DNA, 22 bp, synthetic construct
  misc_feature 1..22: note = Synthetic Construct
  source 1..22: mol_type = other DNA
gtgccaaacacagagcttcatg

SEQ ID NO: 4497 - DNA, 28 bp, synthetic construct
  misc_feature 1..28: note = Synthetic Construct
  source 1..28: mol_type = other DNA
ctaatgtggtacttagctcacagtaagt

SEQ ID NO: 4498 - DNA, 25 bp, synthetic construct
  misc_feature 1..25: note = Synthetic Construct
  source 1..25: mol_type = other DNA
acagaggaccacaataaccttatcc

SEQ ID NO: 4499 - DNA, 24 bp, synthetic construct
  misc_feature 1..24: note = Synthetic Construct
  source 1..24: mol_type = other DNA
cagagattggcactcttccctctt

SEQ ID NO: 4500 - DNA, 20 bp, synthetic construct
  misc_feature 1..20: note = Synthetic Construct
  source 1..20: mol_type = other DNA
ctgctgaggcctgagacatg

SEQ ID NO: 4501 - DNA, 21 bp, synthetic construct
  misc_feature 1..21: note = Synthetic Construct
  source 1..21: mol_type = other DNA
accctgcagttgacaatttgc

SEQ ID NO: 4502 - DNA, 30 bp, synthetic construct
  misc_feature 1..30: note = Synthetic Construct
  source 1..30: mol_type = other DNA
gggagaggaagtatatgagtgtgaattagg

SEQ ID NO: 4503 - DNA, 28 bp, synthetic construct
  misc_feature 1..28: note = Synthetic Construct
  source 1..28: mol_type = other DNA
ccaactacaagtccctagctcttttctc

SEQ ID NO: 4504 - DNA, 25 bp, synthetic construct
  misc_feature 1..25: note = Synthetic Construct
  source 1..25: mol_type = other DNA
actaatattcactggccaactgtga

SEQ ID NO: 4505 - DNA, 23 bp, synthetic construct
  misc_feature 1..23: note = Synthetic Construct
  source 1..23: mol_type = other DNA
acctgtaactccctgaggcagaa

SEQ ID NO: 4506 - DNA, 22 bp, synthetic construct
  misc_feature 1..22: note = Synthetic Construct
  source 1..22: mol_type = other DNA
agagatagcccatcccagttgt

SEQ ID NO: 4507 - DNA, 25 bp, synthetic construct
  misc_feature 1..25: note = Synthetic Construct
  source 1..25: mol_type = other DNA
gtgagtagcatgccttcattgaatc

SEQ ID NO: 4508 - DNA, 19 bp, synthetic construct
  misc_feature 1..19: note = Synthetic Construct
  source 1..19: mol_type = other DNA
tggagaggggtggcttgct

SEQ ID NO: 4509 - DNA, 23 bp, synthetic construct
  misc_feature 1..23: note = Synthetic Construct
  source 1..23: mol_type = other DNA
aaaacaatgtccctgcactcaag

SEQ ID NO: 4510 - DNA, 24 bp, synthetic construct
  misc_feature 1..24: note = Synthetic Construct
  source 1..24: mol_type = other DNA
gacatgaccaggaagcatctctca

SEQ ID NO: 4511 - DNA, 19 bp, synthetic construct
  misc_feature 1..19: note = Synthetic Construct
  source 1..19: mol_type = other DNA
acccgctccacacacacaa

SEQ ID NO: 4512 - DNA, 23 bp, synthetic construct
  misc_feature 1..23: note = Synthetic Construct
  source 1..23: mol_type = other DNA
aggcctctcattgatcttttgct

SEQ ID NO: 4513 - DNA, 24 bp, synthetic construct
  misc_feature 1..24: note = Synthetic Construct
  source 1..24: mol_type = other DNA
ccgaggaactatacccacttggtt

SEQ ID NO: 4514 - DNA, 21 bp, synthetic construct
  misc_feature 1..21: note = Synthetic Construct
  source 1..21: mol_type = other DNA
cgtctcactgctgtcttctgt

SEQ ID NO: 4515 - DNA, 22 bp, synthetic construct
  misc_feature 1..22: note = Synthetic Construct
  source 1..22: mol_type = other DNA
gcaaccccctctttaactttgc

SEQ ID NO: 4516 - DNA, 24 bp, synthetic construct
  misc_feature 1..24: note = Synthetic Construct
  source 1..24: mol_type = other DNA
aggggatgaccaaccctgatcata

SEQ ID NO: 4517 - DNA, 26 bp, synthetic construct
  misc_feature 1..26: note = Synthetic Construct
  source 1..26: mol_type = other DNA
cccaggttaatgagtagtaagtgtca

SEQ ID NO: 4518 - DNA, 27 bp, synthetic construct
  misc_feature 1..27: note = Synthetic Construct
  source 1..27: mol_type = other DNA
ggcttcattcatcacatgactctgtga

SEQ ID NO: 4519 - DNA, 19 bp, synthetic construct
  misc_feature 1..19: note = Synthetic Construct
  source 1..19: mol_type = other DNA
acgtggctgccttcatcct

SEQ ID NO: 4520 - DNA, 26 bp, synthetic construct
  misc_feature 1..26: note = Synthetic Construct
  source 1..26: mol_type = other DNA
cagagaaaaatagctgtccccattgg

SEQ ID NO: 4521 - DNA, 21 bp, synthetic construct
  misc_feature 1..21: note = Synthetic Construct
  source 1..21: mol_type = other DNA
attaagctgcacccacacact

SEQ ID NO: 4522 - DNA, 22 bp, synthetic construct
  misc_feature 1..22: note = Synthetic Construct
  source 1..22: mol_type = other DNA
gggcgtttttgtccttcttggt

SEQ ID NO: 4523 - DNA, 21 bp, synthetic construct
  misc_feature 1..21: note = Synthetic Construct
  source 1..21: mol_type = other DNA
aaggtggatgtgctcagcaat

SEQ ID NO: 4524 - DNA, 24 bp, synthetic construct
  misc_feature 1..24: note = Synthetic Construct
  source 1..24: mol_type = other DNA
catcttggtttcttccctttgcaa

SEQ ID NO: 4525 - DNA, 26 bp, synthetic construct
  misc_feature 1..26: note = Synthetic Construct
  source 1..26: mol_type = other DNA
gacttattgcctcaaacctctacact

SEQ ID NO: 4526 - DNA, 24 bp, synthetic construct
  misc_feature 1..24: note = Synthetic Construct
  source 1..24: mol_type = other DNA
cgctggagattgagggtggaatta

SEQ ID NO: 4527 - DNA, 24 bp, synthetic construct
  misc_feature 1..24: note = Synthetic Construct
  source 1..24: mol_type = other DNA
tcttgccatcaccatcagtcataa

SEQ ID NO: 4528 - DNA, 20 bp, synthetic construct
  misc_feature 1..20: note = Synthetic Construct
  source 1..20: mol_type = other DNA
atgggcttaagggggtggaa

SEQ ID NO: 4529 - DNA, 22 bp, synthetic construct
  misc_feature 1..22: note = Synthetic Construct
  source 1..22: mol_type = other DNA
actgtcagaatcccaggcagta

SEQ ID NO: 4530 - DNA, 22 bp, synthetic construct
  misc_feature 1..22: note = Synthetic Construct
  source 1..22: mol_type = other DNA
tccggggaagaacattttgaca

SEQ ID NO: 4531 - DNA, 23 bp, synthetic construct
  misc_feature 1..23: note = Synthetic Construct
  source 1..23: mol_type = other DNA
ggtaggagatggagccaatgaag

SEQ ID NO: 4532 - DNA, 19 bp, synthetic construct
  misc_feature 1..19: note = Synthetic Construct
  source 1..19: mol_type = other DNA
gcgcaagacagcagaaacc

SEQ ID NO: 4533 - DNA, 24 bp, synthetic construct
  misc_feature 1..24: note = Synthetic Construct
  source 1..24: mol_type = other DNA
ctcagactgtggcttatgatgtct

SEQ ID NO: 4534 - DNA, 26 bp, synthetic construct
  misc_feature 1..26: note = Synthetic Construct
  source 1..26: mol_type = other DNA
agtgacaacacaactttgaagatgag

SEQ ID NO: 4535 - DNA, 26 bp, synthetic construct
  misc_feature 1..26: note = Synthetic Construct
  source 1..26: mol_type = other DNA
cgggcagtaagaaatttcttgccaat

SEQ ID NO: 4536 - DNA, 22 bp, synthetic construct
  misc_feature 1..22: note = Synthetic Construct
  source 1..22: mol_type = other DNA
gtccgaaagagagcaaggagtt

SEQ ID NO: 4537 - DNA, 20 bp, synthetic construct
  misc_feature 1..20: note = Synthetic Construct
  source 1..20: mol_type = other DNA
accaggcagaccccatcagt

SEQ ID NO: 4538 - DNA, 22 bp, synthetic construct
  misc_feature 1..22: note = Synthetic Construct
  source 1..22: mol_type = other DNA
aaactccctgagtctccgtgaa

SEQ ID NO: 4539 - DNA, 22 bp, synthetic construct
  misc_feature 1..22: note = Synthetic Construct
  source 1..22: mol_type = other DNA
gcatctggcacctttctcaagt

SEQ ID NO: 4540 - DNA, 24 bp, synthetic construct
  misc_feature 1..24: note = Synthetic Construct
  source 1..24: mol_type = other DNA
ctttctaagcagggtggacatcag

SEQ ID NO: 4541 - DNA, 23 bp, synthetic construct
  misc_feature 1..23: note = Synthetic Construct
  source 1..23: mol_type = other DNA
tgacaaacacccaaggtaaacca

SEQ ID NO: 4542 - DNA, 22 bp, synthetic construct
  misc_feature 1..22: note = Synthetic Construct
  source 1..22: mol_type = other DNA
tctcatgtcccagaccctactg

SEQ ID NO: 4543 - DNA, 22 bp, synthetic construct
  misc_feature 1..22: note = Synthetic Construct
  source 1..22: mol_type = other DNA
ggacccgctgcatggaaattaa

SEQ ID NO: 4544 - DNA, 26 bp, synthetic construct
  misc_feature 1..26: note = Synthetic Construct
  source 1..26: mol_type = other DNA
tgtcagttaagcaagtgttcctatct

SEQ ID NO: 4545 - DNA, 24 bp, synthetic construct
  misc_feature 1..24: note = Synthetic Construct
  source 1..24: mol_type = other DNA
gctcacttgaggctcacttactgt

SEQ ID NO: 4546 - DNA, 26 bp, synthetic construct
  misc_feature 1..26: note = Synthetic Construct
  source 1..26: mol_type = other DNA
gtgtttaggccaagtaggagacttct

SEQ ID NO: 4547 - DNA, 20 bp, synthetic construct
  misc_feature 1..20: note = Synthetic Construct
  source 1..20: mol_type = other DNA
caagggttgggtgcagagaa

SEQ ID NO: 4548 - DNA, 22 bp, synthetic construct
  misc_feature 1..22: note = Synthetic Construct
  source 1..22: mol_type = other DNA
tccttatgggatggctgtgttg

SEQ ID NO: 4549 - DNA, 23 bp, synthetic construct
  misc_feature 1..23: note = Synthetic Construct
  source 1..23: mol_type = other DNA
gttgtgtgagtgagccaaatcac

SEQ ID NO: 4550 - DNA, 25 bp, synthetic construct
  misc_feature 1..25: note = Synthetic Construct
  source 1..25: mol_type = other DNA
gtctagatcctgactcactgcttag

SEQ ID NO: 4551 - DNA, 19 bp, synthetic construct
  misc_feature 1..19: note = Synthetic Construct
  source 1..19: mol_type = other DNA
tgctgccccaagctcctta

SEQ ID NO: 4552 - DNA, 27 bp, synthetic construct
  misc_feature 1..27: note = Synthetic Construct
  source 1..27: mol_type = other DNA
cctgaaatacctagatcctctctttgc

SEQ ID NO: 4553 - DNA, 28 bp, synthetic construct
  misc_feature 1..28: note = Synthetic Construct
  source 1..28: mol_type = other DNA
ggctgagaggatgaaatacttgtagtca

SEQ ID NO: 4554 - DNA, 20 bp, synthetic construct
  misc_feature 1..20: note = Synthetic Construct
  source 1..20: mol_type = other DNA
gtggtgccactcttggaact

SEQ ID NO: 4555 - DNA, 24 bp, synthetic construct
  misc_feature 1..24: note = Synthetic Construct
  source 1..24: mol_type = other DNA
catcgtgggagcatttacctaagg

SEQ ID NO: 4556 - DNA, 23 bp, synthetic construct
  misc_feature 1..23: note = Synthetic Construct
  source 1..23: mol_type = other DNA
tcagcatcactaacgaggtcttc

SEQ ID NO: 4557 - DNA, 25 bp, synthetic construct
  misc_feature 1..25: note = Synthetic Construct
  source 1..25: mol_type = other DNA
caccatgggaatgatctgtgtactg

SEQ ID NO: 4558 - DNA, 22 bp, synthetic construct
  misc_feature 1..22: note = Synthetic Construct
  source 1..22: mol_type = other DNA
cacttgtggcccccatgtttat

SEQ ID NO: 4559 - DNA, 25 bp, synthetic construct
  misc_feature 1..25: note = Synthetic Construct
  source 1..25: mol_type = other DNA
tcctaagtattcaggaggctgaagt

SEQ ID NO: 4560 - DNA, 27 bp, synthetic construct
  misc_feature 1..27: note = Synthetic Construct
  source 1..27: mol_type = other DNA
gggctgcacatttgattatcattgtgt

SEQ ID NO: 4561 - DNA, 22 bp, synthetic construct
  misc_feature 1..22: note = Synthetic Construct
  source 1..22: mol_type = other DNA
aaagccatggtggggtgtgaga

SEQ ID NO: 4562 - DNA, 21 bp, synthetic construct
  misc_feature 1..21: note = Synthetic Construct
  source 1..21: mol_type = other DNA
actgctggctgctcaaagcta

SEQ ID NO: 4563 - DNA, 24 bp, synthetic construct
  misc_feature 1..24: note = Synthetic Construct
  source 1..24: mol_type = other DNA
agctggggagacttagtcagatga

SEQ ID NO: 4564 - DNA, 24 bp, synthetic construct
  misc_feature 1..24: note = Synthetic Construct
  source 1..24: mol_type = other DNA
tgagctgaagttcttgctgagatt

SEQ ID NO: 4565 - DNA, 22 bp, synthetic construct
  misc_feature 1..22: note = Synthetic Construct
  source 1..22: mol_type = other DNA
tgcaggaagccacacagaagtt

SEQ ID NO: 4566 - DNA, 30 bp, synthetic construct
  misc_feature 1..30: note = Synthetic Construct
  source 1..30: mol_type = other DNA
gcctaaaatatttgctgtctggccttttac

SEQ ID NO: 4567 - DNA, 24 bp, synthetic construct
  misc_feature 1..24: note = Synthetic Construct
  source 1..24: mol_type = other DNA
aggcatggtcagaagggttaagag

SEQ ID NO: 4568 - DNA, 23 bp, synthetic construct
  misc_feature 1..23: note = Synthetic Construct
  source 1..23: mol_type = other DNA
tccagatgtcccatggagtagga

SEQ ID NO: 4569 - DNA, 22 bp, synthetic construct
  misc_feature 1..22: note = Synthetic Construct
  source 1..22: mol_type = other DNA
gcttggctccatctgaaattcc

SEQ ID NO: 4570 - DNA, 19 bp, synthetic construct
  misc_feature 1..19: note = Synthetic Construct
  source 1..19: mol_type = other DNA
cctgctcaggccattccaa

SEQ ID NO: 4571 - DNA, 21 bp, synthetic construct
  misc_feature 1..21: note = Synthetic Construct
  source 1..21: mol_type = other DNA
aagccttccagactgggcaaa

SEQ ID NO: 4572 - DNA, 24 bp, synthetic construct
  misc_feature 1..24: note = Synthetic Construct
  source 1..24: mol_type = other DNA
ggactcaacacccaattccagaga

SEQ ID NO: 4573 - DNA, 22 bp, synthetic construct
  misc_feature 1..22: note = Synthetic Construct
  source 1..22: mol_type = other DNA
ctgagccacagaacacacaagt

SEQ ID NO: 4574 - DNA, 25 bp, synthetic construct
  misc_feature 1..25: note = Synthetic Construct
  source 1..25: mol_type = other DNA
gcacgtatgtgtgttgatggacata

SEQ ID NO: 4575 - DNA, 26 bp, synthetic construct
  misc_feature 1..26: note = Synthetic Construct
  source 1..26: mol_type = other DNA
gttgcactacaaggtagattgggtta

SEQ ID NO: 4576 - DNA, 22 bp, synthetic construct
  misc_feature 1..22: note = Synthetic Construct
  source 1..22: mol_type = other DNA
gacaagggcttgaggttacaca

SEQ ID NO: 4577 - DNA, 22 bp, synthetic construct
  misc_feature 1..22: note = Synthetic Construct
  source 1..22: mol_type = other DNA
tcgtggatttgtcgttctttgc

SEQ ID NO: 4578 - DNA, 26 bp, synthetic construct
  misc_feature 1..26: note = Synthetic Construct
  source 1..26: mol_type = other DNA
actgtaacaatgttaagaggcacaga

SEQ ID NO: 4579 - DNA, 30 bp, synthetic construct
  misc_feature 1..30: note = Synthetic Construct
  source 1..30: mol_type = other DNA
gttgtccttaatatgccatagtcattcatg

SEQ ID NO: 4580 - DNA, 22 bp, synthetic construct
  misc_feature 1..22: note = Synthetic Construct
  source 1..22: mol_type = other DNA
tcacagacagcagatccctgat

SEQ ID NO: 4581 - DNA, 29 bp, synthetic construct
  misc_feature 1..29: note = Synthetic Construct
  source 1..29: mol_type = other DNA
gaacttatgctgagattccattaattcca

SEQ ID NO: 4582 - DNA, 28 bp, synthetic construct
  misc_feature 1..28: note = Synthetic Construct
  source 1..28: mol_type = other DNA
agtaaatcaatgtcactggatccatgaa

SEQ ID NO: 4583 - DNA, 24 bp, synthetic construct
  misc_feature 1..24: note = Synthetic Construct
  source 1..24: mol_type = other DNA
ggtgaccaacttgtcctgaggaaa

SEQ ID NO: 4584 - DNA, 24 bp, synthetic construct
  misc_feature 1..24: note = Synthetic Construct
  source 1..24: mol_type = other DNA
ggtaggagttgggggaaaatgaaa

SEQ ID NO: 4585 - DNA, 22 bp, synthetic construct
  misc_feature 1..22: note = Synthetic Construct
  source 1..22: mol_type = other DNA
gatgtcaccgccacttttaagc

SEQ ID NO: 4586 - DNA, 22 bp, synthetic construct
  misc_feature 1..22: note = Synthetic Construct
  source 1..22: mol_type = other DNA
tgcacacttcctcggaaaacag

SEQ ID NO: 4587 - DNA, 26 bp, synthetic construct
  misc_feature 1..26: note = Synthetic Construct
  source 1..26: mol_type = other DNA
ggtgtcagatttcattcagagaggat

SEQ ID NO: 4588 - DNA, 28 bp, synthetic construct
  misc_feature 1..28: note = Synthetic Construct
  source 1..28: mol_type = other DNA
ccaaggttcttttcactatgtcctagct

SEQ ID NO: 4589 - DNA, 19 bp, synthetic construct
  misc_feature 1..19: note = Synthetic Construct
  source 1..19: mol_type = other DNA
agggccacatcccccacaa

SEQ ID NO: 4590 - DNA, 25 bp, synthetic construct
  misc_feature 1..25: note = Synthetic Construct
  source 1..25: mol_type = other DNA
gtgggagctctaacttgacactatt

SEQ ID NO: 4591 - DNA, 22 bp, synthetic construct
  misc_feature 1..22: note = Synthetic Construct
  source 1..22: mol_type = other DNA
cctacacctgcttcctgtcctt

SEQ ID NO: 4592 - DNA, 23 bp, synthetic construct
  misc_feature 1..23: note = Synthetic Construct
  source 1..23: mol_type = other DNA
accaactctgcgtatctggaatg

SEQ ID NO: 4593 - DNA, 21 bp, synthetic construct
  misc_feature 1..21: note = Synthetic Construct
  source 1..21: mol_type = other DNA
ggcctcctagaccacttcaga

SEQ ID NO: 4594 - DNA, 25 bp, synthetic construct
  misc_feature 1..25: note = Synthetic Construct
  source 1..25: mol_type = other DNA
tgctcctagaataaggacacactca

SEQ ID NO: 4595 - DNA, 25 bp, synthetic construct
  misc_feature 1..25: note = Synthetic Construct
  source 1..25: mol_type = other DNA
cccaaggaccatatgtaacctacca

SEQ ID NO: 4596 - DNA, 22 bp, synthetic construct
  misc_feature 1..22: note = Synthetic Construct
  source 1..22: mol_type = other DNA
cctgaacaaagacagcccaatg

SEQ ID NO: 4597 - DNA, 22 bp, synthetic construct
  misc_feature 1..22: note = Synthetic Construct
  source 1..22: mol_type = other DNA
aaatgtcctcccacaggcactt

SEQ ID NO: 4598 - DNA, 24 bp, synthetic construct
  misc_feature 1..24: note = Synthetic Construct
  source 1..24: mol_type = other DNA
cacatcagttctgtgggagatacc

SEQ ID NO: 4599 - DNA, 20 bp, synthetic construct
  misc_feature 1..20: note = Synthetic Construct
  source 1..20: mol_type = other DNA
cacgtggttgtggggaacaa

SEQ ID NO: 4600 - DNA, 25 bp, synthetic construct
  misc_feature 1..25: note = Synthetic Construct
  source 1..25: mol_type = other DNA
tccccatcaccttattttgacaaga

SEQ ID NO: 4601 - DNA, 23 bp, synthetic construct
  misc_feature 1..23: note = Synthetic Construct
  source 1..23: mol_type = other DNA
gtcaacccgaatagctcctttct

SEQ ID NO: 4602 - DNA, 28 bp, synthetic construct
  misc_feature 1..28: note = Synthetic Construct
  source 1..28: mol_type = other DNA
agagaattgagttatgctgccataaatc

SEQ ID NO: 4603 - DNA, 20 bp, synthetic construct
  misc_feature 1..20: note = Synthetic Construct
  source 1..20: mol_type = other DNA
ccatgtggcaggaagaacca

SEQ ID NO: 4604 - DNA, 26 bp, synthetic construct
  misc_feature 1..26: note = Synthetic Construct
  source 1..26: mol_type = other DNA
ccttgaaaggaatggacctagacatg

SEQ ID NO: 4605 - DNA, 24 bp, synthetic construct
  misc_feature 1..24: note = Synthetic Construct
  source 1..24: mol_type = other DNA
ctccttctccaagacaggaaatcc

SEQ ID NO: 4606 - DNA, 24 bp, synthetic construct
  misc_feature 1..24: note = Synthetic Construct
  source 1..24: mol_type = other DNA
ggacgccactttaaaatccaactg

SEQ ID NO: 4607 - DNA, 23 bp, synthetic construct
  misc_feature 1..23: note = Synthetic Construct
  source 1..23: mol_type = other DNA
ttcctagccaggtgaccatctag

SEQ ID NO: 4608 - DNA, 21 bp, synthetic construct
  misc_feature 1..21: note = Synthetic Construct
  source 1..21: mol_type = other DNA
tcctacctcatgcctgtcact

SEQ ID NO: 4609 - DNA, 25 bp, synthetic construct
  misc_feature 1..25: note = Synthetic Construct
  source 1..25: mol_type = other DNA
ggatgattgccattttcctgaacac

SEQ ID NO: 4610 - DNA, 23 bp, synthetic construct
  misc_feature 1..23: note = Synthetic Construct
  source 1..23: mol_type = other DNA
agaaagccacaatgttggagaga

SEQ ID NO: 4611 - DNA, 24 bp, synthetic construct
  misc_feature 1..24: note = Synthetic Construct
  source 1..24: mol_type = other DNA
cctggtcaccatattccaggagta

SEQ ID NO: 4612 - DNA, 24 bp, synthetic construct
  misc_feature 1..24: note = Synthetic Construct
  source 1..24: mol_type = other DNA
agacctagccatgggtactaagaa

SEQ ID NO: 4613 - DNA, 22 bp, synthetic construct
  misc_feature 1..22: note = Synthetic Construct
  source 1..22: mol_type = other DNA
ccatctttgcacctccaagttg

SEQ ID NO: 4614 - DNA, 22 bp, synthetic construct
  misc_feature 1..22: note = Synthetic Construct
  source 1..22: mol_type = other DNA
agcaacccacagaagccatgag

SEQ ID NO: 4615 - DNA, 20 bp, synthetic construct
  misc_feature 1..20: note = Synthetic Construct
  source 1..20: mol_type = other DNA
ggtgcaagccattggtggtt

SEQ ID NO: 4616 - DNA, 27 bp, synthetic construct
  misc_feature 1..27: note = Synthetic Construct
  source 1..27: mol_type = other DNA
caaggcatgtttatacaacaacaacag

SEQ ID NO: 4617 - DNA, 19 bp, synthetic construct
  misc_feature 1..19: note = Synthetic Construct
  source 1..19: mol_type = other DNA
cagggcatggagggatgga

SEQ ID NO: 4618 - DNA, 24 bp, synthetic construct
  misc_feature 1..24: note = Synthetic Construct
  source 1..24: mol_type = other DNA
ggaggtttctaactggtgggatgt

SEQ ID NO: 4619 - DNA, 26 bp, synthetic construct
  misc_feature 1..26: note = Synthetic Construct
  source 1..26: mol_type = other DNA
gggagtactcaagctatgctgatgtg

SEQ ID NO: 4620 - DNA, 25 bp, synthetic construct
  misc_feature 1..25: note = Synthetic Construct
  source 1..25: mol_type = other DNA
gcagtcatcatcaagttgagtctct

SEQ ID NO: 4621 - DNA, 21 bp, synthetic construct
  misc_feature 1..21: note = Synthetic Construct
  source 1..21: mol_type = other DNA
aggaacttccagtgccaagga

SEQ ID NO: 4622 - DNA, 26 bp, synthetic construct
  misc_feature 1..26: note = Synthetic Construct
  source 1..26: mol_type = other DNA
gtttttcaacccaattacctggatgt

SEQ ID NO: 4623 - DNA, 28 bp, synthetic construct
  misc_feature 1..28: note = Synthetic Construct
  source 1..28: mol_type = other DNA
catctattacctgcattggttacattgc

SEQ ID NO: 4624 - DNA, 22 bp, synthetic construct
  misc_feature 1..22: note = Synthetic Construct
  source 1..22: mol_type = other DNA
tccagagaggataggggatgtg

SEQ ID NO: 4625 - DNA, 22 bp, synthetic construct
  misc_feature 1..22: note = Synthetic Construct
  source 1..22: mol_type = other DNA
agccaggcatccatacgaccta

SEQ ID NO: 4626 - DNA, 22 bp, synthetic construct
  misc_feature 1..22: note = Synthetic Construct
  source 1..22: mol_type = other DNA
tgtttttccacttggcctagca

SEQ ID NO: 4627 - DNA, 26 bp, synthetic construct
  misc_feature 1..26: note = Synthetic Construct
  source 1..26: mol_type = other DNA
ctcaggtccctattgctatggtaaag

SEQ ID NO: 4628 - DNA, 27 bp, synthetic construct
  misc_feature 1..27: note = Synthetic Construct
  source 1..27: mol_type = other DNA
cactgaagccaaataaaccagaaacac

SEQ ID NO: 4629 - DNA, 26 bp, synthetic construct
  misc_feature 1..26: note = Synthetic Construct
  source 1..26: mol_type = other DNA
cgtacatatggctattctggaactga

SEQ ID NO: 4630 - DNA, 23 bp, synthetic construct
  misc_feature 1..23: note = Synthetic Construct
  source 1..23: mol_type = other DNA
tgagagaccctagaggcagctat

SEQ ID NO: 4631 - DNA, 24 bp, synthetic construct
  misc_feature 1..24: note = Synthetic Construct
  source 1..24: mol_type = other DNA
ccttgaaagtaggcctgaagtagt

SEQ ID NO: 4632 - DNA, 23 bp, synthetic construct
  misc_feature 1..23: note = Synthetic Construct
  source 1..23: mol_type = other DNA
cacaaaaccactacacccttcca

SEQ ID NO: 4633 - DNA, 24 bp, synthetic construct
  misc_feature 1..24: note = Synthetic Construct
  source 1..24: mol_type = other DNA
gacaaaacacctgaggtcattggt

SEQ ID NO: 4634 - DNA, 21 bp, synthetic construct
  misc_feature 1..21: note = Synthetic Construct
  source 1..21: mol_type = other DNA
aaagacggtccacctgaggtt

SEQ ID NO: 4635 - DNA, 22 bp, synthetic construct
  misc_feature 1..22: note = Synthetic Construct
  source 1..22: mol_type = other DNA
agcgaacatgctgacacctact

SEQ ID NO: 4636 - DNA, 21 bp, synthetic construct
  misc_feature 1..21: note = Synthetic Construct
  source 1..21: mol_type = other DNA
ccagggagagcaactgggttt

SEQ ID NO: 4637 - DNA, 19 bp, synthetic construct
  misc_feature 1..19: note = Synthetic Construct
  source 1..19: mol_type = other DNA
aggcaatgggctcccttca

SEQ ID NO: 4638 - DNA, 26 bp, synthetic construct
  misc_feature 1..26: note = Synthetic Construct
  source 1..26: mol_type = other DNA
tgattagatggccacaatgaattagc

SEQ ID NO: 4639 - DNA, 27 bp, synthetic construct
  misc_feature 1..27: note = Synthetic Construct
  source 1..27: mol_type = other DNA
tcattcaatatgcccctgtgtttaatg

SEQ ID NO: 4640 - DNA, 21 bp, synthetic construct
  misc_feature 1..21: note = Synthetic Construct
  source 1..21: mol_type = other DNA
gctccacactggcctctacaa

SEQ ID NO: 4641 - DNA, 22 bp, synthetic construct
  misc_feature 1..22: note = Synthetic Construct
  source 1..22: mol_type = other DNA
cttcagctcaaccctccctttt

SEQ ID NO: 4642 - DNA, 24 bp, synthetic construct
  misc_feature 1..24: note = Synthetic Construct
  source 1..24: mol_type = other DNA
ggtgtttctgcaaatggagcaaca

SEQ ID NO: 4643 - DNA, 26 bp, synthetic construct
  misc_feature 1..26: note = Synthetic Construct
  source 1..26: mol_type = other DNA
cactctggtctactagtctggtatca

SEQ ID NO: 4644 - DNA, 22 bp, synthetic construct
  misc_feature 1..22: note = Synthetic Construct
  source 1..22: mol_type = other DNA
agggcaaggagaatcctgactt

SEQ ID NO: 4645 - DNA, 26 bp, synthetic construct
  misc_feature 1..26: note = Synthetic Construct
  source 1..26: mol_type = other DNA
cgacaaattccttgaaacaagttgtg

SEQ ID NO: 4646 - DNA, 21 bp, synthetic construct
  misc_feature 1..21: note = Synthetic Construct
  source 1..21: mol_type = other DNA
tgcagtcattgggcccattgt

SEQ ID NO: 4647 - DNA, 19 bp, synthetic construct
  misc_feature 1..19: note = Synthetic Construct
  source 1..19: mol_type = other DNA
aaaggagctggggcaatgc

SEQ ID NO: 4648 - DNA, 21 bp, synthetic construct
  misc_feature 1..21: note = Synthetic Construct
  source 1..21: mol_type = other DNA
tgggcaggcagcttagtacat

SEQ ID NO: 4649 - DNA, 25 bp, synthetic construct
  misc_feature 1..25: note = Synthetic Construct
  source 1..25: mol_type = other DNA
actttcatctaccccttgacatctc

SEQ ID NO: 4650 - DNA, 28 bp, synthetic construct
  misc_feature 1..28: note = Synthetic Construct
  source 1..28: mol_type = other DNA
ggcttacacactttactgtcacacttag

SEQ ID NO: 4651 - DNA, 18 bp, synthetic construct
  misc_feature 1..18: note = Synthetic Construct
  source 1..18: mol_type = other DNA
ctggcctctgggggtaca

SEQ ID NO: 4652 - DNA, 22 bp, synthetic construct
  misc_feature 1..22: note = Synthetic Construct
  source 1..22: mol_type = other DNA
gtgggaatccatgaagctagct

SEQ ID NO: 4653 - DNA, 22 bp, synthetic construct
  misc_feature 1..22: note = Synthetic Construct
  source 1..22: mol_type = other DNA
cacctggcaggaatgatggttt

SEQ ID NO: 4654 - DNA, 25 bp, synthetic construct
  misc_feature 1..25: note = Synthetic Construct
  source 1..25: mol_type = other DNA
aaatgcttcaacacatcccttgaaa

SEQ ID NO: 4655 - DNA, 20 bp, synthetic construct
  misc_feature 1..20: note = Synthetic Construct
  source 1..20: mol_type = other DNA
gcctctgccacttgctctgt

SEQ ID NO: 4656 - DNA, 20 bp, synthetic construct
  misc_feature 1..20: note = Synthetic Construct
  source 1..20: mol_type = other DNA
acaccatcccctgagtgaca

SEQ ID NO: 4657 - DNA, 23 bp, synthetic construct
  misc_feature 1..23: note = Synthetic Construct
  source 1..23: mol_type = other DNA
tccttcccagaccctatgctctt

SEQ ID NO: 4658 - DNA, 20 bp, synthetic construct
  misc_feature 1..20: note = Synthetic Construct
  source 1..20: mol_type = other DNA
aactggagctggagcagttg

SEQ ID NO: 4659 - DNA, 27 bp, synthetic construct
  misc_feature 1..27: note = Synthetic Construct
  source 1..27: mol_type = other DNA
gcaaacatccagtgaccttacatattg

SEQ ID NO: 4660 - DNA, 25 bp, synthetic construct
  misc_feature 1..25: note = Synthetic Construct
  source 1..25: mol_type = other DNA
cagagtctctgaccatggattacac

SEQ ID NO: 4661 - DNA, 26 bp, synthetic construct
  misc_feature 1..26: note = Synthetic Construct
  source 1..26: mol_type = other DNA
agtaacaggacagatgtcaattccat

SEQ ID NO: 4662 - DNA, 23 bp, synthetic construct
  misc_feature 1..23: note = Synthetic Construct
  source 1..23: mol_type = other DNA
ctctactttcccacaggctttct

SEQ ID NO: 4663 - DNA, 22 bp, synthetic construct
  misc_feature 1..22: note = Synthetic Construct
  source 1..22: mol_type = other DNA
atgctcttaggcatgggaagtc

SEQ ID NO: 4664 - DNA, 20 bp, synthetic construct
  misc_feature 1..20: note = Synthetic Construct
  source 1..20: mol_type = other DNA
cagctcaggactgcagaaca

SEQ ID NO: 4665 - DNA, 21 bp, synthetic construct
  misc_feature 1..21: note = Synthetic Construct
  source 1..21: mol_type = other DNA
acccacccagcttggaaaagg

SEQ ID NO: 4666 - DNA, 25 bp, synthetic construct
  misc_feature 1..25: note = Synthetic Construct
  source 1..25: mol_type = other DNA
accctatagcctttatcagcaagga

SEQ ID NO: 4667 - DNA, 21 bp, synthetic construct
  misc_feature 1..21: note = Synthetic Construct
  source 1..21: mol_type = other DNA
agaaccctggaatggcttcct

SEQ ID NO: 4668 - DNA, 20 bp, synthetic construct
  misc_feature 1..20: note = Synthetic Construct
  source 1..20: mol_type = other DNA
gcgggtgacgttaggagaca

SEQ ID NO: 4669 - DNA, 20 bp, synthetic construct
  misc_feature 1..20: note = Synthetic Construct
  source 1..20: mol_type = other DNA
aaggcagggacttggtgact

SEQ ID NO: 4670 - DNA, 22 bp, synthetic construct
  misc_feature 1..22: note = Synthetic Construct
  source 1..22: mol_type = other DNA
aagctggctccactgagagaat

SEQ ID NO: 4671 - DNA, 19 bp, synthetic construct
  misc_feature 1..19: note = Synthetic Construct
  source 1..19: mol_type = other DNA
cccccagcagtttgcatca

SEQ ID NO: 4672 - DNA, 19 bp, synthetic construct
  misc_feature 1..19: note = Synthetic Construct
  source 1..19: mol_type = other DNA
ggtgccagttctgctgcat

SEQ ID NO: 4673 - DNA, 25 bp, synthetic construct
  misc_feature 1..25: note = Synthetic Construct
  source 1..25: mol_type = other DNA
gtgcactacagctactttctgaagt

SEQ ID NO: 4674 - DNA, 25 bp, synthetic construct
  misc_feature 1..25: note = Synthetic Construct
  source 1..25: mol_type = other DNA
ttcctacaccctcattcagttgttt

SEQ ID NO: 4675 - DNA, 19 bp, synthetic construct
  misc_feature 1..19: note = Synthetic Construct
  source 1..19: mol_type = other DNA
ccggtcctcactgcctctt

SEQ ID NO: 4676 - DNA, 22 bp, synthetic construct
  misc_feature 1..22: note = Synthetic Construct
  source 1..22: mol_type = other DNA
tcagtggtcgctcatctttgaa

SEQ ID NO: 4677 - DNA, 23 bp, synthetic construct
  misc_feature 1..23: note = Synthetic Construct
  source 1..23: mol_type = other DNA
cctagaaaacggcttgtcatgga

SEQ ID NO: 4678 - DNA, 22 bp, synthetic construct
  misc_feature 1..22: note = Synthetic Construct
  source 1..22: mol_type = other DNA
gggtaagctcacatgctctcat

SEQ ID NO: 4679 - DNA, 21 bp, synthetic construct
  misc_feature 1..21: note = Synthetic Construct
  source 1..21: mol_type = other DNA
ctgggagcactccttgtcttt

SEQ ID NO: 4680 - DNA, 21 bp, synthetic construct
  misc_feature 1..21: note = Synthetic Construct
  source 1..21: mol_type = other DNA
acaggccacccagagtaagac

SEQ ID NO: 4681 - DNA, 22 bp, synthetic construct
  misc_feature 1..22: note = Synthetic Construct
  source 1..22: mol_type = other DNA
aagccagttttgctccctttgc

SEQ ID NO: 4682 - DNA, 28 bp, synthetic construct
  misc_feature 1..28: note = Synthetic Construct
  source 1..28: mol_type = other DNA
tgcttttacttgagttatagctcagtca

SEQ ID NO: 4683 - DNA, 21 bp, synthetic construct
  misc_feature 1..21: note = Synthetic Construct
  source 1..21: mol_type = other DNA
tctgcccatcaaaaccaacca

SEQ ID NO: 4684 - DNA, 22 bp, synthetic construct
  misc_feature 1..22: note = Synthetic Construct
  source 1..22: mol_type = other DNA
agctcacccaatacctgtggaa

SEQ ID NO: 4685 - DNA, 26 bp, synthetic construct
  misc_feature 1..26: note = Synthetic Construct
  source 1..26: mol_type = other DNA
gcaggagtgcattaagagtcaactag

SEQ ID NO: 4686 - DNA, 26 bp, synthetic construct
  misc_feature 1..26: note = Synthetic Construct
  source 1..26: mol_type = other DNA
ctgaaatcctattgagtgtggatgca

SEQ ID NO: 4687 - DNA, 26 bp, synthetic construct
  misc_feature 1..26: note = Synthetic Construct
  source 1..26: mol_type = other DNA
ccactcttagggagccatttcttacc

SEQ ID NO: 4688 - DNA, 21 bp, synthetic construct
  misc_feature 1..21: note = Synthetic Construct
  source 1..21: mol_type = other DNA
tccatcacctgctagctgtga

SEQ ID NO: 4689 - DNA, 23 bp, synthetic construct
  misc_feature 1..23: note = Synthetic Construct
  source 1..23: mol_type = other DNA
catcagtgtcagtgcagaacttg

SEQ ID NO: 4690 - DNA, 20 bp, synthetic construct
  misc_feature 1..20: note = Synthetic Construct
  source 1..20: mol_type = other DNA
tgcggctgtgtgttaacaga

SEQ ID NO: 4691 - DNA, 20 bp, synthetic construct
  misc_feature 1..20: note = Synthetic Construct
  source 1..20: mol_type = other DNA
acaaaacaggggcccatgga

SEQ ID NO: 4692 - DNA, 26 bp, synthetic construct
  misc_feature 1..26: note = Synthetic Construct
  source 1..26: mol_type = other DNA
gaatgatgggagacagttttttagca

SEQ ID NO: 4693 - DNA, 19 bp, synthetic construct
  misc_feature 1..19: note = Synthetic Construct
  source 1..19: mol_type = other DNA
agtggctggccggatccta

SEQ ID NO: 4694 - DNA, 25 bp, synthetic construct
  misc_feature 1..25: note = Synthetic Construct
  source 1..25: mol_type = other DNA
gctaggtaggaggcaaattgtctca

SEQ ID NO: 4695 - DNA, 22 bp, synthetic construct
  misc_feature 1..22: note = Synthetic Construct
  source 1..22: mol_type = other DNA
tctgccacccctcatgttctct

SEQ ID NO: 4696 - DNA, 22 bp, synthetic construct
  misc_feature 1..22: note = Synthetic Construct
  source 1..22: mol_type = other DNA
tgcagtgggtcttctgattctg

SEQ ID NO: 4697 - DNA, 20 bp, synthetic construct
  misc_feature 1..20: note = Synthetic Construct
  source 1..20: mol_type = other DNA
ggagaccccggcataagtct

SEQ ID NO: 4698 - DNA, 18 bp, synthetic construct
  misc_feature 1..18: note = Synthetic Construct
  source 1..18: mol_type = other DNA
aggaggggcccacgctaa

SEQ ID NO: 4699 - DNA, 24 bp, synthetic construct
  misc_feature 1..24: note = Synthetic Construct
  source 1..24: mol_type = other DNA
tggccttatcacagtctcttctct

SEQ ID NO: 4700 - DNA, 25 bp, synthetic construct
  misc_feature 1..25: note = Synthetic Construct
  source 1..25: mol_type = other DNA
cctgagagtgtacttgttagttggt

SEQ ID NO: 4701 - DNA, 21 bp, synthetic construct
  misc_feature 1..21: note = Synthetic Construct
  source 1..21: mol_type = other DNA
cgggagcttacttgcttctgt

SEQ ID NO: 4702 - DNA, 25 bp, synthetic construct
  misc_feature 1..25: note = Synthetic Construct
  source 1..25: mol_type = other DNA
tcacaaatacagtggctaggtcatg

SEQ ID NO: 4703 - DNA, 22 bp, synthetic construct
  misc_feature 1..22: note = Synthetic Construct
  source 1..22: mol_type = other DNA
tcctgagggccagtgaccttat

SEQ ID NO: 4704 - DNA, 22 bp, synthetic construct
  misc_feature 1..22: note = Synthetic Construct
  source 1..22: mol_type = other DNA
gagctcactcctctcttttgca

SEQ ID NO: 4705 - DNA, 30 bp, synthetic construct
  misc_feature 1..30: note = Synthetic Construct
  source 1..30: mol_type = other DNA
gccagtatcccatgtgaaatagactattgg

SEQ ID NO: 4706 - DNA, 18 bp, synthetic construct
  misc_feature 1..18: note = Synthetic Construct
  source 1..18: mol_type = other DNA
cctgacccaggccagtct

SEQ ID NO: 4707 - DNA, 24 bp, synthetic construct
  misc_feature 1..24: note = Synthetic Construct
  source 1..24: mol_type = other DNA
cctgttgtggttcgatggtttagc

SEQ ID NO: 4708 - DNA, 22 bp, synthetic construct
  misc_feature 1..22: note = Synthetic Construct
  source 1..22: mol_type = other DNA
gtctcctttgctgcaggctttt

SEQ ID NO: 4709 - DNA, 20 bp, synthetic construct
  misc_feature 1..20: note = Synthetic Construct
  source 1..20: mol_type = other DNA
ggggctacctttccctttcc

SEQ ID NO: 4710 - DNA, 22 bp, synthetic construct
  misc_feature 1..22: note = Synthetic Construct
  source 1..22: mol_type = other DNA
gcttgtggtgatcgcttaaagg

SEQ ID NO: 4711 - DNA, 22 bp, synthetic construct
  misc_feature 1..22: note = Synthetic Construct
  source 1..22: mol_type = other DNA
gcaaatctgcaacctggaagga

SEQ ID NO: 4712 - DNA, 22 bp, synthetic construct
  misc_feature 1..22: note = Synthetic Construct
  source 1..22: mol_type = other DNA
tgttcagggcatgatcctgttc

SEQ ID NO: 4713 - DNA, 22 bp, synthetic construct
  misc_feature 1..22: note = Synthetic Construct
  source 1..22: mol_type = other DNA
accacggtgctttctggaatgt

SEQ ID NO: 4714 - DNA, 26 bp, synthetic construct
  misc_feature 1..26: note = Synthetic Construct
  source 1..26: mol_type = other DNA
gtccacaatacagagagtctcttctc

SEQ ID NO: 4715 - DNA, 23 bp, synthetic construct
  misc_feature 1..23: note = Synthetic Construct
  source 1..23: mol_type = other DNA
aggttccagcaggtgtagaatgg

SEQ ID NO: 4716 - DNA, 22 bp, synthetic construct
  misc_feature 1..22: note = Synthetic Construct
  source 1..22: mol_type = other DNA
tcactcggtctcagcgttagat

SEQ ID NO: 4717 - DNA, 26 bp, synthetic construct
  misc_feature 1..26: note = Synthetic Construct
  source 1..26: mol_type = other DNA
ccaataaaatctgggggcttctcagt

SEQ ID NO: 4718 - DNA, 24 bp, synthetic construct
  misc_feature 1..24: note = Synthetic Construct
  source 1..24: mol_type = other DNA
acggagcaagatcagcttcagtag

SEQ ID NO: 4719 - DNA, 24 bp, synthetic construct
  misc_feature 1..24: note = Synthetic Construct
  source 1..24: mol_type = other DNA
gcagtctctatggggtcatagttg

SEQ ID NO: 4720 - DNA, 24 bp, synthetic construct
  misc_feature 1..24: note = Synthetic Construct
  source 1..24: mol_type = other DNA
acttttctgcagtgatctccatct

SEQ ID NO: 4721 - DNA, 23 bp, synthetic construct
  misc_feature 1..23: note = Synthetic Construct
  source 1..23: mol_type = other DNA
gcccagtcaagtctgtacccttt

SEQ ID NO: 4722 - DNA, 27 bp, synthetic construct
  misc_feature 1..27: note = Synthetic Construct
  source 1..27: mol_type = other DNA
cccatttggaggtgaggaaatgtagtc

SEQ ID NO: 4723 - DNA, 24 bp, synthetic construct
  misc_feature 1..24: note = Synthetic Construct
  source 1..24: mol_type = other DNA
tgagagctgaaatcaacactgctt

SEQ ID NO: 4724 - DNA, 20 bp, synthetic construct
  misc_feature 1..20: note = Synthetic Construct
  source 1..20: mol_type = other DNA
acctgggcctgcctgtatga

SEQ ID NO: 4725 - DNA, 25 bp, synthetic construct
  misc_feature 1..25: note = Synthetic Construct
  source 1..25: mol_type = other DNA
tctccagtttatagtgggtgagact

SEQ ID NO: 4726 - DNA, 24 bp, synthetic construct
  misc_feature 1..24: note = Synthetic Construct
  source 1..24: mol_type = other DNA
ggtcactctatgtccctctgtgta

SEQ ID NO: 4727 - DNA, 24 bp, synthetic construct
  misc_feature 1..24: note = Synthetic Construct
  source 1..24: mol_type = other DNA
gctcagctgtaggagatttgttct

SEQ ID NO: 4728 - DNA, 22 bp, synthetic construct
  misc_feature 1..22: note = Synthetic Construct
  source 1..22: mol_type = other DNA
actgtttctgtcagggccagat

SEQ ID NO: 4729 - DNA, 23 bp, synthetic construct
  misc_feature 1..23: note = Synthetic Construct
  source 1..23: mol_type = other DNA
ccttgcttttggtctggttttgg

SEQ ID NO: 4730 - DNA, 20 bp, synthetic construct
  misc_feature 1..20: note = Synthetic Construct
  source 1..20: mol_type = other DNA
tggcgtgggcgtgttagaag

SEQ ID NO: 4731 - DNA, 26 bp, synthetic construct
  misc_feature 1..26: note = Synthetic Construct
  source 1..26: mol_type = other DNA
ggtaggtagagggtaggttttgtaca

SEQ ID NO: 4732 - DNA, 22 bp, synthetic construct
  misc_feature 1..22: note = Synthetic Construct
  source 1..22: mol_type = other DNA
gctttaggaatgcctgggatga

SEQ ID NO: 4733 - DNA, 28 bp, synthetic construct
  misc_feature 1..28: note = Synthetic Construct
  source 1..28: mol_type = other DNA
ccaaactcttcccctaggttttatttgg

SEQ ID NO: 4734 - DNA, 28 bp, synthetic construct
  misc_feature 1..28: note = Synthetic Construct
  source 1..28: mol_type = other DNA
ccctctagaaacctgtcttcatgggtta

SEQ ID NO: 4735 - DNA, 22 bp, synthetic construct
  misc_feature 1..22: note = Synthetic Construct
  source 1..22: mol_type = other DNA
gggtccaatggcatttcagtga

SEQ ID NO: 4736 - DNA, 26 bp, synthetic construct
  misc_feature 1..26: note = Synthetic Construct
  source 1..26: mol_type = other DNA
cctcagggactaagttctccatttcc

SEQ ID NO: 4737 - DNA, 22 bp, synthetic construct
  misc_feature 1..22: note = Synthetic Construct
  source 1..22: mol_type = other DNA
gtgggaaggaaatgggacagat

SEQ ID NO: 4738 - DNA, 23 bp, synthetic construct
  misc_feature 1..23: note = Synthetic Construct
  source 1..23: mol_type = other DNA
ctctgttctgccttgctgaaagt

SEQ ID NO: 4739 - DNA, 22 bp, synthetic construct
  misc_feature 1..22: note = Synthetic Construct
  source 1..22: mol_type = other DNA
tggggtcacttggaagattgga

SEQ ID NO: 4740 - DNA, 24 bp, synthetic construct
  misc_feature 1..24: note = Synthetic Construct
  source 1..24: mol_type = other DNA
tgtagccatttcccctatctaggt

SEQ ID NO: 4741 - DNA, 25 bp, synthetic construct
  misc_feature 1..25: note = Synthetic Construct
  source 1..25: mol_type = other DNA
cttcaggcttggactagaagtacac

SEQ ID NO: 4742 - DNA, 24 bp, synthetic construct
  misc_feature 1..24: note = Synthetic Construct
  source 1..24: mol_type = other DNA
ccagatcttcattgcgcctctgat

SEQ ID NO: 4743 - DNA, 26 bp, synthetic construct
  misc_feature 1..26: note = Synthetic Construct
  source 1..26: mol_type = other DNA
ccaaccagctatgctaccatttctac

SEQ ID NO: 4744 - DNA, 26 bp, synthetic construct
  misc_feature 1..26: note = Synthetic Construct
  source 1..26: mol_type = other DNA
gagagatggttcctatctctgaagct

SEQ ID NO: 4745 - DNA, 25 bp, synthetic construct
  misc_feature 1..25: note = Synthetic Construct
  source 1..25: mol_type = other DNA
ctgttgattggtgtgaatggtagga

SEQ ID NO: 4746 - DNA, 23 bp, synthetic construct
  misc_feature 1..23: note = Synthetic Construct
  source 1..23: mol_type = other DNA
cacaatacctgaggcacctagtg

SEQ ID NO: 4747 - DNA, 19 bp, synthetic construct
  misc_feature 1..19: note = Synthetic Construct
  source 1..19: mol_type = other DNA
gctgagccactgcctcaca

SEQ ID NO: 4748 - DNA, 20 bp, synthetic construct
  misc_feature 1..20: note = Synthetic Construct
  source 1..20: mol_type = other DNA
aggccatcgttgaagccaat

SEQ ID NO: 4749 - DNA, 26 bp, synthetic construct
  misc_feature 1..26: note = Synthetic Construct
  source 1..26: mol_type = other DNA
tggaaaacccttcattcaaagtctga

SEQ ID NO: 4750 - DNA, 20 bp, synthetic construct
  misc_feature 1..20: note = Synthetic Construct
  source 1..20: mol_type = other DNA
cacccgagctgttgtttgga

SEQ ID NO: 4751 - DNA, 20 bp, synthetic construct
  misc_feature 1..20: note = Synthetic Construct
  source 1..20: mol_type = other DNA
gtgtctgctcagcacatggt

SEQ ID NO: 4752 - DNA, 21 bp, synthetic construct
  misc_feature 1..21: note = Synthetic Construct
  source 1..21: mol_type = other DNA
tctctctgggcctcagaccat

SEQ ID NO: 4753 - DNA, 22 bp, synthetic construct
  misc_feature 1..22: note = Synthetic Construct
  source 1..22: mol_type = other DNA
acagcccaccacagagattcat

SEQ ID NO: 4754 - DNA, 19 bp, synthetic construct
  misc_feature 1..19: note = Synthetic Construct
  source 1..19: mol_type = other DNA
accgcactgcactgtggtt

SEQ ID NO: 4755 - DNA, 24 bp, synthetic construct
  misc_feature 1..24: note = Synthetic Construct
  source 1..24: mol_type = other DNA
gtgaacagtgtctagggttttggt

SEQ ID NO: 4756 - DNA, 21 bp, synthetic construct
  misc_feature 1..21: note = Synthetic Construct
  source 1..21: mol_type = other DNA
cgctcctctctcaccacctaa

SEQ ID NO: 4757 - DNA, 19 bp, synthetic construct
  misc_feature 1..19: note = Synthetic Construct
  source 1..19: mol_type = other DNA
agcaagcaagcagcacact

SEQ ID NO: 4758 - DNA, 18 bp, synthetic construct
  misc_feature 1..18: note = Synthetic Construct
  source 1..18: mol_type = other DNA
aggtgcagccccaagtga

SEQ ID NO: 4759 - DNA, 23 bp, synthetic construct
  misc_feature 1..23: note = Synthetic Construct
  source 1..23: mol_type = other DNA
gtcttctcttctcaccccctact

SEQ ID NO: 4760 - DNA, 21 bp, synthetic construct
  misc_feature 1..21: note = Synthetic Construct
  source 1..21: mol_type = other DNA
tgcttctccgtcacagctaag

SEQ ID NO: 4761 - DNA, 25 bp, synthetic construct
  misc_feature 1..25: note = Synthetic Construct
  source 1..25: mol_type = other DNA
gctggccctttaaatatcccagaga

SEQ ID NO: 4762 - DNA, 22 bp, synthetic construct
  misc_feature 1..22: note = Synthetic Construct
  source 1..22: mol_type = other DNA
tccagcagctagtaaggaagca

SEQ ID NO: 4763 - DNA, 21 bp, synthetic construct
  misc_feature 1..21: note = Synthetic Construct
  source 1..21: mol_type = other DNA
tccccatgcacacaccctcta

SEQ ID NO: 4764 - DNA, 24 bp, synthetic construct
  misc_feature 1..24: note = Synthetic Construct
  source 1..24: mol_type = other DNA
ttacattgacagcagggaacagat

SEQ ID NO: 4765 - DNA, 23 bp, synthetic construct
  misc_feature 1..23: note = Synthetic Construct
  source 1..23: mol_type = other DNA
ccgaatggcgtcattgatgattt

SEQ ID NO: 4766 - DNA, 25 bp, synthetic construct
  misc_feature 1..25: note = Synthetic Construct
  source 1..25: mol_type = other DNA
aaacctgaagagtacgtttggtttc

SEQ ID NO: 4767 - DNA, 20 bp, synthetic construct
  misc_feature 1..20: note = Synthetic Construct
  source 1..20: mol_type = other DNA
gagccccagtctcctcttct

SEQ ID NO: 4768 - DNA, 25 bp, synthetic construct
  misc_feature 1..25: note = Synthetic Construct
  source 1..25: mol_type = other DNA
gaggcactatcttgctaggatgtag

SEQ ID NO: 4769 - DNA, 26 bp, synthetic construct
  misc_feature 1..26: note = Synthetic Construct
  source 1..26: mol_type = other DNA
aggttgattagtctctgtagtttgca

SEQ ID NO: 4770 - DNA, 26 bp, synthetic construct
  misc_feature 1..26: note = Synthetic Construct
  source 1..26: mol_type = other DNA
gcttccattataggcttagcatctct

SEQ ID NO: 4771 - DNA, 27 bp, synthetic construct
  misc_feature 1..27: note = Synthetic Construct
  source 1..27: mol_type = other DNA
gggagagaatgatcatcacttcttctc

SEQ ID NO: 4772 - DNA, 22 bp, synthetic construct
  misc_feature 1..22: note = Synthetic Construct
  source 1..22: mol_type = other DNA
ctgtcactgacagtgctttcct

SEQ ID NO: 4773 - DNA, 22 bp, synthetic construct
  misc_feature 1..22: note = Synthetic Construct
  source 1..22: mol_type = other DNA
tccatgataggggtgcattgca

SEQ ID NO: 4774 - DNA, 24 bp, synthetic construct
  misc_feature 1..24: note = Synthetic Construct
  source 1..24: mol_type = other DNA
gagttctgagaaatagggcttgct

SEQ ID NO: 4775 - DNA, 20 bp, synthetic construct
  misc_feature 1..20: note = Synthetic Construct
  source 1..20: mol_type = other DNA
tgattgtgccagctgactgt

SEQ ID NO: 4776 - DNA, 22 bp, synthetic construct
  misc_feature 1..22: note = Synthetic Construct
  source 1..22: mol_type = other DNA
tgtgtcttctgtcccagagtca

SEQ ID NO: 4777 - DNA, 30 bp, synthetic construct
  misc_feature 1..30: note = Synthetic Construct
  source 1..30: mol_type = other DNA
ggagagtagggatttttaccttttgcattc

SEQ ID NO: 4778 - DNA, 28 bp, synthetic construct
  misc_feature 1..28: note = Synthetic Construct
  source 1..28: mol_type = other DNA
gtcattgacatggccacagagattaata

SEQ ID NO: 4779 - DNA, 23 bp, synthetic construct
  misc_feature 1..23: note = Synthetic Construct
  source 1..23: mol_type = other DNA
gatattgccaaacgtccctcagt

SEQ ID NO: 4780 - DNA, 22 bp, synthetic construct
  misc_feature 1..22: note = Synthetic Construct
  source 1..22: mol_type = other DNA
cagtgaatccaatgggccattg

SEQ ID NO: 4781 - DNA, 23 bp, synthetic construct
  misc_feature 1..23: note = Synthetic Construct
  source 1..23: mol_type = other DNA
tgtctctgattgcctaggatggt

SEQ ID NO: 4782 - DNA, 26 bp, synthetic construct
  misc_feature 1..26: note = Synthetic Construct
  source 1..26: mol_type = other DNA
aggagttaaataacttgcctgagcta

SEQ ID NO: 4783 - DNA, 23 bp, synthetic construct
  misc_feature 1..23: note = Synthetic Construct
  source 1..23: mol_type = other DNA
tgctccaaccccacagtaaagtc

SEQ ID NO: 4784 - DNA, 22 bp, synthetic construct
  misc_feature 1..22: note = Synthetic Construct
  source 1..22: mol_type = other DNA
gcagacaaggatccagttgcaa

SEQ ID NO: 4785 - DNA, 26 bp, synthetic construct
  misc_feature 1..26: note = Synthetic Construct
  source 1..26: mol_type = other DNA
cgtgaacttcatcaacaccgaagtct

SEQ ID NO: 4786 - DNA, 22 bp, synthetic construct
  misc_feature 1..22: note = Synthetic Construct
  source 1..22: mol_type = other DNA
ttcagatccctctgctggtaca

SEQ ID NO: 4787 - DNA, 20 bp, synthetic construct
  misc_feature 1..20: note = Synthetic Construct
  source 1..20: mol_type = other DNA
ccagcaacagaaccgtctct

SEQ ID NO: 4788 - DNA, 19 bp, synthetic construct
  misc_feature 1..19: note = Synthetic Construct
  source 1..19: mol_type = other DNA
aggagcccgtgcatttgct

SEQ ID NO: 4789 - DNA, 28 bp, synthetic construct
  misc_feature 1..28: note = Synthetic Construct
  source 1..28: mol_type = other DNA
ggagataaccagaagtaaccatgaagct

SEQ ID NO: 4790 - DNA, 24 bp, synthetic construct
  misc_feature 1..24: note = Synthetic Construct
  source 1..24: mol_type = other DNA
gacaatcagatggacctggtcttg

SEQ ID NO: 4791 - DNA, 22 bp, synthetic construct
  misc_feature 1..22: note = Synthetic Construct
  source 1..22: mol_type = other DNA
tgctgctcaagtgtttccttct

SEQ ID NO: 4792 - DNA, 23 bp, synthetic construct
  misc_feature 1..23: note = Synthetic Construct
  source 1..23: mol_type = other DNA
gctactctgcaatgtgccaacta

SEQ ID NO: 4793 - DNA, 25 bp, synthetic construct
  misc_feature 1..25: note = Synthetic Construct
  source 1..25: mol_type = other DNA
agaacatttgttacaggcagaagtg

SEQ ID NO: 4794 - DNA, 22 bp, synthetic construct
  misc_feature 1..22: note = Synthetic Construct
  source 1..22: mol_type = other DNA
tccacaatgggtgttgcatgtg

SEQ ID NO: 4795 - DNA, 20 bp, synthetic construct
  misc_feature 1..20: note = Synthetic Construct
  source 1..20: mol_type = other DNA
gcatcctgggctccgaatgt

SEQ ID NO: 4796 - DNA, 27 bp, synthetic construct
  misc_feature 1..27: note = Synthetic Construct
  source 1..27: mol_type = other DNA
tgggattttggctttctatcctttttg

SEQ ID NO: 4797 - DNA, 24 bp, synthetic construct
  misc_feature 1..24: note = Synthetic Construct
  source 1..24: mol_type = other DNA
tctcagccaacattgagaggaaat

SEQ ID NO: 4798 - DNA, 22 bp, synthetic construct
  misc_feature 1..22: note = Synthetic Construct
  source 1..22: mol_type = other DNA
tcgagtaacttgccaagggttt

SEQ ID NO: 4799 - DNA, 22 bp, synthetic construct
  misc_feature 1..22: note = Synthetic Construct
  source 1..22: mol_type = other DNA
cacatccctcacaacctgttct

SEQ ID NO: 4800 - DNA, 22 bp, synthetic construct
  misc_feature 1..22: note = Synthetic Construct
  source 1..22: mol_type = other DNA
tccaacagcaggtaggcaaatg

SEQ ID NO: 4801 - DNA, 21 bp, synthetic construct
  misc_feature 1..21: note = Synthetic Construct
  source 1..21: mol_type = other DNA
ctgccaggttctcaggcattt

SEQ ID NO: 4802 - DNA, 22 bp, synthetic construct
  misc_feature 1..22: note = Synthetic Construct
  source 1..22: mol_type = other DNA
tcaggcaggaactcttgctgta

SEQ ID NO: 4803 - DNA, 21 bp, synthetic construct
  misc_feature 1..21: note = Synthetic Construct
  source 1..21: mol_type = other DNA
gatgaacccccaccctattgc

SEQ ID NO: 4804 - DNA, 29 bp, synthetic construct
  misc_feature 1..29: note = Synthetic Construct
  source 1..29: mol_type = other DNA
gtcctggatataatttcaagactttgctt

SEQ ID NO: 4805 - DNA, 21 bp, synthetic construct
  misc_feature 1..21: note = Synthetic Construct
  source 1..21: mol_type = other DNA
tcccacatcctgtcccattcc

SEQ ID NO: 4806 - DNA, 22 bp, synthetic construct
  misc_feature 1..22: note = Synthetic Construct
  source 1..22: mol_type = other DNA
agggtgtgaaagaggaattgca

SEQ ID NO: 4807 - DNA, 24 bp, synthetic construct
  misc_feature 1..24: note = Synthetic Construct
  source 1..24: mol_type = other DNA
ggccttatgtatagggaggaatgg

SEQ ID NO: 4808 - DNA, 23 bp, synthetic construct
  misc_feature 1..23: note = Synthetic Construct
  source 1..23: mol_type = other DNA
aggcagagtctctctaccctttt

SEQ ID NO: 4809 - DNA, 21 bp, synthetic construct
  misc_feature 1..21: note = Synthetic Construct
  source 1..21: mol_type = other DNA
tcaggaccctgggtactctct

SEQ ID NO: 4810 - DNA, 26 bp, synthetic construct
  misc_feature 1..26: note = Synthetic Construct
  source 1..26: mol_type = other DNA
ccatcttaggtaccacagaaccttct

SEQ ID NO: 4811 - DNA, 22 bp, synthetic construct
  misc_feature 1..22: note = Synthetic Construct
  source 1..22: mol_type = other DNA
gaagattcagcgccaagactca

SEQ ID NO: 4812 - DNA, 21 bp, synthetic construct
  misc_feature 1..21: note = Synthetic Construct
  source 1..21: mol_type = other DNA
cgggcaaagcagaaggattcg

SEQ ID NO: 4813 - DNA, 27 bp, synthetic construct
  misc_feature 1..27: note = Synthetic Construct
  source 1..27: mol_type = other DNA
tctacagatggaagtattctggacaag

SEQ ID NO: 4814 - DNA, 20 bp, synthetic construct
  misc_feature 1..20: note = Synthetic Construct
  source 1..20: mol_type = other DNA
aaagctgggtggtgacgttt

SEQ ID NO: 4815 - DNA, 23 bp, synthetic construct
  misc_feature 1..23: note = Synthetic Construct
  source 1..23: mol_type = other DNA
tgtaggcaaaaagctcaccctaa

SEQ ID NO: 4816 - DNA, 19 bp, synthetic construct
  misc_feature 1..19: note = Synthetic Construct
  source 1..19: mol_type = other DNA
agcaccaccaccacgcaat

SEQ ID NO: 4817 - DNA, 21 bp, synthetic construct
  misc_feature 1..21: note = Synthetic Construct
  source 1..21: mol_type = other DNA
atggggaagacagaggctcat

SEQ ID NO: 4818 - DNA, 24 bp, synthetic construct
  misc_feature 1..24: note = Synthetic Construct
  source 1..24: mol_type = other DNA
tccctacctatacaccccaaaagg

SEQ ID NO: 4819 - DNA, 26 bp, synthetic construct
  misc_feature 1..26: note = Synthetic Construct
  source 1..26: mol_type = other DNA
caaagatctttcatcatggccttcaa

SEQ ID NO: 4820 - DNA, 27 bp, synthetic construct
  misc_feature 1..27: note = Synthetic Construct
  source 1..27: mol_type = other DNA
cccagagtacctatatattggccaatg

SEQ ID NO: 4821 - DNA, 19 bp, synthetic construct
  misc_feature 1..19: note = Synthetic Construct
  source 1..19: mol_type = other DNA
agcacttccctggcaagca

SEQ ID NO: 4822 - DNA, 21 bp, synthetic construct
  misc_feature 1..21: note = Synthetic Construct
  source 1..21: mol_type = other DNA
cacctgaggtggagtctagca

SEQ ID NO: 4823 - DNA, 22 bp, synthetic construct
  misc_feature 1..22: note = Synthetic Construct
  source 1..22: mol_type = other DNA
ttctccagcatcacgtctctgt

SEQ ID NO: 4824 - DNA, 20 bp, synthetic construct
  misc_feature 1..20: note = Synthetic Construct
  source 1..20: mol_type = other DNA
tgaccacaccccatcaggtt

SEQ ID NO: 4825 - DNA, 22 bp, synthetic construct
  misc_feature 1..22: note = Synthetic Construct
  source 1..22: mol_type = other DNA
tctgcacttctacccaggcaat

SEQ ID NO: 4826 - DNA, 20 bp, synthetic construct
  misc_feature 1..20: note = Synthetic Construct
  source 1..20: mol_type = other DNA
agcagagcctgaagcaatgg

SEQ ID NO: 4827 - DNA, 24 bp, synthetic construct
  misc_feature 1..24: note = Synthetic Construct
  source 1..24: mol_type = other DNA
gtgcttttaccttcccactatgga

SEQ ID NO: 4828 - DNA, 24 bp, synthetic construct
  misc_feature 1..24: note = Synthetic Construct
  source 1..24: mol_type = other DNA
gtgcaggagggttgtagacaagat

SEQ ID NO: 4829 - DNA, 27 bp, synthetic construct
  misc_feature 1..27: note = Synthetic Construct
  source 1..27: mol_type = other DNA
gggcagtgtacaggcaaataaatcatc

SEQ ID NO: 4830 - DNA, 27 bp, synthetic construct
  misc_feature 1..27: note = Synthetic Construct
  source 1..27: mol_type = other DNA
ttcattgtcaatcctggatctaagtgt

SEQ ID NO: 4831 - DNA, 19 bp, synthetic construct
  misc_feature 1..19: note = Synthetic Construct
  source 1..19: mol_type = other DNA
gaggctcctccctgacaca

SEQ ID NO: 4832 - DNA, 27 bp, synthetic construct
  misc_feature 1..27: note = Synthetic Construct
  source 1..27: mol_type = other DNA
gtaaatccaccagttacaattcccaat

SEQ ID NO: 4833 - DNA, 25 bp, synthetic construct
  misc_feature 1..25: note = Synthetic Construct
  source 1..25: mol_type = other DNA
agataaaatcctccccactgagtct

SEQ ID NO: 4834 - DNA, 20 bp, synthetic construct
  misc_feature 1..20: note = Synthetic Construct
  source 1..20: mol_type = other DNA
agtgtgctgagccttgtgtt

SEQ ID NO: 4835 - DNA, 29 bp, synthetic construct
  misc_feature 1..29: note = Synthetic Construct
  source 1..29: mol_type = other DNA
agggcatatttaggaggttatctattcct

SEQ ID NO: 4836 - DNA, 19 bp, synthetic construct
  misc_feature 1..19: note = Synthetic Construct
  source 1..19: mol_type = other DNA
aagggcctggagggtttgg

SEQ ID NO: 4837 - DNA, 24 bp, synthetic construct
  misc_feature 1..24: note = Synthetic Construct
  source 1..24: mol_type = other DNA
gattcaagtagacagacccaagct

SEQ ID NO: 4838 - DNA, 25 bp, synthetic construct
  misc_feature 1..25: note = Synthetic Construct
  source 1..25: mol_type = other DNA
ctgtgcagtttgtcctcctcatata

SEQ ID NO: 4839 - DNA, 22 bp, synthetic construct
  misc_feature 1..22: note = Synthetic Construct
  source 1..22: mol_type = other DNA
aggaagaacagaggctgcatct

SEQ ID NO: 4840 - DNA, 25 bp, synthetic construct
  misc_feature 1..25: note = Synthetic Construct
  source 1..25: mol_type = other DNA
gatatccaaggcctgaggatttcaa

SEQ ID NO: 4841 - DNA, 25 bp, synthetic construct
  misc_feature 1..25: note = Synthetic Construct
  source 1..25: mol_type = other DNA
tgtgttctgtatgcattttgtgtgt

SEQ ID NO: 4842 - DNA, 24 bp, synthetic construct
  misc_feature 1..24: note = Synthetic Construct
  source 1..24: mol_type = other DNA
ttggatccttctttccctcagttc

SEQ ID NO: 4843 - DNA, 27 bp, synthetic construct
  misc_feature 1..27: note = Synthetic Construct
  source 1..27: mol_type = other DNA
cttgtaatgtcaccattttgtgaggat

SEQ ID NO: 4844 - DNA, 25 bp, synthetic construct
  misc_feature 1..25: note = Synthetic Construct
  source 1..25: mol_type = other DNA
tctagtgacccaaaaacagcctaat

SEQ ID NO: 4845 - DNA, 24 bp, synthetic construct
  misc_feature 1..24: note = Synthetic Construct
  source 1..24: mol_type = other DNA
ggtctgctgttttgcatgtttgct

SEQ ID NO: 4846 - DNA, 26 bp, synthetic construct
  misc_feature 1..26: note = Synthetic Construct
  source 1..26: mol_type = other DNA
gacactgggtattaatggaggatctg

SEQ ID NO: 4847 - DNA, 28 bp, synthetic construct
  misc_feature 1..28: note = Synthetic Construct
  source 1..28: mol_type = other DNA
ggagacaaacctgactagagttgagttg

SEQ ID NO: 4848 - DNA, 25 bp, synthetic construct
  misc_feature 1..25: note = Synthetic Construct
  source 1..25: mol_type = other DNA
ccaagtgtgcttgtagctcattgag

SEQ ID NO: 4849 - DNA, 24 bp, synthetic construct
  misc_feature 1..24: note = Synthetic Construct
  source 1..24: mol_type = other DNA
gtcgtattaggtgactgacactgt

SEQ ID NO: 4850 - DNA, 23 bp, synthetic construct
  misc_feature 1..23: note = Synthetic Construct
  source 1..23: mol_type = other DNA
gcatgactaagcatgtgtttgca

SEQ ID NO: 4851 - DNA, 26 bp, synthetic construct
  misc_feature 1..26: note = Synthetic Construct
  source 1..26: mol_type = other DNA
ccaaaccattggcctgtaaactttgt

SEQ ID NO: 4852 - DNA, 21 bp, synthetic construct
  misc_feature 1..21: note = Synthetic Construct
  source 1..21: mol_type = other DNA
gacaatgggactgccatttgc

SEQ ID NO: 4853 - DNA, 25 bp, synthetic construct
  misc_feature 1..25: note = Synthetic Construct
  source 1..25: mol_type = other DNA
gactaccttcaacatcatgggatca

SEQ ID NO: 4854 - DNA, 24 bp, synthetic construct
  misc_feature 1..24: note = Synthetic Construct
  source 1..24: mol_type = other DNA
gggggtgtaatcacagctctgaat

SEQ ID NO: 4855 - DNA, 24 bp, synthetic construct
  misc_feature 1..24: note = Synthetic Construct
  source 1..24: mol_type = other DNA
tctgagacatctttcctcgtttgg

SEQ ID NO: 4856 - DNA, 19 bp, synthetic construct
  misc_feature 1..19: note = Synthetic Construct
  source 1..19: mol_type = other DNA
gggtgaacctggggacaca

SEQ ID NO: 4857 - DNA, 23 bp, synthetic construct
  misc_feature 1..23: note = Synthetic Construct
  source 1..23: mol_type = other DNA
tccctagctctgagggtgaatgt

SEQ ID NO: 4858 - DNA, 19 bp, synthetic construct
  misc_feature 1..19: note = Synthetic Construct
  source 1..19: mol_type = other DNA
cgtggctgctccaggttaa

SEQ ID NO: 4859 - DNA, 24 bp, synthetic construct
  misc_feature 1..24: note = Synthetic Construct
  source 1..24: mol_type = other DNA
cctaccagagtcctgtgtcttcag

SEQ ID NO: 4860 - DNA, 25 bp, synthetic construct
  misc_feature 1..25: note = Synthetic Construct
  source 1..25: mol_type = other DNA
tgtggactttgctgagcataactag

SEQ ID NO: 4861 - DNA, 23 bp, synthetic construct
  misc_feature 1..23: note = Synthetic Construct
  source 1..23: mol_type = other DNA
agtgggtggatagtcaaggaaga

SEQ ID NO: 4862 - DNA, 24 bp, synthetic construct
  misc_feature 1..24: note = Synthetic Construct
  source 1..24: mol_type = other DNA
gggaaactgagagagaagctgagt

SEQ ID NO: 4863 - DNA, 20 bp, synthetic construct
  misc_feature 1..20: note = Synthetic Construct
  source 1..20: mol_type = other DNA
gttgtgggctacgcttgtca

SEQ ID NO: 4864 - DNA, 22 bp, synthetic construct
  misc_feature 1..22: note = Synthetic Construct
  source 1..22: mol_type = other DNA
gctcacaggtacacgaaaatgg

SEQ ID NO: 4865 - DNA, 23 bp, synthetic construct
  misc_feature 1..23: note = Synthetic Construct
  source 1..23: mol_type = other DNA
agaggaggagagaacaggacagt

SEQ ID NO: 4866 - DNA, 22 bp, synthetic construct
  misc_feature 1..22: note = Synthetic Construct
  source 1..22: mol_type = other DNA
aaatgcccctcttgcctatgca

SEQ ID NO: 4867 - DNA, 22 bp, synthetic construct
  misc_feature 1..22: note = Synthetic Construct
  source 1..22: mol_type = other DNA
tgctctgggctgtcgctaaatt

SEQ ID NO: 4868 - DNA, 26 bp, synthetic construct
  misc_feature 1..26: note = Synthetic Construct
  source 1..26: mol_type = other DNA
gcagtcctgtcatccctctgttaatg

SEQ ID NO: 4869 - DNA, 20 bp, synthetic construct
  misc_feature 1..20: note = Synthetic Construct
  source 1..20: mol_type = other DNA
aaacccacccaagccaacct

SEQ ID NO: 4870 - DNA, 24 bp, synthetic construct
  misc_feature 1..24: note = Synthetic Construct
  source 1..24: mol_type = other DNA
ggtgtgaatggcagcctctaaatg

SEQ ID NO: 4871 - DNA, 20 bp, synthetic construct
  misc_feature 1..20: note = Synthetic Construct
  source 1..20: mol_type = other DNA
ttggagggtggccttttgct

SEQ ID NO: 4872 - DNA, 22 bp, synthetic construct
  misc_feature 1..22: note = Synthetic Construct
  source 1..22: mol_type = other DNA
ccggcatttctgaacactgtgt

SEQ ID NO: 4873 - DNA, 27 bp, synthetic construct
  misc_feature 1..27: note = Synthetic Construct
  source 1..27: mol_type = other DNA
ctgagccagtagaaatttagacctcat

SEQ ID NO: 4874 - DNA, 22 bp, synthetic construct
  misc_feature 1..22: note = Synthetic Construct
  source 1..22: mol_type = other DNA
tggtgaacttctccagcagttg

SEQ ID NO: 4875 - DNA, 19 bp, synthetic construct
  misc_feature 1..19: note = Synthetic Construct
  source 1..19: mol_type = other DNA
tgtgtccgggcagagactt

SEQ ID NO: 4876 - DNA, 28 bp, synthetic construct
  misc_feature 1..28: note = Synthetic Construct
  source 1..28: mol_type = other DNA
gagatgatagtaacataggggcatttgt

SEQ ID NO: 4877 - DNA, 24 bp, synthetic construct
  misc_feature 1..24: note = Synthetic Construct
  source 1..24: mol_type = other DNA
ctccagaccccactttgattagtc

SEQ ID NO: 4878 - DNA, 20 bp, synthetic construct
  misc_feature 1..20: note = Synthetic Construct
  source 1..20: mol_type = other DNA
atcttggtggtggcccttct

SEQ ID NO: 4879 - DNA, 24 bp, synthetic construct
  misc_feature 1..24: note = Synthetic Construct
  source 1..24: mol_type = other DNA
ccttgctggaaccacgaattaaca

SEQ ID NO: 4880 - DNA, 26 bp, synthetic construct
  misc_feature 1..26: note = Synthetic Construct
  source 1..26: mol_type = other DNA
cacacagctcaaattattggcagaga

SEQ ID NO: 4881 - DNA, 27 bp, synthetic construct
  misc_feature 1..27: note = Synthetic Construct
  source 1..27: mol_type = other DNA
aggaattcaggtgaatatgttccaaca

SEQ ID NO: 4882 - DNA, 26 bp, synthetic construct
  misc_feature 1..26: note = Synthetic Construct
  source 1..26: mol_type = other DNA
agttgaaaagaatctcaggtctggtt

SEQ ID NO: 4883 - DNA, 24 bp, synthetic construct
  misc_feature 1..24: note = Synthetic Construct
  source 1..24: mol_type = other DNA
agtctccctctagccaagtattcc

SEQ ID NO: 4884 - DNA, 23 bp, synthetic construct
  misc_feature 1..23: note = Synthetic Construct
  source 1..23: mol_type = other DNA
ccagtgtgagggttccttttctt

SEQ ID NO: 4885 - DNA, 27 bp, synthetic construct
  misc_feature 1..27: note = Synthetic Construct
  source 1..27: mol_type = other DNA
gactcatcagtaaatgcagtcaactga

SEQ ID NO: 4886 - DNA, 26 bp, synthetic construct
  misc_feature 1..26: note = Synthetic Construct
  source 1..26: mol_type = other DNA
gtctcactttttatgccgtggtttaa

SEQ ID NO: 4887 - DNA, 22 bp, synthetic construct
  misc_feature 1..22: note = Synthetic Construct
  source 1..22: mol_type = other DNA
ccatctcactgcggagaagttt

SEQ ID NO: 4888 - DNA, 21 bp, synthetic construct
  misc_feature 1..21: note = Synthetic Construct
  source 1..21: mol_type = other DNA
tctgctaggaagggctgagtt

SEQ ID NO: 4889 - DNA, 23 bp, synthetic construct
  misc_feature 1..23: note = Synthetic Construct
  source 1..23: mol_type = other DNA
tgacccagaagagtttggagttg

SEQ ID NO: 4890 - DNA, 22 bp, synthetic construct
  misc_feature 1..22: note = Synthetic Construct
  source 1..22: mol_type = other DNA
caacttgggcatcacagagcaa

SEQ ID NO: 4891 - DNA, 24 bp, synthetic construct
  misc_feature 1..24: note = Synthetic Construct
  source 1..24: mol_type = other DNA
cttggggaaatacagggtcattct

SEQ ID NO: 4892 - DNA, 24 bp, synthetic construct
  misc_feature 1..24: note = Synthetic Construct
  source 1..24: mol_type = other DNA
ctcttatgcccttggccatactct

SEQ ID NO: 4893 - DNA, 25 bp, synthetic construct
  misc_feature 1..25: note = Synthetic Construct
  source 1..25: mol_type = other DNA
ccatcctggtgactgtttcctttca

SEQ ID NO: 4894 - DNA, 24 bp, synthetic construct
  misc_feature 1..24: note = Synthetic Construct
  source 1..24: mol_type = other DNA
tgcttctttccttcctagctacca

SEQ ID NO: 4895 - DNA, 25 bp, synthetic construct
  misc_feature 1..25: note = Synthetic Construct
  source 1..25: mol_type = other DNA
aaaaagagagagaggaaagcattgc

SEQ ID NO: 4896 - DNA, 21 bp, synthetic construct
  misc_feature 1..21: note = Synthetic Construct
  source 1..21: mol_type = other DNA
cttggtctttgcgctgagaga

SEQ ID NO: 4897 - DNA, 28 bp, synthetic construct
  misc_feature 1..28: note = Synthetic Construct
  source 1..28: mol_type = other DNA
ggaccataaaccgtttatgaatccctaa

SEQ ID NO: 4898 - DNA, 22 bp, synthetic construct
  misc_feature 1..22: note = Synthetic Construct
  source 1..22: mol_type = other DNA
tggtggtttgctgtgtgtttac

SEQ ID NO: 4899 - DNA, 21 bp, synthetic construct
  misc_feature 1..21: note = Synthetic Construct
  source 1..21: mol_type = other DNA
agaagctaccctgagcacaga

SEQ ID NO: 4900 - DNA, 23 bp, synthetic construct
  misc_feature 1..23: note = Synthetic Construct
  source 1..23: mol_type = other DNA
tctgttttgaggaatggctgaca

SEQ ID NO: 4901 - DNA, 24 bp, synthetic construct
  misc_feature 1..24: note = Synthetic Construct
  source 1..24: mol_type = other DNA
ggtctctcaggtgtgttcagtaga

SEQ ID NO: 4902 - DNA, 20 bp, synthetic construct
  misc_feature 1..20: note = Synthetic Construct
  source 1..20: mol_type = other DNA
agtgcagcttttcccatggt

SEQ ID NO: 4903 - DNA, 21 bp, synthetic construct
  misc_feature 1..21: note = Synthetic Construct
  source 1..21: mol_type = other DNA
atgagtacagggtggggacat

SEQ ID NO: 4904 - DNA, 22 bp, synthetic construct
  misc_feature 1..22: note = Synthetic Construct
  source 1..22: mol_type = other DNA
ggtgaggcccctttatcctttt

SEQ ID NO: 4905 - DNA, 22 bp, synthetic construct
  misc_feature 1..22: note = Synthetic Construct
  source 1..22: mol_type = other DNA
gcctcggaaactgtcagatggt

SEQ ID NO: 4906 - DNA, 30 bp, synthetic construct
  misc_feature 1..30: note = Synthetic Construct
  source 1..30: mol_type = other DNA
gctactatgtaacatttcatatggcaaaga

SEQ ID NO: 4907 - DNA, 28 bp, synthetic construct
  misc_feature 1..28: note = Synthetic Construct
  source 1..28: mol_type = other DNA
tgtctgaatctaagcttttctgcataga

SEQ ID NO: 4908 - DNA, 21 bp, synthetic construct
  misc_feature 1..21: note = Synthetic Construct
  source 1..21: mol_type = other DNA
caaacagctggtgtgctcatc

SEQ ID NO: 4909 - DNA, 19 bp, synthetic construct
  misc_feature 1..19: note = Synthetic Construct
  source 1..19: mol_type = other DNA
gtggcaggtccagggatct

SEQ ID NO: 4910 - DNA, 23 bp, synthetic construct
  misc_feature 1..23: note = Synthetic Construct
  source 1..23: mol_type = other DNA
aggcctcctaacaggtattcaga

SEQ ID NO: 4911 - DNA, 25 bp, synthetic construct
  misc_feature 1..25: note = Synthetic Construct
  source 1..25: mol_type = other DNA
gccaccacaaatacacttagaactc

SEQ ID NO: 4912 - DNA, 25 bp, synthetic construct
  misc_feature 1..25: note = Synthetic Construct
  source 1..25: mol_type = other DNA
cctgctgggtatctgtaacaatgca

SEQ ID NO: 4913 - DNA, 23 bp, synthetic construct
  misc_feature 1..23: note = Synthetic Construct
  source 1..23: mol_type = other DNA
agggattggcttatctcctctga

SEQ ID NO: 4914 - DNA, 23 bp, synthetic construct
  misc_feature 1..23: note = Synthetic Construct
  source 1..23: mol_type = other DNA
acaacaaaatagggcaggtgcta

SEQ ID NO: 4915 - DNA, 29 bp, synthetic construct
  misc_feature 1..29: note = Synthetic Construct
  source 1..29: mol_type = other DNA
tgataactgttgactgttaattccacaga

SEQ ID NO: 4916 - DNA, 22 bp, synthetic construct
  misc_feature 1..22: note = Synthetic Construct
  source 1..22: mol_type = other DNA
aaagcaggcgggagaactagat

SEQ ID NO: 4917 - DNA, 24 bp, synthetic construct
  misc_feature 1..24: note = Synthetic Construct
  source 1..24: mol_type = other DNA
cctcacctgtctttgcaactttgg

SEQ ID NO: 4918 - DNA, 24 bp, synthetic construct
  misc_feature 1..24: note = Synthetic Construct
  source 1..24: mol_type = other DNA
acccctgatgaaggaaagggattg

SEQ ID NO: 4919 - DNA, 24 bp, synthetic construct
  misc_feature 1..24: note = Synthetic Construct
  source 1..24: mol_type = other DNA
cagtgtgctgacagctgtatagca

SEQ ID NO: 4920 - DNA, 20 bp, synthetic construct
  misc_feature 1..20: note = Synthetic Construct
  source 1..20: mol_type = other DNA
tgggtggggctcagtgttga

SEQ ID NO: 4921 - DNA, 24 bp, synthetic construct
  misc_feature 1..24: note = Synthetic Construct
  source 1..24: mol_type = other DNA
gcagctacctgtctgtcctagaat

SEQ ID NO: 4922 - DNA, 22 bp, synthetic construct
  misc_feature 1..22: note = Synthetic Construct
  source 1..22: mol_type = other DNA
agccattcggatcctggatggt

SEQ ID NO: 4923 - DNA, 22 bp, synthetic construct
  misc_feature 1..22: note = Synthetic Construct
  source 1..22: mol_type = other DNA
gccaagttatgcgatgcattcc

SEQ ID NO: 4924 - DNA, 25 bp, synthetic construct
  misc_feature 1..25: note = Synthetic Construct
  source 1..25: mol_type = other DNA
gtttttctcttcctcatgccccata

SEQ ID NO: 4925 - DNA, 20 bp, synthetic construct
  misc_feature 1..20: note = Synthetic Construct
  source 1..20: mol_type = other DNA
ggtgcccctagtgctgagaa

SEQ ID NO: 4926 - DNA, 26 bp, synthetic construct
  misc_feature 1..26: note = Synthetic Construct
  source 1..26: mol_type = other DNA
gagcctgtctagaaacctaagtggat

SEQ ID NO: 4927 - DNA, 25 bp, synthetic construct
  misc_feature 1..25: note = Synthetic Construct
  source 1..25: mol_type = other DNA
ccaataccttgtgtctgtgtgttac

SEQ ID NO: 4928 - DNA, 22 bp, synthetic construct
  misc_feature 1..22: note = Synthetic Construct
  source 1..22: mol_type = other DNA
tctggaactggacacacatgga

SEQ ID NO: 4929 - DNA, 23 bp, synthetic construct
  misc_feature 1..23: note = Synthetic Construct
  source 1..23: mol_type = other DNA
cccatttgtgcttccacatactc

SEQ ID NO: 4930 - DNA, 20 bp, synthetic construct
  misc_feature 1..20: note = Synthetic Construct
  source 1..20: mol_type = other DNA
ctggcaccaggtgttgctaa

SEQ ID NO: 4931 - DNA, 21 bp, synthetic construct
  misc_feature 1..21: note = Synthetic Construct
  source 1..21: mol_type = other DNA
agcccaggtcaccaagagact

SEQ ID NO: 4932 - DNA, 19 bp, synthetic construct
  misc_feature 1..19: note = Synthetic Construct
  source 1..19: mol_type = other DNA
agccccagttgctcacagt

SEQ ID NO: 4933 - DNA, 27 bp, synthetic construct
  misc_feature 1..27: note = Synthetic Construct
  source 1..27: mol_type = other DNA
ggctgtgaggttttagatacacccttt

SEQ ID NO: 4934 - DNA, 26 bp, synthetic construct
  misc_feature 1..26: note = Synthetic Construct
  source 1..26: mol_type = other DNA
ccaaaacagggcacttgaacattttg

SEQ ID NO: 4935 - DNA, 24 bp, synthetic construct
  misc_feature 1..24: note = Synthetic Construct
  source 1..24: mol_type = other DNA
gcaaagtacaggccatgtgaacct

SEQ ID NO: 4936 - DNA, 25 bp, synthetic construct
  misc_feature 1..25: note = Synthetic Construct
  source 1..25: mol_type = other DNA
gcaagaggaatggacagtagagaag

SEQ ID NO: 4937 - DNA, 20 bp, synthetic construct
  misc_feature 1..20: note = Synthetic Construct
  source 1..20: mol_type = other DNA
tgagcagcttgagcacttgt

SEQ ID NO: 4938 - DNA, 23 bp, synthetic construct
  misc_feature 1..23: note = Synthetic Construct
  source 1..23: mol_type = other DNA
ccctctccaaagaaaaggcctat

SEQ ID NO: 4939 - DNA, 22 bp, synthetic construct
  misc_feature 1..22: note = Synthetic Construct
  source 1..22: mol_type = other DNA
gagcggaattcccagacatcat

SEQ ID NO: 4940 - DNA, 23 bp, synthetic construct
  misc_feature 1..23: note = Synthetic Construct
  source 1..23: mol_type = other DNA
ggcattgtgtaggaaaggagaga

SEQ ID NO: 4941 - DNA, 18 bp, synthetic construct
  misc_feature 1..18: note = Synthetic Construct
  source 1..18: mol_type = other DNA
gcgcacagccgtggaaag

SEQ ID NO: 4942 - DNA, 25 bp, synthetic construct
  misc_feature 1..25: note = Synthetic Construct
  source 1..25: mol_type = other DNA
actgttcccagttagaggtgtaaca

SEQ ID NO: 4943 - DNA, 20 bp, synthetic construct
  misc_feature 1..20: note = Synthetic Construct
  source 1..20: mol_type = other DNA
atgggccatcctgacatgct

SEQ ID NO: 4944 - DNA, 26 bp, synthetic construct
  misc_feature 1..26: note = Synthetic Construct
  source 1..26: mol_type = other DNA
gtagctccagaaacctttctcatcta

SEQ ID NO: 4945 - DNA, 24 bp, synthetic construct
  misc_feature 1..24: note = Synthetic Construct
  source 1..24: mol_type = other DNA
tcctgattgtagtcagcacagaga

SEQ ID NO: 4946 - DNA, 26 bp, synthetic construct
  misc_feature 1..26: note = Synthetic Construct
  source 1..26: mol_type = other DNA
aggagaagagaagtacatgggttttc

SEQ ID NO: 4947 - DNA, 26 bp, synthetic construct
  misc_feature 1..26: note = Synthetic Construct
  source 1..26: mol_type = other DNA
cctgatgccttcataaatgtgttgtg

SEQ ID NO: 4948 - DNA, 23 bp, synthetic construct
  misc_feature 1..23: note = Synthetic Construct
  source 1..23: mol_type = other DNA
gaaatttgggtatgccgttgtca

SEQ ID NO: 4949 - DNA, 25 bp, synthetic construct
  misc_feature 1..25: note = Synthetic Construct
  source 1..25: mol_type = other DNA
gtctggaaagatgcatggaagtaag

SEQ ID NO: 4950 - DNA, 24 bp, synthetic construct
  misc_feature 1..24: note = Synthetic Construct
  source 1..24: mol_type = other DNA
ggaaacttagtgcagtagcggatt

SEQ ID NO: 4951 - DNA, 29 bp, synthetic construct
  misc_feature 1..29: note = Synthetic Construct
  source 1..29: mol_type = other DNA
acaaaaatgatatgtgcaaaatccagttg

SEQ ID NO: 4952 - DNA, 24 bp, synthetic construct
  misc_feature 1..24: note = Synthetic Construct
  source 1..24: mol_type = other DNA
acctctttaacccttcctgtagga

SEQ ID NO: 4953 - DNA, 20 bp, synthetic construct
  misc_feature 1..20: note = Synthetic Construct
  source 1..20: mol_type = other DNA
cccaggcaccctctattcca

SEQ ID NO: 4954 - DNA, 22 bp, synthetic construct
  misc_feature 1..22: note = Synthetic Construct
  source 1..22: mol_type = other DNA
tggtgcctgaatgtgagttcct

SEQ ID NO: 4955 - DNA, 25 bp, synthetic construct
  misc_feature 1..25: note = Synthetic Construct
  source 1..25: mol_type = other DNA
tttatggcctacgctctttttgttc

SEQ ID NO: 4956 - DNA, 27 bp, synthetic construct
  misc_feature 1..27: note = Synthetic Construct
  source 1..27: mol_type = other DNA
gcaatgggaatttgaatcaggtccaat

SEQ ID NO: 4957 - DNA, 22 bp, synthetic construct
  misc_feature 1..22: note = Synthetic Construct
  source 1..22: mol_type = other DNA
gcaggcacagtattggctcaaa

SEQ ID NO: 4958 - DNA, 20 bp, synthetic construct
  misc_feature 1..20: note = Synthetic Construct
  source 1..20: mol_type = other DNA
tgttgatgtggggggaagga

SEQ ID NO: 4959 - DNA, 24 bp, synthetic construct
  misc_feature 1..24: note = Synthetic Construct
  source 1..24: mol_type = other DNA
acaccgcctgaggtagtgcaaata

SEQ ID NO: 4960 - DNA, 26 bp, synthetic construct
  misc_feature 1..26: note = Synthetic Construct
  source 1..26: mol_type = other DNA
ctgaagtccagtaaggctctcacctt

SEQ ID NO: 4961 - DNA, 24 bp, synthetic construct
  misc_feature 1..24: note = Synthetic Construct
  source 1..24: mol_type = other DNA
gaccaagatgtgagacctctttgg

SEQ ID NO: 4962 - DNA, 22 bp, synthetic construct
  misc_feature 1..22: note = Synthetic Construct
  source 1..22: mol_type = other DNA
gcccataaacaccctggactca

SEQ ID NO: 4963 - DNA, 24 bp, synthetic construct
  misc_feature 1..24: note = Synthetic Construct
  source 1..24: mol_type = other DNA
gcaagagcttcctggttgatctag

SEQ ID NO: 4964 - DNA, 20 bp, synthetic construct
  misc_feature 1..20: note = Synthetic Construct
  source 1..20: mol_type = other DNA
cactgtgccaaccccttacc

SEQ ID NO: 4965 - DNA, 22 bp, synthetic construct
  misc_feature 1..22: note = Synthetic Construct
  source 1..22: mol_type = other DNA
tgctctgtctctgctccattcc

SEQ ID NO: 4966 - DNA, 24 bp, synthetic construct
  misc_feature 1..24: note = Synthetic Construct
  source 1..24: mol_type = other DNA
ttgtagcctgatgaacttcacaca

SEQ ID NO: 4967 - DNA, 23 bp, synthetic construct
  misc_feature 1..23: note = Synthetic Construct
  source 1..23: mol_type = other DNA
gctgagactttcacagtgttcac

SEQ ID NO: 4968 - DNA, 24 bp, synthetic construct
  misc_feature 1..24: note = Synthetic Construct
  source 1..24: mol_type = other DNA
tctaggcaagctacctgtaacttg

SEQ ID NO: 4969 - DNA, 20 bp, synthetic construct
  misc_feature 1..20: note = Synthetic Construct
  source 1..20: mol_type = other DNA
acagccgtgaactccctaga

SEQ ID NO: 4970 - DNA, 20 bp, synthetic construct
  misc_feature 1..20: note = Synthetic Construct
  source 1..20: mol_type = other DNA
cagggggacagcctgtctta

SEQ ID NO: 4971 - DNA, 24 bp, synthetic construct
  misc_feature 1..24: note = Synthetic Construct
  source 1..24: mol_type = other DNA
gagaattccccaggtgtaggtgtt

SEQ ID NO: 4972 - DNA, 21 bp, synthetic construct
  misc_feature 1..21: note = Synthetic Construct
  source 1..21: mol_type = other DNA
aggagccttcaaagccctgaa

SEQ ID NO: 4973 - DNA, 25 bp, synthetic construct
  misc_feature 1..25: note = Synthetic Construct
  source 1..25: mol_type = other DNA
acagagagaatccacttggtttcaa

SEQ ID NO: 4974 - DNA, 25 bp, synthetic construct
  misc_feature 1..25: note = Synthetic Construct
  source 1..25: mol_type = other DNA
aagcgttagttgctttggttagaag

SEQ ID NO: 4975 - DNA, 20 bp, synthetic construct
  misc_feature 1..20: note = Synthetic Construct
  source 1..20: mol_type = other DNA
gcgttgcttaggccatttgc

SEQ ID NO: 4976 - DNA, 25 bp, synthetic construct
  misc_feature 1..25: note = Synthetic Construct
  source 1..25: mol_type = other DNA
ggacacatgtcattgtgcagagatc

SEQ ID NO: 4977 - DNA, 24 bp, synthetic construct
  misc_feature 1..24: note = Synthetic Construct
  source 1..24: mol_type = other DNA
gtgtcgagaaccggctgtaaatca

SEQ ID NO: 4978 - DNA, 28 bp, synthetic construct
  misc_feature 1..28: note = Synthetic Construct
  source 1..28: mol_type = other DNA
ggggtataccttgtcatatggcataagc

SEQ ID NO: 4979 - DNA, 22 bp, synthetic construct
  misc_feature 1..22: note = Synthetic Construct
  source 1..22: mol_type = other DNA
tgtctactgagccattgcagtt

SEQ ID NO: 4980 - DNA, 26 bp, synthetic construct
  misc_feature 1..26: note = Synthetic Construct
  source 1..26: mol_type = other DNA
ggcagggagcttattcagatctacag

SEQ ID NO: 4981 - DNA, 19 bp, synthetic construct
  misc_feature 1..19: note = Synthetic Construct
  source 1..19: mol_type = other DNA
tgctcacagtgccgtttga

SEQ ID NO: 4982 - DNA, 22 bp, synthetic construct
  misc_feature 1..22: note = Synthetic Construct
  source 1..22: mol_type = other DNA
gcagaacatcaaaggccaatgt

SEQ ID NO: 4983 - DNA, 21 bp, synthetic construct
  misc_feature 1..21: note = Synthetic Construct
  source 1..21: mol_type = other DNA
tcaatgcgctccctggtattt

SEQ ID NO: 4984 - DNA, 25 bp, synthetic construct
  misc_feature 1..25: note = Synthetic Construct
  source 1..25: mol_type = other DNA
gtagtgatttccaagacctcaccat

SEQ ID NO: 4985 - DNA, 22 bp, synthetic construct
  misc_feature 1..22: note = Synthetic Construct
  source 1..22: mol_type = other DNA
aagcagctcaggtgatcttcag

SEQ ID NO: 4986 - DNA, 25 bp, synthetic construct
  misc_feature 1..25: note = Synthetic Construct
  source 1..25: mol_type = other DNA
gccagatagggtacagtgcctttaa

SEQ ID NO: 4987 - DNA, 28 bp, synthetic construct
  misc_feature 1..28: note = Synthetic Construct
  source 1..28: mol_type = other DNA
cagtacttttccagttaggttcgttacc

SEQ ID NO: 4988 - DNA, 25 bp, synthetic construct
  misc_feature 1..25: note = Synthetic Construct
  source 1..25: mol_type = other DNA
cgaccaaagagtcttaggcatatgc

SEQ ID NO: 4989 - DNA, 22 bp, synthetic construct
  misc_feature 1..22: note = Synthetic Construct
  source 1..22: mol_type = other DNA
tcccttctcatgggggattacc

SEQ ID NO: 4990 - DNA, 28 bp, synthetic construct
  misc_feature 1..28: note = Synthetic Construct
  source 1..28: mol_type = other DNA
caactggaaatgatgaaaataggctgat

SEQ ID NO: 4991 - DNA, 23 bp, synthetic construct
  misc_feature 1..23: note = Synthetic Construct
  source 1..23: mol_type = other DNA
agtacagcaggaagtgggatagg

SEQ ID NO: 4992 - DNA, 22 bp, synthetic construct
  misc_feature 1..22: note = Synthetic Construct
  source 1..22: mol_type = other DNA
gggcttttccatgcttctgcta

SEQ ID NO: 4993 - DNA, 25 bp, synthetic construct
  misc_feature 1..25: note = Synthetic Construct
  source 1..25: mol_type = other DNA
gctctgaactgtcattggtggctat

SEQ ID NO: 4994 - DNA, 21 bp, synthetic construct
  misc_feature 1..21: note = Synthetic Construct
  source 1..21: mol_type = other DNA
tggccaaagctctcaggtcat

SEQ ID NO: 4995 - DNA, 22 bp, synthetic construct
  misc_feature 1..22: note = Synthetic Construct
  source 1..22: mol_type = other DNA
cctccagttctgtatgcaacca

SEQ ID NO: 4996 - DNA, 18 bp, synthetic construct
  misc_feature 1..18: note = Synthetic Construct
  source 1..18: mol_type = other DNA
gtgcgtggtgggcttcat

SEQ ID NO: 4997 - DNA, 20 bp, synthetic construct
  misc_feature 1..20: note = Synthetic Construct
  source 1..20: mol_type = other DNA
agcaaggaagggagcatcct

SEQ ID NO: 4998 - DNA, 29 bp, synthetic construct
  misc_feature 1..29: note = Synthetic Construct
  source 1..29: mol_type = other DNA
gaatttgtgttaagcactatcctctactc

SEQ ID NO: 4999 - DNA, 24 bp, synthetic construct
  misc_feature 1..24: note = Synthetic Construct
  source 1..24: mol_type = other DNA
gggaggatgactttggagctatgt

SEQ ID NO: 5000 - DNA, 21 bp, synthetic construct
  misc_feature 1..21: note = Synthetic Construct
  source 1..21: mol_type = other DNA
atgtcagaagggggactgcat

SEQ ID NO: 5001 - DNA, 22 bp, synthetic construct
  misc_feature 1..22: note = Synthetic Construct
  source 1..22: mol_type = other DNA
tgatcaggtgaaggggctaact

SEQ ID NO: 5002 - DNA, 21 bp, synthetic construct
  misc_feature 1..21: note = Synthetic Construct
  source 1..21: mol_type = other DNA
ccatcaggcagtcacaatgct

SEQ ID NO: 5003 - DNA, 22 bp, synthetic construct
  misc_feature 1..22: note = Synthetic Construct
  source 1..22: mol_type = other DNA
tggctccttgtccacagcataa

SEQ ID NO: 5004 - DNA, 29 bp, synthetic construct
  misc_feature 1..29: note = Synthetic Construct
  source 1..29: mol_type = other DNA
ggactaagtagaagtagggtatcctatgt

SEQ ID NO: 5005 - DNA, 21 bp, synthetic construct
  misc_feature 1..21: note = Synthetic Construct
  source 1..21: mol_type = other DNA
aagtgaaagggtggcattcca

SEQ ID NO: 5006 - DNA, 22 bp, synthetic construct
  misc_feature 1..22: note = Synthetic Construct
  source 1..22: mol_type = other DNA
ttatcagcccatggagcaactc

SEQ ID NO: 5007 - DNA, 20 bp, synthetic construct
  misc_feature 1..20: note = Synthetic Construct
  source 1..20: mol_type = other DNA
cgctgatcgccttcatacca

SEQ ID NO: 5008 - DNA, 28 bp, synthetic construct
  misc_feature 1..28: note = Synthetic Construct
  source 1..28: mol_type = other DNA
ccactagtaaagggatttttctcatagc

SEQ ID NO: 5009 - DNA, 24 bp, synthetic construct
  misc_feature 1..24: note = Synthetic Construct
  source 1..24: mol_type = other DNA
gagctcaagttcaaggtgaagctt

SEQ ID NO: 5010 - DNA, 25 bp, synthetic construct
  misc_feature 1..25: note = Synthetic Construct
  source 1..25: mol_type = other DNA
gtctggtctcagtcctgtttaggtt

SEQ ID NO: 5011 - DNA, 22 bp, synthetic construct
  misc_feature 1..22: note = Synthetic Construct
  source 1..22: mol_type = other DNA
aggcagggagaagcagctcatt

SEQ ID NO: 5012 - DNA, 21 bp, synthetic construct
  misc_feature 1..21: note = Synthetic Construct
  source 1..21: mol_type = other DNA
ggtccctgggtgcattttagg

SEQ ID NO: 5013 - DNA, 22 bp, synthetic construct
  misc_feature 1..22: note = Synthetic Construct
  source 1..22: mol_type = other DNA
tcccagggtaagttgccaagga

SEQ ID NO: 5014 - DNA, 20 bp, synthetic construct
  misc_feature 1..20: note = Synthetic Construct
  source 1..20: mol_type = other DNA
ggcatggaggagacgagtgt

SEQ ID NO: 5015 - DNA, 21 bp, synthetic construct
  misc_feature 1..21: note = Synthetic Construct
  source 1..21: mol_type = other DNA
agccatccttgcattgacagt

SEQ ID NO: 5016 - DNA, 23 bp, synthetic construct
  misc_feature 1..23: note = Synthetic Construct
  source 1..23: mol_type = other DNA
cctctcaacgaaggcataatgct

SEQ ID NO: 5017 - DNA, 23 bp, synthetic construct
  misc_feature 1..23: note = Synthetic Construct
  source 1..23: mol_type = other DNA
gcatttgtgcccagctaaatctt

SEQ ID NO: 5018 - DNA, 24 bp, synthetic construct
  misc_feature 1..24: note = Synthetic Construct
  source 1..24: mol_type = other DNA
caaatgcctctatctcagctcaca

SEQ ID NO: 5019 - DNA, 23 bp, synthetic construct
  misc_feature 1..23: note = Synthetic Construct
  source 1..23: mol_type = other DNA
agcagaatggctgagatttcaga

SEQ ID NO: 5020 - DNA, 22 bp, synthetic construct
  misc_feature 1..22: note = Synthetic Construct
  source 1..22: mol_type = other DNA
aacatgggacctgaacaaacca

SEQ ID NO: 5021 - DNA, 27 bp, synthetic construct
  misc_feature 1..27: note = Synthetic Construct
  source 1..27: mol_type = other DNA
gcttccactggagtttgagtttatgag

SEQ ID NO: 5022 - DNA, 23 bp, synthetic construct
  misc_feature 1..23: note = Synthetic Construct
  source 1..23: mol_type = other DNA
gaaaataggcagactcggagcat

SEQ ID NO: 5023 - DNA, 20 bp, synthetic construct
  misc_feature 1..20: note = Synthetic Construct
  source 1..20: mol_type = other DNA
ttcagggccactctgaagga

SEQ ID NO: 5024 - DNA, 24 bp, synthetic construct
  misc_feature 1..24: note = Synthetic Construct
  source 1..24: mol_type = other DNA
caactctctgccttgaacttctgt

SEQ ID NO: 5025 - DNA, 25 bp, synthetic construct
  misc_feature 1..25: note = Synthetic Construct
  source 1..25: mol_type = other DNA
acatgtacactgggtcagaatttgt

SEQ ID NO: 5026 - DNA, 22 bp, synthetic construct
  misc_feature 1..22: note = Synthetic Construct
  source 1..22: mol_type = other DNA
gggaagactgttgtctgaagct

SEQ ID NO: 5027 - DNA, 27 bp, synthetic construct
  misc_feature 1..27: note = Synthetic Construct
  source 1..27: mol_type = other DNA
gctacccattagacctatcagcatgtt

SEQ ID NO: 5028 - DNA, 22 bp, synthetic construct
  misc_feature 1..22: note = Synthetic Construct
  source 1..22: mol_type = other DNA
ttccaggggcctgaacatcttt

SEQ ID NO: 5029 - DNA, 20 bp, synthetic construct
  misc_feature 1..20: note = Synthetic Construct
  source 1..20: mol_type = other DNA
ccaacagccccacagagaga

SEQ ID NO: 5030 - DNA, 25 bp, synthetic construct
  misc_feature 1..25: note = Synthetic Construct
  source 1..25: mol_type = other DNA
gattcacccaactcctctattctgt

SEQ ID NO: 5031 - DNA, 22 bp, synthetic construct
  misc_feature 1..22: note = Synthetic Construct
  source 1..22: mol_type = other DNA
ggcttggaatgcagaagaggta

SEQ ID NO: 5032 - DNA, 26 bp, synthetic construct
  misc_feature 1..26: note = Synthetic Construct
  source 1..26: mol_type = other DNA
acagtttctggcaaattctagaagct

SEQ ID NO: 5033 - DNA, 27 bp, synthetic construct
  misc_feature 1..27: note = Synthetic Construct
  source 1..27: mol_type = other DNA
cctcaacaacccagtttttcagaaacc

SEQ ID NO: 5034 - DNA, 26 bp, synthetic construct
  misc_feature 1..26: note = Synthetic Construct
  source 1..26: mol_type = other DNA
ctctcaagcacataaaagcacttacc

SEQ ID NO: 5035 - DNA, 21 bp, synthetic construct
  misc_feature 1..21: note = Synthetic Construct
  source 1..21: mol_type = other DNA
cgggcagcgtcctgacatagt

SEQ ID NO: 5036 - DNA, 20 bp, synthetic construct
  misc_feature 1..20: note = Synthetic Construct
  source 1..20: mol_type = other DNA
cccccctggagccctctttt

SEQ ID NO: 5037 - DNA, 26 bp, synthetic construct
  misc_feature 1..26: note = Synthetic Construct
  source 1..26: mol_type = other DNA
caggatattgagcagttcccaaactc

SEQ ID NO: 5038 - DNA, 20 bp, synthetic construct
  misc_feature 1..20: note = Synthetic Construct
  source 1..20: mol_type = other DNA
gctccagaggaagcggtcta

SEQ ID NO: 5039 - DNA, 22 bp, synthetic construct
  misc_feature 1..22: note = Synthetic Construct
  source 1..22: mol_type = other DNA
aagccccagtaatgaccattgc

SEQ ID NO: 5040 - DNA, 22 bp, synthetic construct
  misc_feature 1..22: note = Synthetic Construct
  source 1..22: mol_type = other DNA
gctggtgggatggaatgaatga

SEQ ID NO: 5041 - DNA, 24 bp, synthetic construct
  misc_feature 1..24: note = Synthetic Construct
  source 1..24: mol_type = other DNA
gggcagtacagacaccatctctat

SEQ ID NO: 5042 - DNA, 24 bp, synthetic construct
  misc_feature 1..24: note = Synthetic Construct
  source 1..24: mol_type = other DNA
gctgcatttgggtcgttttgtttc

SEQ ID NO: 5043 - DNA, 24 bp, synthetic construct
  misc_feature 1..24: note = Synthetic Construct
  source 1..24: mol_type = other DNA
gacatttccaggcctgttgttagg

SEQ ID NO: 5044 - DNA, 20 bp, synthetic construct
  misc_feature 1..20: note = Synthetic Construct
  source 1..20: mol_type = other DNA
tctgcaccccagttgtcact

SEQ ID NO: 5045 - DNA, 21 bp, synthetic construct
  misc_feature 1..21: note = Synthetic Construct
  source 1..21: mol_type = other DNA
accgtccacatgttcctttcc

SEQ ID NO: 5046 - DNA, 22 bp, synthetic construct
  misc_feature 1..22: note = Synthetic Construct
  source 1..22: mol_type = other DNA
cccaataggtgctgacctttgg

SEQ ID NO: 5047 - DNA, 26 bp, synthetic construct
  misc_feature 1..26: note = Synthetic Construct
  source 1..26: mol_type = other DNA
ctgttcagttactttcaactctgctt

SEQ ID NO: 5048 - DNA, 27 bp, synthetic construct
  misc_feature 1..27: note = Synthetic Construct
  source 1..27: mol_type = other DNA
cctactttgtgcctagagttgtactca

SEQ ID NO: 5049 - DNA, 28 bp, synthetic construct
  misc_feature 1..28: note = Synthetic Construct
  source 1..28: mol_type = other DNA
gactaggaaattatcaagctggtttgtg

SEQ ID NO: 5050 - DNA, 22 bp, synthetic construct
  misc_feature 1..22: note = Synthetic Construct
  source 1..22: mol_type = other DNA
ttctccaatgaccgggtgacaa

SEQ ID NO: 5051 - DNA, 27 bp, synthetic construct
  misc_feature 1..27: note = Synthetic Construct
  source 1..27: mol_type = other DNA
ctggcactgttacatattttcctgaga

SEQ ID NO: 5052 - DNA, 24 bp, synthetic construct
  misc_feature 1..24: note = Synthetic Construct
  source 1..24: mol_type = other DNA
agtatctgactgcaaggctgttac

SEQ ID NO: 5053 - DNA, 26 bp, synthetic construct
  misc_feature 1..26: note = Synthetic Construct
  source 1..26: mol_type = other DNA
tggttgagacctgttatttccagtac

SEQ ID NO: 5054 - DNA, 26 bp, synthetic construct
  misc_feature 1..26: note = Synthetic Construct
  source 1..26: mol_type = other DNA
tcaatgggctcatcagtagatatcag

SEQ ID NO: 5055 - DNA, 27 bp, synthetic construct
  misc_feature 1..27: note = Synthetic Construct
  source 1..27: mol_type = other DNA
aacctgactttaatacaaacccaactg

SEQ ID NO: 5056 - DNA, 19 bp, synthetic construct
  misc_feature 1..19: note = Synthetic Construct
  source 1..19: mol_type = other DNA
ggctgcatgcgagttcgtt

SEQ ID NO: 5057 - DNA, 26 bp, synthetic construct
  misc_feature 1..26: note = Synthetic Construct
  source 1..26: mol_type = other DNA
gcatgttattctctccaggtccagaa

SEQ ID NO: 5058 - DNA, 23 bp, synthetic construct
  misc_feature 1..23: note = Synthetic Construct
  source 1..23: mol_type = other DNA
gggacttgcaattcgatgtgaga

SEQ ID NO: 5059 - DNA, 21 bp, synthetic construct
  misc_feature 1..21: note = Synthetic Construct
  source 1..21: mol_type = other DNA
gtggaaggtgaagcagagaca

SEQ ID NO: 5060 - DNA, 27 bp, synthetic construct
  misc_feature 1..27: note = Synthetic Construct
  source 1..27: mol_type = other DNA
cctgattggtattggctttcaggatca

SEQ ID NO: 5061 - DNA, 26 bp, synthetic construct
  misc_feature 1..26: note = Synthetic Construct
  source 1..26: mol_type = other DNA
gcaacaatccacatgaatggactatg

SEQ ID NO: 5062 - DNA, 23 bp, synthetic construct
  misc_feature 1..23: note = Synthetic Construct
  source 1..23: mol_type = other DNA
agaagctcactggaattgcagat

SEQ ID NO: 5063 - DNA, 22 bp, synthetic construct
  misc_feature 1..22: note = Synthetic Construct
  source 1..22: mol_type = other DNA
ggagctgctgtttttctgcttt

SEQ ID NO: 5064 - DNA, 24 bp, synthetic construct
  misc_feature 1..24: note = Synthetic Construct
  source 1..24: mol_type = other DNA
gagtggtggaagttacctctcaac

SEQ ID NO: 5065 - DNA, 24 bp, synthetic construct
  misc_feature 1..24: note = Synthetic Construct
  source 1..24: mol_type = other DNA
acagtttaagttttgcctgcttgt

SEQ ID NO: 5066 - DNA, 22 bp, synthetic construct
  misc_feature 1..22: note = Synthetic Construct
  source 1..22: mol_type = other DNA
ctcttgccatggttctgctcta

SEQ ID NO: 5067 - DNA, 26 bp, synthetic construct
  misc_feature 1..26: note = Synthetic Construct
  source 1..26: mol_type = other DNA
gggaatcatggttctctgctattgct

SEQ ID NO: 5068 - DNA, 27 bp, synthetic construct
  misc_feature 1..27: note = Synthetic Construct
  source 1..27: mol_type = other DNA
cgataatgtcagtgatcctgggaattc

SEQ ID NO: 5069 - DNA, 22 bp, synthetic construct
  misc_feature 1..22: note = Synthetic Construct
  source 1..22: mol_type = other DNA
tgcctccctgcatgatgattgt

SEQ ID NO: 5070 - DNA, 27 bp, synthetic construct
  misc_feature 1..27: note = Synthetic Construct
  source 1..27: mol_type = other DNA
catagttctgggaatggattcatttgc

SEQ ID NO: 5071 - DNA, 27 bp, synthetic construct
  misc_feature 1..27: note = Synthetic Construct
  source 1..27: mol_type = other DNA
cctcatatacctggaggaaaggagcat

SEQ ID NO: 5072 - DNA, 22 bp, synthetic construct
  misc_feature 1..22: note = Synthetic Construct
  source 1..22: mol_type = other DNA
tgagattggcagcgaccttaac

SEQ ID NO: 5073 - DNA, 22 bp, synthetic construct
  misc_feature 1..22: note = Synthetic Construct
  source 1..22: mol_type = other DNA
aggaggacatcagatcctgcat

SEQ ID NO: 5074 - DNA, 22 bp, synthetic construct
  misc_feature 1..22: note = Synthetic Construct
  source 1..22: mol_type = other DNA
tgatggtggcttggacttcagt

SEQ ID NO: 5075 - DNA, 21 bp, synthetic construct
  misc_feature 1..21: note = Synthetic Construct
  source 1..21: mol_type = other DNA
aagtgggttctcagggctcaa

SEQ ID NO: 5076 - DNA, 20 bp, synthetic construct
  misc_feature 1..20: note = Synthetic Construct
  source 1..20: mol_type = other DNA
gtgcagccaagttggggaaa

SEQ ID NO: 5077 - DNA, 30 bp, synthetic construct
  misc_feature 1..30: note = Synthetic Construct
  source 1..30: mol_type = other DNA
caaagtagataaaggttttcttccagtgtt

SEQ ID NO: 5078 - DNA, 18 bp, synthetic construct
  misc_feature 1..18: note = Synthetic Construct
  source 1..18: mol_type = other DNA
ggccgcaagcactccttt

SEQ ID NO: 5079 - DNA, 22 bp, synthetic construct
  misc_feature 1..22: note = Synthetic Construct
  source 1..22: mol_type = other DNA
agagtctggagggtggatccaa

SEQ ID NO: 5080 - DNA, 27 bp, synthetic construct
  misc_feature 1..27: note = Synthetic Construct
  source 1..27: mol_type = other DNA
gcatttgaaaagcattatcgtctcatc

SEQ ID NO: 5081 - DNA, 23 bp, synthetic construct
  misc_feature 1..23: note = Synthetic Construct
  source 1..23: mol_type = other DNA
accccacacaaccatacacaaag

SEQ ID NO: 5082 - DNA, 21 bp, synthetic construct
  misc_feature 1..21: note = Synthetic Construct
  source 1..21: mol_type = other DNA
accttcctggtgcctgtgatg

SEQ ID NO: 5083 - DNA, 24 bp, synthetic construct
  misc_feature 1..24: note = Synthetic Construct
  source 1..24: mol_type = other DNA
acacccacccctttctctaagtag

SEQ ID NO: 5084 - DNA, 26 bp, synthetic construct
  misc_feature 1..26: note = Synthetic Construct
  source 1..26: mol_type = other DNA
gcctgataacctgctgattctcaaac

SEQ ID NO: 5085 - DNA, 19 bp, synthetic construct
  misc_feature 1..19: note = Synthetic Construct
  source 1..19: mol_type = other DNA
aggtgggcaactgcaagca

SEQ ID NO: 5086 - DNA, 26 bp, synthetic construct
  misc_feature 1..26: note = Synthetic Construct
  source 1..26: mol_type = other DNA
cagctatactgacggtaattgtaagc

SEQ ID NO: 5087 - DNA, 22 bp, synthetic construct
  misc_feature 1..22: note = Synthetic Construct
  source 1..22: mol_type = other DNA
aagggaatggagcctgctagtt

SEQ ID NO: 5088 - DNA, 22 bp, synthetic construct
  misc_feature 1..22: note = Synthetic Construct
  source 1..22: mol_type = other DNA
accaacttcctggactgcaaag

SEQ ID NO: 5089 - DNA, 25 bp, synthetic construct
  misc_feature 1..25: note = Synthetic Construct
  source 1..25: mol_type = other DNA
gcatgtctatggcttggaaggtagt

SEQ ID NO: 5090 - DNA, 26 bp, synthetic construct
  misc_feature 1..26: note = Synthetic Construct
  source 1..26: mol_type = other DNA
ggtatttggctgtctcaagattacac

SEQ ID NO: 5091 - DNA, 22 bp, synthetic construct
  misc_feature 1..22: note = Synthetic Construct
  source 1..22: mol_type = other DNA
acgagcagcatcttctgactct

SEQ ID NO: 5092 - DNA, 23 bp, synthetic construct
  misc_feature 1..23: note = Synthetic Construct
  source 1..23: mol_type = other DNA
tccataggtcaggctgactatgc

SEQ ID NO: 5093 - DNA, 25 bp, synthetic construct
  misc_feature 1..25: note = Synthetic Construct
  source 1..25: mol_type = other DNA
gtcaagaatgatgcctggtttttgg

SEQ ID NO: 5094 - DNA, 21 bp, synthetic construct
  misc_feature 1..21: note = Synthetic Construct
  source 1..21: mol_type = other DNA
gtggtgcctgtgccacaagaa

SEQ ID NO: 5095 - DNA, 21 bp, synthetic construct
  misc_feature 1..21: note = Synthetic Construct
  source 1..21: mol_type = other DNA
agcagtagcaaggaggtgaca

SEQ ID NO: 5096 - DNA, 27 bp, synthetic construct
  misc_feature 1..27: note = Synthetic Construct
  source 1..27: mol_type = other DNA
gggaggttagacttttactctctcaga

SEQ ID NO: 5097 - DNA, 21 bp, synthetic construct
  misc_feature 1..21: note = Synthetic Construct
  source 1..21: mol_type = other DNA
gctggaaactccactgccatt

SEQ ID NO: 5098 - DNA, 22 bp, synthetic construct
  misc_feature 1..22: note = Synthetic Construct
  source 1..22: mol_type = other DNA
tcccagttgcagccataactgt

SEQ ID NO: 5099 - DNA, 28 bp, synthetic construct
  misc_feature 1..28: note = Synthetic Construct
  source 1..28: mol_type = other DNA
cagcaactacttctcaatctgtctacag

SEQ ID NO: 5100 - DNA, 23 bp, synthetic construct
  misc_feature 1..23: note = Synthetic Construct
  source 1..23: mol_type = other DNA
gcatgtacaaaacaagcccttga

SEQ ID NO: 5101 - DNA, 24 bp, synthetic construct
  misc_feature 1..24: note = Synthetic Construct
  source 1..24: mol_type = other DNA
ggagggtgagaccaagtctgtttt

SEQ ID NO: 5102 - DNA, 25 bp, synthetic construct
  misc_feature 1..25: note = Synthetic Construct
  source 1..25: mol_type = other DNA
tcatcatgggtctgtgattgattga

SEQ ID NO: 5103 - DNA, 21 bp, synthetic construct
  misc_feature 1..21: note = Synthetic Construct
  source 1..21: mol_type = other DNA
tgggatggtggtgtgagaagt

SEQ ID NO: 5104 - DNA, 22 bp, synthetic construct
  misc_feature 1..22: note = Synthetic Construct
  source 1..22: mol_type = other DNA
tcctgagtggatggttgactct

SEQ ID NO: 5105 - DNA, 25 bp, synthetic construct
  misc_feature 1..25: note = Synthetic Construct
  source 1..25: mol_type = other DNA
gataatgttgggagaggcaatttgg

SEQ ID NO: 5106 - DNA, 22 bp, synthetic construct
  misc_feature 1..22: note = Synthetic Construct
  source 1..22: mol_type = other DNA
tgagaggtgagtggagtttgct

SEQ ID NO: 5107 - DNA, 23 bp, synthetic construct
  misc_feature 1..23: note = Synthetic Construct
  source 1..23: mol_type = other DNA
cctgaatcccttttgtgcatgtg

SEQ ID NO: 5108 - DNA, 23 bp, synthetic construct
  misc_feature 1..23: note = Synthetic Construct
  source 1..23: mol_type = other DNA
ccacctctgtaaacatgcaagga

SEQ ID NO: 5109 - DNA, 24 bp, synthetic construct
  misc_feature 1..24: note = Synthetic Construct
  source 1..24: mol_type = other DNA
gtaaagggctctgttcttcaggaa

SEQ ID NO: 5110 - DNA, 21 bp, synthetic construct
  misc_feature 1..21: note = Synthetic Construct
  source 1..21: mol_type = other DNA
tccaagacaagggagccagaa

SEQ ID NO: 5111 - DNA, 23 bp, synthetic construct
  misc_feature 1..23: note = Synthetic Construct
  source 1..23: mol_type = other DNA
caccaaaaatcactggggttggt

SEQ ID NO: 5112 - DNA, 22 bp, synthetic construct
  misc_feature 1..22: note = Synthetic Construct
  source 1..22: mol_type = other DNA
gcgacctctttcagtcaccaaa

SEQ ID NO: 5113 - DNA, 22 bp, synthetic construct
  misc_feature 1..22: note = Synthetic Construct
  source 1..22: mol_type = other DNA
ctgctcctgtgagacagtaacc

SEQ ID NO: 5114 - DNA, 27 bp, synthetic construct
  misc_feature 1..27: note = Synthetic Construct
  source 1..27: mol_type = other DNA
gacccatgtacttattagctgtgaact

SEQ ID NO: 5115 - DNA, 19 bp, synthetic construct
  misc_feature 1..19: note = Synthetic Construct
  source 1..19: mol_type = other DNA
tgccgctctgccagattct

SEQ ID NO: 5116 - DNA, 24 bp, synthetic construct
  misc_feature 1..24: note = Synthetic Construct
  source 1..24: mol_type = other DNA
tgccagagactttgccagatttcc

SEQ ID NO: 5117 - DNA, 23 bp, synthetic construct
  misc_feature 1..23: note = Synthetic Construct
  source 1..23: mol_type = other DNA
tgctgagagaaggtgctatctct

SEQ ID NO: 5118 - DNA, 22 bp, synthetic construct
  misc_feature 1..22: note = Synthetic Construct
  source 1..22: mol_type = other DNA
tctccatgccccttgatagtca

SEQ ID NO: 5119 - DNA, 22 bp, synthetic construct
  misc_feature 1..22: note = Synthetic Construct
  source 1..22: mol_type = other DNA
ggcaaggagacctttcagatga

SEQ ID NO: 5120 - DNA, 23 bp, synthetic construct
  misc_feature 1..23: note = Synthetic Construct
  source 1..23: mol_type = other DNA
actccctgaatgcctccttaacc

SEQ ID NO: 5121 - DNA, 21 bp, synthetic construct
  misc_feature 1..21: note = Synthetic Construct
  source 1..21: mol_type = other DNA
gctgtggtcatgtaggaagct

SEQ ID NO: 5122 - DNA, 22 bp, synthetic construct
  misc_feature 1..22: note = Synthetic Construct
  source 1..22: mol_type = other DNA
tgctgccccattgtcactttca

SEQ ID NO: 5123 - DNA, 21 bp, synthetic construct
  misc_feature 1..21: note = Synthetic Construct
  source 1..21: mol_type = other DNA
tccccagctgacaatcatgca

SEQ ID NO: 5124 - DNA, 24 bp, synthetic construct
  misc_feature 1..24: note = Synthetic Construct
  source 1..24: mol_type = other DNA
tgccaacaaggtgaaatagcagat

SEQ ID NO: 5125 - DNA, 26 bp, synthetic construct
  misc_feature 1..26: note = Synthetic Construct
  source 1..26: mol_type = other DNA
cgagctgatctgagtacaatcacaga

SEQ ID NO: 5126 - DNA, 24 bp, synthetic construct
  misc_feature 1..24: note = Synthetic Construct
  source 1..24: mol_type = other DNA
actcttttgtctctggctgtagag

SEQ ID NO: 5127 - DNA, 27 bp, synthetic construct
  misc_feature 1..27: note = Synthetic Construct
  source 1..27: mol_type = other DNA
gcaaagatgaaaactggaagctacaac

SEQ ID NO: 5128 - DNA, 26 bp, synthetic construct
  misc_feature 1..26: note = Synthetic Construct
  source 1..26: mol_type = other DNA
acatgacaggaaagtaaagctttgac

SEQ ID NO: 5129 - DNA, 25 bp, synthetic construct
  misc_feature 1..25: note = Synthetic Construct
  source 1..25: mol_type = other DNA
ggggatagatgaagtgtggcaaaat

SEQ ID NO: 5130 - DNA, 25 bp, synthetic construct
  misc_feature 1..25: note = Synthetic Construct
  source 1..25: mol_type = other DNA
tgaagtagaaggatgcagagacctt

SEQ ID NO: 5131 - DNA, 25 bp, synthetic construct
  misc_feature 1..25: note = Synthetic Construct
  source 1..25: mol_type = other DNA
gagtttcctgtgacctaaccatgtg

SEQ ID NO: 5132 - DNA, 20 bp, synthetic construct
  misc_feature 1..20: note = Synthetic Construct
  source 1..20: mol_type = other DNA
acgtgcctcagctgtgaaat

SEQ ID NO: 5133 - DNA, 25 bp, synthetic construct
  misc_feature 1..25: note = Synthetic Construct
  source 1..25: mol_type = other DNA
ggacagacactgattaagggcaact

SEQ ID NO: 5134 - DNA, 22 bp, synthetic construct
  misc_feature 1..22: note = Synthetic Construct
  source 1..22: mol_type = other DNA
cccagcatctttgtgaggagaa

SEQ ID NO: 5135 - DNA, 21 bp, synthetic construct
  misc_feature 1..21: note = Synthetic Construct
  source 1..21: mol_type = other DNA
aggctcagctgcatcagacaa

SEQ ID NO: 5136 - DNA, 24 bp, synthetic construct
  misc_feature 1..24: note = Synthetic Construct
  source 1..24: mol_type = other DNA
cttggaaaagtgagagcgttttga

SEQ ID NO: 5137 - DNA, 26 bp, synthetic construct
  misc_feature 1..26: note = Synthetic Construct
  source 1..26: mol_type = other DNA
tttcaggcaagaaacaaatgatctgt

SEQ ID NO: 5138 - DNA, 21 bp, synthetic construct
  misc_feature 1..21: note = Synthetic Construct
  source 1..21: mol_type = other DNA
atcggctcaggcacacttagt

SEQ ID NO: 5139 - DNA, 21 bp, synthetic construct
  misc_feature 1..21: note = Synthetic Construct
  source 1..21: mol_type = other DNA
agggagtgtgtgggtttggtt

SEQ ID NO: 5140 - DNA, 22 bp, synthetic construct
  misc_feature 1..22: note = Synthetic Construct
  source 1..22: mol_type = other DNA
gaaacagtgcctgcccaactat

SEQ ID NO: 5141 - DNA, 27 bp, synthetic construct
  misc_feature 1..27: note = Synthetic Construct
  source 1..27: mol_type = other DNA
gcactaacagcccatgtacactaacag

SEQ ID NO: 5142 - DNA, 22 bp, synthetic construct
  misc_feature 1..22: note = Synthetic Construct
  source 1..22: mol_type = other DNA
gaacaataggctgcctgtggtt

SEQ ID NO: 5143 - DNA, 23 bp, synthetic construct
  misc_feature 1..23: note = Synthetic Construct
  source 1..23: mol_type = other DNA
tgaatctaggctgcctctgtaca

SEQ ID NO: 5144 - DNA, 26 bp, synthetic construct
  misc_feature 1..26: note = Synthetic Construct
  source 1..26: mol_type = other DNA
gcatgctgatttgaaggaaactgtct

SEQ ID NO: 5145 - DNA, 22 bp, synthetic construct
  misc_feature 1..22: note = Synthetic Construct
  source 1..22: mol_type = other DNA
gcaacaactgccagctttactg

SEQ ID NO: 5146 - DNA, 24 bp, synthetic construct
  misc_feature 1..24: note = Synthetic Construct
  source 1..24: mol_type = other DNA
ccctgctagatcccaactgttcta

SEQ ID NO: 5147 - DNA, 20 bp, synthetic construct
  misc_feature 1..20: note = Synthetic Construct
  source 1..20: mol_type = other DNA
acctgcagaggatggaagga

SEQ ID NO: 5148 - DNA, 22 bp, synthetic construct
  misc_feature 1..22: note = Synthetic Construct
  source 1..22: mol_type = other DNA
acaaggctcaggattccaagct

SEQ ID NO: 5149 - DNA, 23 bp, synthetic construct
  misc_feature 1..23: note = Synthetic Construct
  source 1..23: mol_type = other DNA
ctcagctttggattggaccttct

SEQ ID NO: 5150 - DNA, 22 bp, synthetic construct
  misc_feature 1..22: note = Synthetic Construct
  source 1..22: mol_type = other DNA
ccaaaggccaggaagagggtat

SEQ ID NO: 5151 - DNA, 20 bp, synthetic construct
  misc_feature 1..20: note = Synthetic Construct
  source 1..20: mol_type = other DNA
actgcactcagggcttgtca

SEQ ID NO: 5152 - DNA, 26 bp, synthetic construct
  misc_feature 1..26: note = Synthetic Construct
  source 1..26: mol_type = other DNA
tgatttgggtgtcaatctgaaatcac

SEQ ID NO: 5153 - DNA, 22 bp, synthetic construct
  misc_feature 1..22: note = Synthetic Construct
  source 1..22: mol_type = other DNA
aggtttctcaccaccctcatct

SEQ ID NO: 5154 - DNA, 22 bp, synthetic construct
  misc_feature 1..22: note = Synthetic Construct
  source 1..22: mol_type = other DNA
cacatccagcgaccatcaacat

SEQ ID NO: 5155 - DNA, 22 bp, synthetic construct
  misc_feature 1..22: note = Synthetic Construct
  source 1..22: mol_type = other DNA
caggttgcttgtttccaaacca

SEQ ID NO: 5156 - DNA, 22 bp, synthetic construct
  misc_feature 1..22: note = Synthetic Construct
  source 1..22: mol_type = other DNA
tgttcccctctctgctctaacc

SEQ ID NO: 5157 - DNA, 28 bp, synthetic construct
  misc_feature 1..28: note = Synthetic Construct
  source 1..28: mol_type = other DNA
ggttggcactataatagccaccattaaa

SEQ ID NO: 5158 - DNA, 21 bp, synthetic construct
  misc_feature 1..21: note = Synthetic Construct
  source 1..21: mol_type = other DNA
acatgcagcatggagcaatgt

SEQ ID NO: 5159 - DNA, 26 bp, synthetic construct
  misc_feature 1..26: note = Synthetic Construct
  source 1..26: mol_type = other DNA
gtgatgattggaatgggttagacaga

SEQ ID NO: 5160 - DNA, 20 bp, synthetic construct
  misc_feature 1..20: note = Synthetic Construct
  source 1..20: mol_type = other DNA
gcttgctgcaattccccaaa

SEQ ID NO: 5161 - DNA, 21 bp, synthetic construct
  misc_feature 1..21: note = Synthetic Construct
  source 1..21: mol_type = other DNA
acctctgccaggaacccagaa

SEQ ID NO: 5162 - DNA, 22 bp, synthetic construct
  misc_feature 1..22: note = Synthetic Construct
  source 1..22: mol_type = other DNA
gtcttgctttaccgcagactga

SEQ ID NO: 5163 - DNA, 19 bp, synthetic construct
  misc_feature 1..19: note = Synthetic Construct
  source 1..19: mol_type = other DNA
aggctcctctgcaggacat

SEQ ID NO: 5164 - DNA, 25 bp, synthetic construct
  misc_feature 1..25: note = Synthetic Construct
  source 1..25: mol_type = other DNA
acaagccactgttacgtttctagat

SEQ ID NO: 5165 - DNA, 25 bp, synthetic construct
  misc_feature 1..25: note = Synthetic Construct
  source 1..25: mol_type = other DNA
cctccgattgctttttgtgttccta

SEQ ID NO: 5166 - DNA, 28 bp, synthetic construct
  misc_feature 1..28: note = Synthetic Construct
  source 1..28: mol_type = other DNA
tctcattgtgtttcatcaagatcactct

SEQ ID NO: 5167 - DNA, 22 bp, synthetic construct
  misc_feature 1..22: note = Synthetic Construct
  source 1..22: mol_type = other DNA
cagtcacccaatgagctcatca

SEQ ID NO: 5168 - DNA, 19 bp, synthetic construct
  misc_feature 1..19: note = Synthetic Construct
  source 1..19: mol_type = other DNA
tcgaggtgtggctgttcct

SEQ ID NO: 5169 - DNA, 19 bp, synthetic construct
  misc_feature 1..19: note = Synthetic Construct
  source 1..19: mol_type = other DNA
tgctagcggctcagagctt

SEQ ID NO: 5170 - DNA, 26 bp, synthetic construct
  misc_feature 1..26: note = Synthetic Construct
  source 1..26: mol_type = other DNA
agaccccatatttctccctattgaac

SEQ ID NO: 5171 - DNA, 24 bp, synthetic construct
  misc_feature 1..24: note = Synthetic Construct
  source 1..24: mol_type = other DNA
cccgatgacatcacttttgcatct

SEQ ID NO: 5172 - DNA, 24 bp, synthetic construct
  misc_feature 1..24: note = Synthetic Construct
  source 1..24: mol_type = other DNA
ccaagattccagcacaggtaccat

SEQ ID NO: 5173 - DNA, 24 bp, synthetic construct
  misc_feature 1..24: note = Synthetic Construct
  source 1..24: mol_type = other DNA
gggggttttgccagtcatctaagt

SEQ ID NO: 5174 - DNA, 22 bp, synthetic construct
  misc_feature 1..22: note = Synthetic Construct
  source 1..22: mol_type = other DNA
ggccacatggaaggcatgttta

SEQ ID NO: 5175 - DNA, 24 bp, synthetic construct
  misc_feature 1..24: note = Synthetic Construct
  source 1..24: mol_type = other DNA
gcaaagttagggcagaaccaacca

SEQ ID NO: 5176 - DNA, 26 bp, synthetic construct
  misc_feature 1..26: note = Synthetic Construct
  source 1..26: mol_type = other DNA
gggttcaataattccaccctcaactc

SEQ ID NO: 5177 - DNA, 24 bp, synthetic construct
  misc_feature 1..24: note = Synthetic Construct
  source 1..24: mol_type = other DNA
gaccaagacctttccatcatccat

SEQ ID NO: 5178 - DNA, 23 bp, synthetic construct
  misc_feature 1..23: note = Synthetic Construct
  source 1..23: mol_type = other DNA
tgtggcctctaagacctgagtag

SEQ ID NO: 5179 - DNA, 24 bp, synthetic construct
  misc_feature 1..24: note = Synthetic Construct
  source 1..24: mol_type = other DNA
gagcagctgaacagtacaatacca

SEQ ID NO: 5180 - DNA, 26 bp, synthetic construct
  misc_feature 1..26: note = Synthetic Construct
  source 1..26: mol_type = other DNA
gtcatatccttagggttcctggttct

SEQ ID NO: 5181 - DNA, 24 bp, synthetic construct
  misc_feature 1..24: note = Synthetic Construct
  source 1..24: mol_type = other DNA
cagccacagtggaataaagtacca

SEQ ID NO: 5182 - DNA, 24 bp, synthetic construct
  misc_feature 1..24: note = Synthetic Construct
  source 1..24: mol_type = other DNA
gttctgtgacaccatcttccatca

SEQ ID NO: 5183 - DNA, 23 bp, synthetic construct
  misc_feature 1..23: note = Synthetic Construct
  source 1..23: mol_type = other DNA
tgctctccaggatctccagtcat

SEQ ID NO: 5184 - DNA, 26 bp, synthetic construct
  misc_feature 1..26: note = Synthetic Construct
  source 1..26: mol_type = other DNA
agaacaacagcaaaacttgtgatctg

SEQ ID NO: 5185 - DNA, 21 bp, synthetic construct
  misc_feature 1..21: note = Synthetic Construct
  source 1..21: mol_type = other DNA
tcagccaaccttgacctgtga

SEQ ID NO: 5186 - DNA, 27 bp, synthetic construct
  misc_feature 1..27: note = Synthetic Construct
  source 1..27: mol_type = other DNA
gagatcctaagtctgtgatatggcaat

SEQ ID NO: 5187 - DNA, 24 bp, synthetic construct
  misc_feature 1..24: note = Synthetic Construct
  source 1..24: mol_type = other DNA
ttctctctggatgtcccccttaag

SEQ ID NO: 5188 - DNA, 20 bp, synthetic construct
  misc_feature 1..20: note = Synthetic Construct
  source 1..20: mol_type = other DNA
cctaggctgggtggatggat

SEQ ID NO: 5189 - DNA, 27 bp, synthetic construct
  misc_feature 1..27: note = Synthetic Construct
  source 1..27: mol_type = other DNA
gtgggtagaaagaacatttcacattgc

SEQ ID NO: 5190 - DNA, 24 bp, synthetic construct
  misc_feature 1..24: note = Synthetic Construct
  source 1..24: mol_type = other DNA
gagttgcttggtagggctggaatt

SEQ ID NO: 5191 - DNA, 22 bp, synthetic construct
  misc_feature 1..22: note = Synthetic Construct
  source 1..22: mol_type = other DNA
acagatggtacccctgctgact

SEQ ID NO: 5192 - DNA, 25 bp, synthetic construct
  misc_feature 1..25: note = Synthetic Construct
  source 1..25: mol_type = other DNA
gcacctatattcatgccaagagaga

SEQ ID NO: 5193 - DNA, 24 bp, synthetic construct
  misc_feature 1..24: note = Synthetic Construct
  source 1..24: mol_type = other DNA
cctgaagatacaggcttccttcct

SEQ ID NO: 5194 - DNA, 21 bp, synthetic construct
  misc_feature 1..21: note = Synthetic Construct
  source 1..21: mol_type = other DNA
tgcagtgggagtctccatgaa

SEQ ID NO: 5195 - DNA, 20 bp, synthetic construct
  misc_feature 1..20: note = Synthetic Construct
  source 1..20: mol_type = other DNA
ctgtgagagccaacccacat

SEQ ID NO: 5196 - DNA, 23 bp, synthetic construct
  misc_feature 1..23: note = Synthetic Construct
  source 1..23: mol_type = other DNA
acttgccttctaaaacccagtca

SEQ ID NO: 5197 - DNA, 21 bp, synthetic construct
  misc_feature 1..21: note = Synthetic Construct
  source 1..21: mol_type = other DNA
cccactgagcctctgtctgta

SEQ ID NO: 5198 - DNA, 24 bp, synthetic construct
  misc_feature 1..24: note = Synthetic Construct
  source 1..24: mol_type = other DNA
gcccacctgaaagtgtcaactaac

SEQ ID NO: 5199 - DNA, 24 bp, synthetic construct
  misc_feature 1..24: note = Synthetic Construct
  source 1..24: mol_type = other DNA
gtatttgggtgcatgagttggttt

SEQ ID NO: 5200 - DNA, 22 bp, synthetic construct
  misc_feature 1..22: note = Synthetic Construct
  source 1..22: mol_type = other DNA
ggaaaggcaggccagagtttaa

SEQ ID NO: 5201 - DNA, 23 bp, synthetic construct
  misc_feature 1..23: note = Synthetic Construct
  source 1..23: mol_type = other DNA
ccacacctgcagaattagtacca

SEQ ID NO: 5202 - DNA, 20 bp, synthetic construct
  misc_feature 1..20: note = Synthetic Construct
  source 1..20: mol_type = other DNA
acagggcttggggcttagga

SEQ ID NO: 5203 - DNA, 19 bp, synthetic construct
  misc_feature 1..19: note = Synthetic Construct
  source 1..19: mol_type = other DNA
gggaaggagctggcgtgta

SEQ ID NO: 5204 - DNA, 23 bp, synthetic construct
  misc_feature 1..23: note = Synthetic Construct
  source 1..23: mol_type = other DNA
tggtgcctgtgatggttaattcc

SEQ ID NO: 5205 - DNA, 24 bp, synthetic construct
  misc_feature 1..24: note = Synthetic Construct
  source 1..24: mol_type = other DNA
aattagaatcagctgggcttagca

SEQ ID NO: 5206 - DNA, 22 bp, synthetic construct
  misc_feature 1..22: note = Synthetic Construct
  source 1..22: mol_type = other DNA
agcacctgaattttggcagaga

SEQ ID NO: 5207 - DNA, 21 bp, synthetic construct
  misc_feature 1..21: note = Synthetic Construct
  source 1..21: mol_type = other DNA
tttggggtggcatttcctgaa

SEQ ID NO: 5208 - DNA, 24 bp, synthetic construct
  misc_feature 1..24: note = Synthetic Construct
  source 1..24: mol_type = other DNA
tctgacaggggatttcagctagtg

SEQ ID NO: 5209 - DNA, 21 bp, synthetic construct
  misc_feature 1..21: note = Synthetic Construct
  source 1..21: mol_type = other DNA
gccactagcagacacctgtgt

SEQ ID NO: 5210 - DNA, 21 bp, synthetic construct
  misc_feature 1..21: note = Synthetic Construct
  source 1..21: mol_type = other DNA
tgctgagctgatgggttgtag

SEQ ID NO: 5211 - DNA, 21 bp, synthetic construct
  misc_feature 1..21: note = Synthetic Construct
  source 1..21: mol_type = other DNA
agccagactccagggatagag

SEQ ID NO: 5212 - DNA, 21 bp, synthetic construct
  misc_feature 1..21: note = Synthetic Construct
  source 1..21: mol_type = other DNA
tgggtgagtcactggattgct

SEQ ID NO: 5213 - DNA, 25 bp, synthetic construct
  misc_feature 1..25: note = Synthetic Construct
  source 1..25: mol_type = other DNA
cagagttagatgagtgggcttcctt

SEQ ID NO: 5214 - DNA, 27 bp, synthetic construct
  misc_feature 1..27: note = Synthetic Construct
  source 1..27: mol_type = other DNA
ggttgtgaccctacttacttactcctt

SEQ ID NO: 5215 - DNA, 26 bp, synthetic construct
  misc_feature 1..26: note = Synthetic Construct
  source 1..26: mol_type = other DNA
gaggatttattgagaggcgattgtca

SEQ ID NO: 5216 - DNA, 26 bp, synthetic construct
  misc_feature 1..26: note = Synthetic Construct
  source 1..26: mol_type = other DNA
cccccaagaatcttaccttcagacta

SEQ ID NO: 5217 - DNA, 24 bp, synthetic construct
  misc_feature 1..24: note = Synthetic Construct
  source 1..24: mol_type = other DNA
ctcgtgggctcctttccttaaatg

SEQ ID NO: 5218 - DNA, 22 bp, synthetic construct
  misc_feature 1..22: note = Synthetic Construct
  source 1..22: mol_type = other DNA
gccttgtgaagagggggtagga

SEQ ID NO: 5219 - DNA, 24 bp, synthetic construct
  misc_feature 1..24: note = Synthetic Construct
  source 1..24: mol_type = other DNA
cctgccttgaccagagtacagttt

SEQ ID NO: 5220 - DNA, 19 bp, synthetic construct
  misc_feature 1..19: note = Synthetic Construct
  source 1..19: mol_type = other DNA
ccagcaccggtgagtgttt

SEQ ID NO: 5221 - DNA, 27 bp, synthetic construct
  misc_feature 1..27: note = Synthetic Construct
  source 1..27: mol_type = other DNA
gcaggatagggattaggttcctaacag

SEQ ID NO: 5222 - DNA, 21 bp, synthetic construct
  misc_feature 1..21: note = Synthetic Construct
  source 1..21: mol_type = other DNA
tgtggactcgtagccttcaga

SEQ ID NO: 5223 - DNA, 21 bp, synthetic construct
  misc_feature 1..21: note = Synthetic Construct
  source 1..21: mol_type = other DNA
agctggtaaggggcatccatt

SEQ ID NO: 5224 - DNA, 25 bp, synthetic construct
  misc_feature 1..25: note = Synthetic Construct
  source 1..25: mol_type = other DNA
ggggtctcttgtcttagagatgagt

SEQ ID NO: 5225 - DNA, 18 bp, synthetic construct
  misc_feature 1..18: note = Synthetic Construct
  source 1..18: mol_type = other DNA
tggggccacgtctgaaca

SEQ ID NO: 5226 - DNA, 22 bp, synthetic construct
  misc_feature 1..22: note = Synthetic Construct
  source 1..22: mol_type = other DNA
gtctcatgcagagttggtgact

SEQ ID NO: 5227 - DNA, 19 bp, synthetic construct
  misc_feature 1..19: note = Synthetic Construct
  source 1..19: mol_type = other DNA
tcagcccaggctcgaacca

SEQ ID NO: 5228 - DNA, 23 bp, synthetic construct
  misc_feature 1..23: note = Synthetic Construct
  source 1..23: mol_type = other DNA
acagattttgcccttggacagtt

SEQ ID NO: 5229 - DNA, 21 bp, synthetic construct
  misc_feature 1..21: note = Synthetic Construct
  source 1..21: mol_type = other DNA
ttcctccaacactgccattgt

SEQ ID NO: 5230 - DNA, 27 bp, synthetic construct
  misc_feature 1..27: note = Synthetic Construct
  source 1..27: mol_type = other DNA
ggaggttgggtgcatctaaatgtaagg

SEQ ID NO: 5231 - DNA, 29 bp, synthetic construct
  misc_feature 1..29: note = Synthetic Construct
  source 1..29: mol_type = other DNA
aagtaagggtgtgatggtgtttattattc

SEQ ID NO: 5232 - DNA, 22 bp, synthetic construct
  misc_feature 1..22: note = Synthetic Construct
  source 1..22: mol_type = other DNA
ggcagtgtgaaaggtgactgta

SEQ ID NO: 5233 - DNA, 25 bp, synthetic construct
  misc_feature 1..25: note = Synthetic Construct
  source 1..25: mol_type = other DNA
caggtatgtttaggaacagcaagga

SEQ ID NO: 5234 - DNA, 22 bp, synthetic construct
  misc_feature 1..22: note = Synthetic Construct
  source 1..22: mol_type = other DNA
aaggagcagcagactccaaagg

SEQ ID NO: 5235 - DNA, 24 bp, synthetic construct
  misc_feature 1..24: note = Synthetic Construct
  source 1..24: mol_type = other DNA
gccaaaaactgacaagtggtactg

SEQ ID NO: 5236 - DNA, 21 bp, synthetic construct
  misc_feature 1..21: note = Synthetic Construct
  source 1..21: mol_type = other DNA
ctgagtgtgttaggggcttgt

SEQ ID NO: 5237 - DNA, 18 bp, synthetic construct
  misc_feature 1..18: note = Synthetic Construct
  source 1..18: mol_type = other DNA
tgctgcagcaacgtctgt

SEQ ID NO: 5238 - DNA, 26 bp, synthetic construct
  misc_feature 1..26: note = Synthetic Construct
  source 1..26: mol_type = other DNA
gcatgactccaatgcactaagtagga

SEQ ID NO: 5239 - DNA, 26 bp, synthetic construct
  misc_feature 1..26: note = Synthetic Construct
  source 1..26: mol_type = other DNA
gcttgctttagaactgactagcaaag

SEQ ID NO: 5240 - DNA, 22 bp, synthetic construct
  misc_feature 1..22: note = Synthetic Construct
  source 1..22: mol_type = other DNA
tgggcttcctattcagcatcag

SEQ ID NO: 5241 - DNA, 25 bp, synthetic construct
  misc_feature 1..25: note = Synthetic Construct
  source 1..25: mol_type = other DNA
ctgtagactgaaatcagggaattgc

SEQ ID NO: 5242 - DNA, 27 bp, synthetic construct
  misc_feature 1..27: note = Synthetic Construct
  source 1..27: mol_type = other DNA
ggaagaatgttgggatgaaaagaaggt

SEQ ID NO: 5243 - DNA, 22 bp, synthetic construct
  misc_feature 1..22: note = Synthetic Construct
  source 1..22: mol_type = other DNA
ggaatttggagggcaacatgga

SEQ ID NO: 5244 - DNA, 18 bp, synthetic construct
  misc_feature 1..18: note = Synthetic Construct
  source 1..18: mol_type = other DNA
cagtgcgcgctccctgaa

SEQ ID NO: 5245 - DNA, 25 bp, synthetic construct
  misc_feature 1..25: note = Synthetic Construct
  source 1..25: mol_type = other DNA
ctgggtctttcagaagtgacccata

SEQ ID NO: 5246 - DNA, 22 bp, synthetic construct
  misc_feature 1..22: note = Synthetic Construct
  source 1..22: mol_type = other DNA
ggagcttgcttcccatttttcc

SEQ ID NO: 5247 - DNA, 23 bp, synthetic construct
  misc_feature 1..23: note = Synthetic Construct
  source 1..23: mol_type = other DNA
agggaaggagttgtgagattcca

SEQ ID NO: 5248 - DNA, 22 bp, synthetic construct
  misc_feature 1..22: note = Synthetic Construct
  source 1..22: mol_type = other DNA
tgaactggaattgcagcaacag

SEQ ID NO: 5249 - DNA, 22 bp, synthetic construct
  misc_feature 1..22: note = Synthetic Construct
  source 1..22: mol_type = other DNA
gcaaagccttctctcgcacatt

SEQ ID NO: 5250 - DNA, 29 bp, synthetic construct
  misc_feature 1..29: note = Synthetic Construct
  source 1..29: mol_type = other DNA
cctgtccatttgtatttaggtatgagctt

SEQ ID NO: 5251 - DNA, 29 bp, synthetic construct
  misc_feature 1..29: note = Synthetic Construct
  source 1..29: mol_type = other DNA
gggttagctaggagtgagtattactaagc

SEQ ID NO: 5252 - DNA, 24 bp, synthetic construct
  misc_feature 1..24: note = Synthetic Construct
  source 1..24: mol_type = other DNA
ggtggttccaaagaagggatcaga

SEQ ID NO: 5253 - DNA, 24 bp, synthetic construct
  misc_feature 1..24: note = Synthetic Construct
  source 1..24: mol_type = other DNA
gcagacactcagtgcatgtttgtg

SEQ ID NO: 5254 - DNA, 21 bp, synthetic construct
  misc_feature 1..21: note = Synthetic Construct
  source 1..21: mol_type = other DNA
cctcaagccagtggtctcttc

SEQ ID NO: 5255 - DNA, 22 bp, synthetic construct
  misc_feature 1..22: note = Synthetic Construct
  source 1..22: mol_type = other DNA
tggcctaaaagtggcctgctat

SEQ ID NO: 5256 - DNA, 24 bp, synthetic construct
  misc_feature 1..24: note = Synthetic Construct
  source 1..24: mol_type = other DNA
ctgtagtccttgaagggagaagga

SEQ ID NO: 5257 - DNA, 22 bp, synthetic construct
  misc_feature 1..22: note = Synthetic Construct
  source 1..22: mol_type = other DNA
gatgtgctgagaagggttcaga

SEQ ID NO: 5258 - DNA, 25 bp, synthetic construct
  misc_feature 1..25: note = Synthetic Construct
  source 1..25: mol_type = other DNA
gcaactttgtgcttaaacctgaagt

SEQ ID NO: 5259 - DNA, 18 bp, synthetic construct
  misc_feature 1..18: note = Synthetic Construct
  source 1..18: mol_type = other DNA
aggcgggagtgctagcat

SEQ ID NO: 5260 - DNA, 22 bp, synthetic construct
  misc_feature 1..22: note = Synthetic Construct
  source 1..22: mol_type = other DNA
cctgcctcattggtatgtggtt

SEQ ID NO: 5261 - DNA, 22 bp, synthetic construct
  misc_feature 1..22: note = Synthetic Construct
  source 1..22: mol_type = other DNA
gctgagattttgcccagtacgt

SEQ ID NO: 5262 - DNA, 28 bp, synthetic construct
  misc_feature 1..28: note = Synthetic Construct
  source 1..28: mol_type = other DNA
tgtatcttttgcagttacctcttaaacc

SEQ ID NO: 5263 - DNA, 22 bp, synthetic construct
  misc_feature 1..22: note = Synthetic Construct
  source 1..22: mol_type = other DNA
aggaccacaacctgatgaagtc

SEQ ID NO: 5264 - DNA, 20 bp, synthetic construct
  misc_feature 1..20: note = Synthetic Construct
  source 1..20: mol_type = other DNA
acctcatgcgtcaggactca

SEQ ID NO: 5265 - DNA, 26 bp, synthetic construct
  misc_feature 1..26: note = Synthetic Construct
  source 1..26: mol_type = other DNA
tctgaatccctgttacattctttcca

SEQ ID NO: 5266 - DNA, 26 bp, synthetic construct
  misc_feature 1..26: note = Synthetic Construct
  source 1..26: mol_type = other DNA
ccagagtatttgtctccaagctatcc

SEQ ID NO: 5267 - DNA, 21 bp, synthetic construct
  misc_feature 1..21: note = Synthetic Construct
  source 1..21: mol_type = other DNA
ggcagtaaggaggccctgcta

SEQ ID NO: 5268 - DNA, 22 bp, synthetic construct
  misc_feature 1..22: note = Synthetic Construct
  source 1..22: mol_type = other DNA
aacctgtattggctgcgtgagt

SEQ ID NO: 5269 - DNA, 22 bp, synthetic construct
  misc_feature 1..22: note = Synthetic Construct
  source 1..22: mol_type = other DNA
agtttctgctctgccactacca

SEQ ID NO: 5270 - DNA, 25 bp, synthetic construct
  misc_feature 1..25: note = Synthetic Construct
  source 1..25: mol_type = other DNA
gggtctagaatggattgcagctgtt

SEQ ID NO: 5271 - DNA, 19 bp, synthetic construct
  misc_feature 1..19: note = Synthetic Construct
  source 1..19: mol_type = other DNA
aggccaagtcccaggtcaa

SEQ ID NO: 5272 - DNA, 19 bp, synthetic construct
  misc_feature 1..19: note = Synthetic Construct
  source 1..19: mol_type = other DNA
tgggcccaagcaggactgt

SEQ ID NO: 5273 - DNA, 20 bp, synthetic construct
  misc_feature 1..20: note = Synthetic Construct
  source 1..20: mol_type = other DNA
tcagtgcatggcctctctct

SEQ ID NO: 5274 - DNA, 23 bp, synthetic construct
  misc_feature 1..23: note = Synthetic Construct
  source 1..23: mol_type = other DNA
tgtggccttcgagacaattactg

SEQ ID NO: 5275 - DNA, 24 bp, synthetic construct
  misc_feature 1..24: note = Synthetic Construct
  source 1..24: mol_type = other DNA
cctgcaaaccgttgacaatttagg

SEQ ID NO: 5276 - DNA, 27 bp, synthetic construct
  misc_feature 1..27: note = Synthetic Construct
  source 1..27: mol_type = other DNA
aaaatccacatagatttccaggtgaga

SEQ ID NO: 5277 - DNA, 23 bp, synthetic construct
  misc_feature 1..23: note = Synthetic Construct
  source 1..23: mol_type = other DNA
ccatagggatgctgacatttgct

SEQ ID NO: 5278 - DNA, 24 bp, synthetic construct
  misc_feature 1..24: note = Synthetic Construct
  source 1..24: mol_type = other DNA
ctgaggctcaaagtgatacagcta

SEQ ID NO: 5279 - DNA, 23 bp, synthetic construct
  misc_feature 1..23: note = Synthetic Construct
  source 1..23: mol_type = other DNA
gaaaagaacagagctcccatgct

SEQ ID NO: 5280 - DNA, 24 bp, synthetic construct
  misc_feature 1..24: note = Synthetic Construct
  source 1..24: mol_type = other DNA
cacgaacatcaaactgaggagcta

SEQ ID NO: 5281 - DNA, 28 bp, synthetic construct
  misc_feature 1..28: note = Synthetic Construct
  source 1..28: mol_type = other DNA
ggttgtaacggaaatacaggttcagttg

SEQ ID NO: 5282 - DNA, 21 bp, synthetic construct
  misc_feature 1..21: note = Synthetic Construct
  source 1..21: mol_type = other DNA
ctggctccaagctctttcgaa

SEQ ID NO: 5283 - DNA, 22 bp, synthetic construct
  misc_feature 1..22: note = Synthetic Construct
  source 1..22: mol_type = other DNA
aaggtctgcctggtttctatgg

SEQ ID NO: 5284 - DNA, 28 bp, synthetic construct
  misc_feature 1..28: note = Synthetic Construct
  source 1..28: mol_type = other DNA
agagtgagacttaggaatcattcattgg

SEQ ID NO: 5285 - DNA, 27 bp, synthetic construct
  misc_feature 1..27: note = Synthetic Construct
  source 1..27: mol_type = other DNA
cgctcagtttacatatatgggttagga

SEQ ID NO: 5286 - DNA, 21 bp, synthetic construct
  misc_feature 1..21: note = Synthetic Construct
  source 1..21: mol_type = other DNA
agaagtgtgcctgacgacaag

SEQ ID NO: 5287 - DNA, 22 bp, synthetic construct
  misc_feature 1..22: note = Synthetic Construct
  source 1..22: mol_type = other DNA
gagctgggggtttgtgatcata

SEQ ID NO: 5288 - DNA, 24 bp, synthetic construct
  misc_feature 1..24: note = Synthetic Construct
  source 1..24: mol_type = other DNA
ggaccaggtttctagcagtgagaa

SEQ ID NO: 5289 - DNA, 22 bp, synthetic construct
  misc_feature 1..22: note = Synthetic Construct
  source 1..22: mol_type = other DNA
gcagacctggtcaagaagacat

SEQ ID NO: 5290 - DNA, 20 bp, synthetic construct
  misc_feature 1..20: note = Synthetic Construct
  source 1..20: mol_type = other DNA
gccatggccctctgaaagca

SEQ ID NO: 5291 - DNA, 22 bp, synthetic construct
  misc_feature 1..22: note = Synthetic Construct
  source 1..22: mol_type = other DNA
ccagcgatgttcagggatgtaa

SEQ ID NO: 5292 - DNA, 22 bp, synthetic construct
  misc_feature 1..22: note = Synthetic Construct
  source 1..22: mol_type = other DNA
gtggtccttccatgacttgtga

SEQ ID NO: 5293 - DNA, 20 bp, synthetic construct
  misc_feature 1..20: note = Synthetic Construct
  source 1..20: mol_type = other DNA
aatggacccaaggccacatg

SEQ ID NO: 5294 - DNA, 21 bp, synthetic construct
  misc_feature 1..21: note = Synthetic Construct
  source 1..21: mol_type = other DNA
ctgcagggggattagggaaga

SEQ ID NO: 5295 - DNA, 25 bp, synthetic construct
  misc_feature 1..25: note = Synthetic Construct
  source 1..25: mol_type = other DNA
cgcttccacctcttttgactgattc

SEQ ID NO: 5296 - DNA, 24 bp, synthetic construct
  misc_feature 1..24: note = Synthetic Construct
  source 1..24: mol_type = other DNA
ggctggtgcagtaggaaattaacc

SEQ ID NO: 5297 - DNA, 24 bp, synthetic construct
  misc_feature 1..24: note = Synthetic Construct
  source 1..24: mol_type = other DNA
cacctaccttcagcctttttagca

SEQ ID NO: 5298 - DNA, 18 bp, synthetic construct
  misc_feature 1..18: note = Synthetic Construct
  source 1..18: mol_type = other DNA
gtaggcagcccccttcca

SEQ ID NO: 5299 - DNA, 22 bp, synthetic construct
  misc_feature 1..22: note = Synthetic Construct
  source 1..22: mol_type = other DNA
gctccttcctactggcattcct

SEQ ID NO: 5300 - DNA, 22 bp, synthetic construct
  misc_feature 1..22: note = Synthetic Construct
  source 1..22: mol_type = other DNA
ttgatgctgtgactgggagatg

SEQ ID NO: 5301 - DNA, 22 bp, synthetic construct
  misc_feature 1..22: note = Synthetic Construct
  source 1..22: mol_type = other DNA
tgggagtcttcagacctgtctt

SEQ ID NO: 5302 - DNA, 25 bp, synthetic construct
  misc_feature 1..25: note = Synthetic Construct
  source 1..25: mol_type = other DNA
cattactccaccagtgcaaatctct

SEQ ID NO: 5303 - DNA, 20 bp, synthetic construct
  misc_feature 1..20: note = Synthetic Construct
  source 1..20: mol_type = other DNA
cagcagctggcactgacaca

SEQ ID NO: 5304 - DNA, 22 bp, synthetic construct
  misc_feature 1..22: note = Synthetic Construct
  source 1..22: mol_type = other DNA
cccaatcaaggagccctgaaat

SEQ ID NO: 5305 - DNA, 27 bp, synthetic construct
  misc_feature 1..27: note = Synthetic Construct
  source 1..27: mol_type = other DNA
ccaaacaaggaggcagaaaatgtaacc

SEQ ID NO: 5306 - DNA, 21 bp, synthetic construct
  misc_feature 1..21: note = Synthetic Construct
  source 1..21: mol_type = other DNA
aaggacttctcagggcaagtg

SEQ ID NO: 5307 - DNA, 26 bp, synthetic construct
  misc_feature 1..26: note = Synthetic Construct
  source 1..26: mol_type = other DNA
cagtagctgtcaagtttttccagaag

SEQ ID NO: 5308 - DNA, 24 bp, synthetic construct
  misc_feature 1..24: note = Synthetic Construct
  source 1..24: mol_type = other DNA
gttttccccctttaccaggaatca

SEQ ID NO: 5309 - DNA, 22 bp, synthetic construct
  misc_feature 1..22: note = Synthetic Construct
  source 1..22: mol_type = other DNA
aactgccacagaactccaagag

SEQ ID NO: 5310 - DNA, 22 bp, synthetic construct
  misc_feature 1..22: note = Synthetic Construct
  source 1..22: mol_type = other DNA
ctatggggagcagcacattctt

SEQ ID NO: 5311 - DNA, 22 bp, synthetic construct
  misc_feature 1..22: note = Synthetic Construct
  source 1..22: mol_type = other DNA
gaaggaagagacatgggccatt

SEQ ID NO: 5312 - DNA, 22 bp, synthetic construct
  misc_feature 1..22: note = Synthetic Construct
  source 1..22: mol_type = other DNA
agtcccagcactaatcccaaga

SEQ ID NO: 5313 - DNA, 21 bp, synthetic construct
  misc_feature 1..21: note = Synthetic Construct
  source 1..21: mol_type = other DNA
tgaacccaggcatgtgttcga

SEQ ID NO: 5314 - DNA, 24 bp, synthetic construct
  misc_feature 1..24: note = Synthetic Construct
  source 1..24: mol_type = other DNA
ggagatagtcaccagtagcatgga

SEQ ID NO: 5315 - DNA, 26 bp, synthetic construct
  misc_feature 1..26: note = Synthetic Construct
  source 1..26: mol_type = other DNA
tggttgatagcaagtacttgaaacct

SEQ ID NO: 5316 - DNA, 25 bp, synthetic construct
  misc_feature 1..25: note = Synthetic Construct
  source 1..25: mol_type = other DNA
caattttccatttgcctgactctca

SEQ ID NO: 5317 - DNA, 23 bp, synthetic construct
  misc_feature 1..23: note = Synthetic Construct
  source 1..23: mol_type = other DNA
ggtcaggaccaagagtggacata

SEQ ID NO: 5318 - DNA, 19 bp, synthetic construct
  misc_feature 1..19: note = Synthetic Construct
  source 1..19: mol_type = other DNA
gggtgagtcccgtgtaggt

SEQ ID NO: 5319 - DNA, 26 bp, synthetic construct
  misc_feature 1..26: note = Synthetic Construct
  source 1..26: mol_type = other DNA
ccttgtgctagacatgaagcaagatc

SEQ ID NO: 5320 - DNA, 27 bp, synthetic construct
  misc_feature 1..27: note = Synthetic Construct
  source 1..27: mol_type = other DNA
ggatgtttttctcaccactatttccat

SEQ ID NO: 5321 - DNA, 25 bp, synthetic construct
  misc_feature 1..25: note = Synthetic Construct
  source 1..25: mol_type = other DNA
gctgaccatttggcttcttggtttc

SEQ ID NO: 5322 - DNA, 26 bp, synthetic construct
  misc_feature 1..26: note = Synthetic Construct
  source 1..26: mol_type = other DNA
gacacttaatacacactgtccggatt

SEQ ID NO: 5323 - DNA, 20 bp, synthetic construct
  misc_feature 1..20: note = Synthetic Construct
  source 1..20: mol_type = other DNA
cgaggcaggaggtacacatc

SEQ ID NO: 5324 - DNA, 29 bp, synthetic construct
  misc_feature 1..29: note = Synthetic Construct
  source 1..29: mol_type = other DNA
ccaatttagcacgtttcaaactggatttt

SEQ ID NO: 5325 - DNA, 22 bp, synthetic construct
  misc_feature 1..22: note = Synthetic Construct
  source 1..22: mol_type = other DNA
cagtaagtgcacagtccttgct

SEQ ID NO: 5326 - DNA, 23 bp, synthetic construct
  misc_feature 1..23: note = Synthetic Construct
  source 1..23: mol_type = other DNA
cgagatggatcctcgagtctttc

SEQ ID NO: 5327 - DNA, 24 bp, synthetic construct
  misc_feature 1..24: note = Synthetic Construct
  source 1..24: mol_type = other DNA
ggaatcattgtgtcccaggaattg

SEQ ID NO: 5328 - DNA, 22 bp, synthetic construct
  misc_feature 1..22: note = Synthetic Construct
  source 1..22: mol_type = other DNA
gcacagactgcacagatacact

SEQ ID NO: 5329 - DNA, 19 bp, synthetic construct
  misc_feature 1..19: note = Synthetic Construct
  source 1..19: mol_type = other DNA
ccctgcagggttgcttagg

SEQ ID NO: 5330 - DNA, 23 bp, synthetic construct
  misc_feature 1..23: note = Synthetic Construct
  source 1..23: mol_type = other DNA
tggggaaggtatctgtggtacct

SEQ ID NO: 5331 - DNA, 20 bp, synthetic construct
  misc_feature 1..20: note = Synthetic Construct
  source 1..20: mol_type = other DNA
accccaagaagcaccttcca

SEQ ID NO: 5332 - DNA, 22 bp, synthetic construct
  misc_feature 1..22: note = Synthetic Construct
  source 1..22: mol_type = other DNA
aagtccttgctgctggagaaga

SEQ ID NO: 5333 - DNA, 21 bp, synthetic construct
  misc_feature 1..21: note = Synthetic Construct
  source 1..21: mol_type = other DNA
ctgctgagcagtggtactgtt

SEQ ID NO: 5334 - DNA, 21 bp, synthetic construct
  misc_feature 1..21: note = Synthetic Construct
  source 1..21: mol_type = other DNA
agcaactgaacagcccattcc

SEQ ID NO: 5335 - DNA, 23 bp, synthetic construct
  misc_feature 1..23: note = Synthetic Construct
  source 1..23: mol_type = other DNA
gcagtttccccttccaaattcac

SEQ ID NO: 5336 - DNA, 19 bp, synthetic construct
  misc_feature 1..19: note = Synthetic Construct
  source 1..19: mol_type = other DNA
gggtcccagggggctgtaa

SEQ ID NO: 5337 - DNA, 21 bp, synthetic construct
  misc_feature 1..21: note = Synthetic Construct
  source 1..21: mol_type = other DNA
cccagacaagaacaccagctt

SEQ ID NO: 5338 - DNA, 18 bp, synthetic construct
  misc_feature 1..18: note = Synthetic Construct
  source 1..18: mol_type = other DNA
agctctggggtcgttgga

SEQ ID NO: 5339 - DNA, 25 bp, synthetic construct
  misc_feature 1..25: note = Synthetic Construct
  source 1..25: mol_type = other DNA
cttgggtggtctgaaaaatgtaggt

SEQ ID NO: 5340 - DNA, 24 bp, synthetic construct
  misc_feature 1..24: note = Synthetic Construct
  source 1..24: mol_type = other DNA
ccagctacctaggaccaagtcata

SEQ ID NO: 5341 - DNA, 26 bp, synthetic construct
  misc_feature 1..26: note = Synthetic Construct
  source 1..26: mol_type = other DNA
agtcccatatccagctgattttaacc

SEQ ID NO: 5342 - DNA, 23 bp, synthetic construct
  misc_feature 1..23: note = Synthetic Construct
  source 1..23: mol_type = other DNA
cgccttacagtccctacttcttc

SEQ ID NO: 5343 - DNA, 20 bp, synthetic construct
  misc_feature 1..20: note = Synthetic Construct
  source 1..20: mol_type = other DNA
catgggagccaacagtcagt

SEQ ID NO: 5344 - DNA, 24 bp, synthetic construct
  misc_feature 1..24: note = Synthetic Construct
  source 1..24: mol_type = other DNA
tttgaaatgaggaccacggtactt

SEQ ID NO: 5345 - DNA, 20 bp, synthetic construct
  misc_feature 1..20: note = Synthetic Construct
  source 1..20: mol_type = other DNA
tgcatggaggatggggaagt

SEQ ID NO: 5346 - DNA, 23 bp, synthetic construct
  misc_feature 1..23: note = Synthetic Construct
  source 1..23: mol_type = other DNA
caccgacaaaccttcccctcttt

SEQ ID NO: 5347 - DNA, 25 bp, synthetic construct
  misc_feature 1..25: note = Synthetic Construct
  source 1..25: mol_type = other DNA
cagggaaagtgctgagtcattttca

SEQ ID NO: 5348 - DNA, 25 bp, synthetic construct
  misc_feature 1..25: note = Synthetic Construct
  source 1..25: mol_type = other DNA
gaagagaagcaggtcactgaagtct

SEQ ID NO: 5349 - DNA, 24 bp, synthetic construct
  misc_feature 1..24: note = Synthetic Construct
  source 1..24: mol_type = other DNA
gcttaagaaaccaggggccataac

SEQ ID NO: 5350 - DNA, 22 bp, synthetic construct
  misc_feature 1..22: note = Synthetic Construct
  source 1..22: mol_type = other DNA
gggcttgaaaaacctgggtgtt

SEQ ID NO: 5351 - DNA, 22 bp, synthetic construct
  misc_feature 1..22: note = Synthetic Construct
  source 1..22: mol_type = other DNA
gcgctttatggtgtccatacct

SEQ ID NO: 5352 - DNA, 25 bp, synthetic construct
  misc_feature 1..25: note = Synthetic Construct
  source 1..25: mol_type = other DNA
gcatttcctaggactttctgtttgc

SEQ ID NO: 5353 - DNA, 20 bp, synthetic construct
  misc_feature 1..20: note = Synthetic Construct
  source 1..20: mol_type = other DNA
tgtgctcatggaggctccta

SEQ ID NO: 5354 - DNA, 22 bp, synthetic construct
  misc_feature 1..22: note = Synthetic Construct
  source 1..22: mol_type = other DNA
gtctcccatctctggtctctgt

SEQ ID NO: 5355 - DNA, 24 bp, synthetic construct
  misc_feature 1..24: note = Synthetic Construct
  source 1..24: mol_type = other DNA
gtctgttcaggcttttgctttttg

SEQ ID NO: 5356 - DNA, 21 bp, synthetic construct
  misc_feature 1..21: note = Synthetic Construct
  source 1..21: mol_type = other DNA
agggatgacagagcccaagta

SEQ ID NO: 5357 - DNA, 24 bp, synthetic construct
  misc_feature 1..24: note = Synthetic Construct
  source 1..24: mol_type = other DNA
ggaggaatggtttctgaggagctt

SEQ ID NO: 5358 - DNA, 21 bp, synthetic construct
  misc_feature 1..21: note = Synthetic Construct
  source 1..21: mol_type = other DNA
tgcccagtgaggtccaacagt

SEQ ID NO: 5359 - DNA, 22 bp, synthetic construct
  misc_feature 1..22: note = Synthetic Construct
  source 1..22: mol_type = other DNA
acactggctctggaacaatgag

SEQ ID NO: 5360 - DNA, 22 bp, synthetic construct
  misc_feature 1..22: note = Synthetic Construct
  source 1..22: mol_type = other DNA
tgaggttagttagggccaaagc

SEQ ID NO: 5361 - DNA, 21 bp, synthetic construct
  misc_feature 1..21: note = Synthetic Construct
  source 1..21: mol_type = other DNA
cgagtttgggcaggcataagc

SEQ ID NO: 5362 - DNA, 21 bp, synthetic construct
  misc_feature 1..21: note = Synthetic Construct
  source 1..21: mol_type = other DNA
ccgtccacctacatcatgctt

SEQ ID NO: 5363 - DNA, 23 bp, synthetic construct
  misc_feature 1..23: note = Synthetic Construct
  source 1..23: mol_type = other DNA
gtgtttcgtggcttaacgtaagg

SEQ ID NO: 5364 - DNA, 25 bp, synthetic construct
  misc_feature 1..25: note = Synthetic Construct
  source 1..25: mol_type = other DNA
catgaggtctatctgtcttcttgct

SEQ ID NO: 5365 - DNA, 22 bp, synthetic construct
  misc_feature 1..22: note = Synthetic Construct
  source 1..22: mol_type = other DNA
gtgtgggccaaaggttgtagaa

SEQ ID NO: 5366 - DNA, 24 bp, synthetic construct
  misc_feature 1..24: note = Synthetic Construct
  source 1..24: mol_type = other DNA
acaggaacttcccacctgatcttc

SEQ ID NO: 5367 - DNA, 22 bp, synthetic construct
  misc_feature 1..22: note = Synthetic Construct
  source 1..22: mol_type = other DNA
acatgcaagatggcctcattca

SEQ ID NO: 5368 - DNA, 24 bp, synthetic construct
  misc_feature 1..24: note = Synthetic Construct
  source 1..24: mol_type = other DNA
cctttagggcccttagacaccttt

SEQ ID NO: 5369 - DNA, 24 bp, synthetic construct
  misc_feature 1..24: note = Synthetic Construct
  source 1..24: mol_type = other DNA
gaggctaaggacattgtacactgt

SEQ ID NO: 5370 - DNA, 24 bp, synthetic construct
  misc_feature 1..24: note = Synthetic Construct
  source 1..24: mol_type = other DNA
gcatcataggggcttagaggttgt

SEQ ID NO: 5371 - DNA, 20 bp, synthetic construct
  misc_feature 1..20: note = Synthetic Construct
  source 1..20: mol_type = other DNA
aggcctccacccctacttct

SEQ ID NO: 5372 - DNA, 23 bp, synthetic construct
  misc_feature 1..23: note = Synthetic Construct
  source 1..23: mol_type = other DNA
cttatagtgaggcaagccctgtt

SEQ ID NO: 5373 - DNA, 20 bp, synthetic construct
  misc_feature 1..20: note = Synthetic Construct
  source 1..20: mol_type = other DNA
aaggggaggggtgggagaaa

SEQ ID NO: 5374 - DNA, 25 bp, synthetic construct
  misc_feature 1..25: note = Synthetic Construct
  source 1..25: mol_type = other DNA
cacctgtcccttgttcagtaatgag

SEQ ID NO: 5375 - DNA, 28 bp, synthetic construct
  misc_feature 1..28: note = Synthetic Construct
  source 1..28: mol_type = other DNA
ggtgatacttagtaggaagcactgcttt

SEQ ID NO: 5376 - DNA, 24 bp, synthetic construct
  misc_feature 1..24: note = Synthetic Construct
  source 1..24: mol_type = other DNA
cttagctctcatgcccctacatag

SEQ ID NO: 5377 - DNA, 21 bp, synthetic construct
  misc_feature 1..21: note = Synthetic Construct
  source 1..21: mol_type = other DNA
caagcggggatgtcaagaaac

SEQ ID NO: 5378 - DNA, 21 bp, synthetic construct
  misc_feature 1..21: note = Synthetic Construct
  source 1..21: mol_type = other DNA
accctcactcccttcaaccaa

SEQ ID NO: 5379 - DNA, 30 bp, synthetic construct
  misc_feature 1..30: note = Synthetic Construct
  source 1..30: mol_type = other DNA
tgaatggttataacgacataatctgacact

SEQ ID NO: 5380 - DNA, 23 bp, synthetic construct
  misc_feature 1..23: note = Synthetic Construct
  source 1..23: mol_type = other DNA
tggaagtgggagtagagggtaag

SEQ ID NO: 5381 - DNA, 21 bp, synthetic construct
  misc_feature 1..21: note = Synthetic Construct
  source 1..21: mol_type = other DNA
aaggccaggattccagtgaag

SEQ ID NO: 5382 - DNA, 25 bp, synthetic construct
  misc_feature 1..25: note = Synthetic Construct
  source 1..25: mol_type = other DNA
acctaagggaaatgggagtttgaat

SEQ ID NO: 5383 - DNA, 20 bp, synthetic construct
  misc_feature 1..20: note = Synthetic Construct
  source 1..20: mol_type = other DNA
tgccccaccccatcaagact

SEQ ID NO: 5384 - DNA, 20 bp, synthetic construct
  misc_feature 1..20: note = Synthetic Construct
  source 1..20: mol_type = other DNA
aggagtcccttgcactgttg

SEQ ID NO: 5385 - DNA, 21 bp, synthetic construct
  misc_feature 1..21: note = Synthetic Construct
  source 1..21: mol_type = other DNA
acgctcataggtcacctgtct

SEQ ID NO: 5386 - DNA, 22 bp, synthetic construct
  misc_feature 1..22: note = Synthetic Construct
  source 1..22: mol_type = other DNA
gggcttccactggtagacaaga

SEQ ID NO: 5387 - DNA, 19 bp, synthetic construct
  misc_feature 1..19: note = Synthetic Construct
  source 1..19: mol_type = other DNA
ggcccgaaatggtgcttct

SEQ ID NO: 5388 - DNA, 20 bp, synthetic construct
  misc_feature 1..20: note = Synthetic Construct
  source 1..20: mol_type = other DNA
aatgtgagcctggggattgg

SEQ ID NO: 5389 - DNA, 26 bp, synthetic construct
  misc_feature 1..26: note = Synthetic Construct
  source 1..26: mol_type = other DNA
ggatgggatcatcaactcaaatgcaa

SEQ ID NO: 5390 - DNA, 22 bp, synthetic construct
  misc_feature 1..22: note = Synthetic Construct
  source 1..22: mol_type = other DNA
acctagcaatgagacagcaaca

SEQ ID NO: 5391 - DNA, 20 bp, synthetic construct
  misc_feature 1..20: note = Synthetic Construct
  source 1..20: mol_type = other DNA
acagcttcagtggctttgca

SEQ ID NO: 5392 - DNA, 26 bp, synthetic construct
  misc_feature 1..26: note = Synthetic Construct
  source 1..26: mol_type = other DNA
ggctgattcagacttatctagcatga

SEQ ID NO: 5393 - DNA, 24 bp, synthetic construct
  misc_feature 1..24: note = Synthetic Construct
  source 1..24: mol_type = other DNA
gcacaacatggactattgggtgtt

SEQ ID NO: 5394 - DNA, 22 bp, synthetic construct
  misc_feature 1..22: note = Synthetic Construct
  source 1..22: mol_type = other DNA
tcttctcccaatccctgcaact

SEQ ID NO: 5395 - DNA, 20 bp, synthetic construct
  misc_feature 1..20: note = Synthetic Construct
  source 1..20: mol_type = other DNA
ccagagctggccacactaag

SEQ ID NO: 5396 - DNA, 22 bp, synthetic construct
  misc_feature 1..22: note = Synthetic Construct
  source 1..22: mol_type = other DNA
ttgagttcccacctgtctgttc

SEQ ID NO: 5397 - DNA, 23 bp, synthetic construct
  misc_feature 1..23: note = Synthetic Construct
  source 1..23: mol_type = other DNA
ctcatctgctattgtcccaacct

SEQ ID NO: 5398 - DNA, 23 bp, synthetic construct
  misc_feature 1..23: note = Synthetic Construct
  source 1..23: mol_type = other DNA
ggatggagaatgtgggaatcgaa

SEQ ID NO: 5399 - DNA, 24 bp, synthetic construct
  misc_feature 1..24: note = Synthetic Construct
  source 1..24: mol_type = other DNA
gcaatggcaggtgtgatggtagaa

SEQ ID NO: 5400 - DNA, 21 bp, synthetic construct
  misc_feature 1..21: note = Synthetic Construct
  source 1..21: mol_type = other DNA
aggttgttagcagggctgtga

SEQ ID NO: 5401 - DNA, 22 bp, synthetic construct
  misc_feature 1..22: note = Synthetic Construct
  source 1..22: mol_type = other DNA
catcatggcagggattcaggtt

SEQ ID NO: 5402 - DNA, 28 bp, synthetic construct
  misc_feature 1..28: note = Synthetic Construct
  source 1..28: mol_type = other DNA
aagaaaccatcttttaagtgttgggaat

SEQ ID NO: 5403 - DNA, 26 bp, synthetic construct
  misc_feature 1..26: note = Synthetic Construct
  source 1..26: mol_type = other DNA
cctgtgagtgtggttgtaacaagaga

SEQ ID NO: 5404 - DNA, 22 bp, synthetic construct
  misc_feature 1..22: note = Synthetic Construct
  source 1..22: mol_type = other DNA
ttccccaaatctggcagaagga

SEQ ID NO: 5405 - DNA, 21 bp, synthetic construct
  misc_feature 1..21: note = Synthetic Construct
  source 1..21: mol_type = other DNA
tcccttcactctccccctcta

SEQ ID NO: 5406 - DNA, 20 bp, synthetic construct
  misc_feature 1..20: note = Synthetic Construct
  source 1..20: mol_type = other DNA
ggagagggccatgtgacaag

SEQ ID NO: 5407 - DNA, 22 bp, synthetic construct
  misc_feature 1..22: note = Synthetic Construct
  source 1..22: mol_type = other DNA
agctgttttccccaaagtgcta

SEQ ID NO: 5408 - DNA, 21 bp, synthetic construct
  misc_feature 1..21: note = Synthetic Construct
  source 1..21: mol_type = other DNA
gccagctgggtttcattggaa

SEQ ID NO: 5409 - DNA, 24 bp, synthetic construct
  misc_feature 1..24: note = Synthetic Construct
  source 1..24: mol_type = other DNA
gatgaagtgggatgtaggcaatga

SEQ ID NO: 5410 - DNA, 24 bp, synthetic construct
  misc_feature 1..24: note = Synthetic Construct
  source 1..24: mol_type = other DNA
aacggccaaatagaacatgtagga

SEQ ID NO: 5411 - DNA, 23 bp, synthetic construct
  misc_feature 1..23: note = Synthetic Construct
  source 1..23: mol_type = other DNA
gggaccaaagtctgtcacaatga

SEQ ID NO: 5412 - DNA, 24 bp, synthetic construct
  misc_feature 1..24: note = Synthetic Construct
  source 1..24: mol_type = other DNA
gcagtgggctttccaaactgaaga

SEQ ID NO: 5413 - DNA, 22 bp, synthetic construct
  misc_feature 1..22: note = Synthetic Construct
  source 1..22: mol_type = other DNA
tggtggctgatacatggcaagt

SEQ ID NO: 5414 - DNA, 27 bp, synthetic construct
  misc_feature 1..27: note = Synthetic Construct
  source 1..27: mol_type = other DNA
cctctcccctgtatctactcaaatagc

SEQ ID NO: 5415 - DNA, 22 bp, synthetic construct
  misc_feature 1..22: note = Synthetic Construct
  source 1..22: mol_type = other DNA
gagagaaggggacactgactca

SEQ ID NO: 5416 - DNA, 21 bp, synthetic construct
  misc_feature 1..21: note = Synthetic Construct
  source 1..21: mol_type = other DNA
acaaggagcccatgtctttgc

SEQ ID NO: 5417 - DNA, 22 bp, synthetic construct
  misc_feature 1..22: note = Synthetic Construct
  source 1..22: mol_type = other DNA
tggaacacagtgggagtcagta

SEQ ID NO: 5418 - DNA, 24 bp, synthetic construct
  misc_feature 1..24: note = Synthetic Construct
  source 1..24: mol_type = other DNA
tccatctgtcaaggtgccatattt

SEQ ID NO: 5419 - DNA, 19 bp, synthetic construct
  misc_feature 1..19: note = Synthetic Construct
  source 1..19: mol_type = other DNA
acccacccactcactccat

SEQ ID NO: 5420 - DNA, 22 bp, synthetic construct
  misc_feature 1..22: note = Synthetic Construct
  source 1..22: mol_type = other DNA
aagccttggtgccctacttaga

SEQ ID NO: 5421 - DNA, 24 bp, synthetic construct
  misc_feature 1..24: note = Synthetic Construct
  source 1..24: mol_type = other DNA
gtgtgatgtgatgtgatccacaag

SEQ ID NO: 5422 - DNA, 24 bp, synthetic construct
  misc_feature 1..24: note = Synthetic Construct
  source 1..24: mol_type = other DNA
gacttccagttagaagcccacctt

SEQ ID NO: 5423 - DNA, 22 bp, synthetic construct
  misc_feature 1..22: note = Synthetic Construct
  source 1..22: mol_type = other DNA
tcccagggccaaactctgagaa

SEQ ID NO: 5424 - DNA, 23 bp, synthetic construct
  misc_feature 1..23: note = Synthetic Construct
  source 1..23: mol_type = other DNA
ctgtgttcaggtacaggtctgaa

SEQ ID NO: 5425 - DNA, 21 bp, synthetic construct
  misc_feature 1..21: note = Synthetic Construct
  source 1..21: mol_type = other DNA
gctacccatgccactgggaaa

SEQ ID NO: 5426 - DNA, 24 bp, synthetic construct
  misc_feature 1..24: note = Synthetic Construct
  source 1..24: mol_type = other DNA
agttaggtgtgtcagcttttcaca

SEQ ID NO: 5427 - DNA, 25 bp, synthetic construct
  misc_feature 1..25: note = Synthetic Construct
  source 1..25: mol_type = other DNA
gcatccccttcagaatcatgaatcg

SEQ ID NO: 5428 - DNA, 20 bp, synthetic construct
  misc_feature 1..20: note = Synthetic Construct
  source 1..20: mol_type = other DNA
gcacaggccgtcttcatgga

SEQ ID NO: 5429 - DNA, 21 bp, synthetic construct
  misc_feature 1..21: note = Synthetic Construct
  source 1..21: mol_type = other DNA
caccgcccaacttgattcagt

SEQ ID NO: 5430 - DNA, 19 bp, synthetic construct
  misc_feature 1..19: note = Synthetic Construct
  source 1..19: mol_type = other DNA
aggccaggacaaggtgtgt

SEQ ID NO: 5431 - DNA, 26 bp, synthetic construct
  misc_feature 1..26: note = Synthetic Construct
  source 1..26: mol_type = other DNA
ggactcgaggaatggacattcatctg

SEQ ID NO: 5432 - DNA, 25 bp, synthetic construct
  misc_feature 1..25: note = Synthetic Construct
  source 1..25: mol_type = other DNA
ctttgggagactgggtaacttttgc

SEQ ID NO: 5433 - DNA, 23 bp, synthetic construct
  misc_feature 1..23: note = Synthetic Construct
  source 1..23: mol_type = other DNA
agggacctctatgactcctacac

SEQ ID NO: 5434 - DNA, 21 bp, synthetic construct
  misc_feature 1..21: note = Synthetic Construct
  source 1..21: mol_type = other DNA
ggtttgtgtgacaggcattcc

SEQ ID NO: 5435 - DNA, 24 bp, synthetic construct
  misc_feature 1..24: note = Synthetic Construct
  source 1..24: mol_type = other DNA
ctccctcaatccaggatgttcttc

SEQ ID NO: 5436 - DNA, 24 bp, synthetic construct
  misc_feature 1..24: note = Synthetic Construct
  source 1..24: mol_type = other DNA
gcaggtcatcctttctccttctac

SEQ ID NO: 5437 - DNA, 24 bp, synthetic construct
  misc_feature 1..24: note = Synthetic Construct
  source 1..24: mol_type = other DNA
tgtccctgagtctgagttttgttg

SEQ ID NO: 5438 - DNA, 25 bp, synthetic construct
  misc_feature 1..25: note = Synthetic Construct
  source 1..25: mol_type = other DNA
tgatgagtggaagaagatgcaaaga

SEQ ID NO: 5439 - DNA, 23 bp, synthetic construct
  misc_feature 1..23: note = Synthetic Construct
  source 1..23: mol_type = other DNA
gcaacttccctaaatccctccaa

SEQ ID NO: 5440 - DNA, 27 bp, synthetic construct
  misc_feature 1..27: note = Synthetic Construct
  source 1..27: mol_type = other DNA
gctccaaatatctgaagagctcatgtg

SEQ ID NO: 5441 - DNA, 22 bp, synthetic construct
  misc_feature 1..22: note = Synthetic Construct
  source 1..22: mol_type = other DNA
ctgacttcccctaggagtccat

SEQ ID NO: 5442 - DNA, 22 bp, synthetic construct
  misc_feature 1..22: note = Synthetic Construct
  source 1..22: mol_type = other DNA
ctgtctgctggcattcagttca

SEQ ID NO: 5443 - DNA, 22 bp, synthetic construct
  misc_feature 1..22: note = Synthetic Construct
  source 1..22: mol_type = other DNA
gcattgtgagctctccaaaggt

SEQ ID NO: 5444 - DNA, 20 bp, synthetic construct
  misc_feature 1..20: note = Synthetic Construct
  source 1..20: mol_type = other DNA
ccagctctggcacctagaga

SEQ ID NO: 5445 - DNA, 27 bp, synthetic construct
  misc_feature 1..27: note = Synthetic Construct
  source 1..27: mol_type = other DNA
gggtacaagctcaagttagaagtacag

SEQ ID NO: 5446 - DNA, 27 bp, synthetic construct
  misc_feature 1..27: note = Synthetic Construct
  source 1..27: mol_type = other DNA
ggtaagacagttttccctactcttctc

SEQ ID NO: 5447 - DNA, 22 bp, synthetic construct
  misc_feature 1..22: note = Synthetic Construct
  source 1..22: mol_type = other DNA
tgatggcagagcaaaccacaaa

SEQ ID NO: 5448 - DNA, 20 bp, synthetic construct
  misc_feature 1..20: note = Synthetic Construct
  source 1..20: mol_type = other DNA
caggggcctcacacttgcat

SEQ ID NO: 5449 - DNA, 21 bp, synthetic construct
  misc_feature 1..21: note = Synthetic Construct
  source 1..21: mol_type = other DNA
agctgcagtggttggaattgg

SEQ ID NO: 5450 - DNA, 22 bp, synthetic construct
  misc_feature 1..22: note = Synthetic Construct
  source 1..22: mol_type = other DNA
acagggtgaggagactttctga

SEQ ID NO: 5451 - DNA, 26 bp, synthetic construct
  misc_feature 1..26: note = Synthetic Construct
  source 1..26: mol_type = other DNA
cggcaagaacatcagctatgttaacc

SEQ ID NO: 5452 - DNA, 26 bp, synthetic construct
  misc_feature 1..26: note = Synthetic Construct
  source 1..26: mol_type = other DNA
gccccagatcctagaaagagaatgtg

SEQ ID NO: 5453 - DNA, 23 bp, synthetic construct
  misc_feature 1..23: note = Synthetic Construct
  source 1..23: mol_type = other DNA
tgagttgagagcctcagacttct

SEQ ID NO: 5454 - DNA, 20 bp, synthetic construct
  misc_feature 1..20: note = Synthetic Construct
  source 1..20: mol_type = other DNA
agagccctctacccctctct

SEQ ID NO: 5455 - DNA, 24 bp, synthetic construct
  misc_feature 1..24: note = Synthetic Construct
  source 1..24: mol_type = other DNA
accaagaaggacactgaggttcac

SEQ ID NO: 5456 - DNA, 21 bp, synthetic construct
  misc_feature 1..21: note = Synthetic Construct
  source 1..21: mol_type = other DNA
actgtcccctctgcatggtat

SEQ ID NO: 5457 - DNA, 21 bp, synthetic construct
  misc_feature 1..21: note = Synthetic Construct
  source 1..21: mol_type = other DNA
ttggctgctggggagcattta

SEQ ID NO: 5458 - DNA, 22 bp, synthetic construct
  misc_feature 1..22: note = Synthetic Construct
  source 1..22: mol_type = other DNA
aggacaggacagagcttttgag

SEQ ID NO: 5459 - DNA, 26 bp, synthetic construct
  misc_feature 1..26: note = Synthetic Construct
  source 1..26: mol_type = other DNA
tgtgcattcatagaggtgaggataaa

SEQ ID NO: 5460 - DNA, 21 bp, synthetic construct
  misc_feature 1..21: note = Synthetic Construct
  source 1..21: mol_type = other DNA
ttgggcatgaacagcctacct

SEQ ID NO: 5461 - DNA, 24 bp, synthetic construct
  misc_feature 1..24: note = Synthetic Construct
  source 1..24: mol_type = other DNA
gcagcagatggcacaatgtaaagg

SEQ ID NO: 5462 - DNA, 28 bp, synthetic construct
  misc_feature 1..28: note = Synthetic Construct
  source 1..28: mol_type = other DNA
gtggaatccattatagggtgtgatacct

SEQ ID NO: 5463 - DNA, 22 bp, synthetic construct
  misc_feature 1..22: note = Synthetic Construct
  source 1..22: mol_type = other DNA
tcagagcgtgctggctatgtta

SEQ ID NO: 5464 - DNA, 25 bp, synthetic construct
  misc_feature 1..25: note = Synthetic Construct
  source 1..25: mol_type = other DNA
gcacagaactgttcagctagaggat

SEQ ID NO: 5465 - DNA, 22 bp, synthetic construct
  misc_feature 1..22: note = Synthetic Construct
  source 1..22: mol_type = other DNA
ccctcatctccagatggcagaa

SEQ ID NO: 5466 - DNA, 25 bp, synthetic construct
  misc_feature 1..25: note = Synthetic Construct
  source 1..25: mol_type = other DNA
gtcccagtgatctgttagagaaagg

SEQ ID NO: 5467 - DNA, 26 bp, synthetic construct
  misc_feature 1..26: note = Synthetic Construct
  source 1..26: mol_type = other DNA
gccccaatcctagctaatcaggatca

SEQ ID NO: 5468 - DNA, 24 bp, synthetic construct
  misc_feature 1..24: note = Synthetic Construct
  source 1..24: mol_type = other DNA
ccctactgtgtggcaatgaagaga

SEQ ID NO: 5469 - DNA, 25 bp, synthetic construct
  misc_feature 1..25: note = Synthetic Construct
  source 1..25: mol_type = other DNA
agctatggcagaattatcactgctt

SEQ ID NO: 5470 - DNA, 24 bp, synthetic construct
  misc_feature 1..24: note = Synthetic Construct
  source 1..24: mol_type = other DNA
gcgcacttctctctcaaacacact

SEQ ID NO: 5471 - DNA, 19 bp, synthetic construct
  misc_feature 1..19: note = Synthetic Construct
  source 1..19: mol_type = other DNA
ggcctggaagacggggttt

SEQ ID NO: 5472 - DNA, 30 bp, synthetic construct
  misc_feature 1..30: note = Synthetic Construct
  source 1..30: mol_type = other DNA
tgtctgataattacaacatctgtgtcatct

SEQ ID NO: 5473 - DNA, 21 bp, synthetic construct
  misc_feature 1..21: note = Synthetic Construct
  source 1..21: mol_type = other DNA
agtggctgtggtggaaatcca

SEQ ID NO: 5474 - DNA, 21 bp, synthetic construct
  misc_feature 1..21: note = Synthetic Construct
  source 1..21: mol_type = other DNA
aaacgaggctcttgggaatgg

SEQ ID NO: 5475 - DNA, 23 bp, synthetic construct
  misc_feature 1..23: note = Synthetic Construct
  source 1..23: mol_type = other DNA
tgtatgtggactgcaaggttagg

SEQ ID NO: 5476 - DNA, 20 bp, synthetic construct
  misc_feature 1..20: note = Synthetic Construct
  source 1..20: mol_type = other DNA
cctccctgaagcccaacaca

SEQ ID NO: 5477 - DNA, 26 bp, synthetic construct
  misc_feature 1..26: note = Synthetic Construct
  source 1..26: mol_type = other DNA
ggtttttgtttgatctcacctggaaa

SEQ ID NO: 5478 - DNA, 19 bp, synthetic construct
  misc_feature 1..19: note = Synthetic Construct
  source 1..19: mol_type = other DNA
aaggcaggcctcagaagca

SEQ ID NO: 5479 - DNA, 19 bp, synthetic construct
  misc_feature 1..19: note = Synthetic Construct
  source 1..19: mol_type = other DNA
tggggagtgcagggagaga

SEQ ID NO: 5480 - DNA, 24 bp, synthetic construct
  misc_feature 1..24: note = Synthetic Construct
  source 1..24: mol_type = other DNA
ctgatttacaccccgtgtaatgga

SEQ ID NO: 5481 - DNA, 19 bp, synthetic construct
  misc_feature 1..19: note = Synthetic Construct
  source 1..19: mol_type = other DNA
ccaccaagaggcccaatgc

SEQ ID NO: 5482 - DNA, 26 bp, synthetic construct
  misc_feature 1..26: note = Synthetic Construct
  source 1..26: mol_type = other DNA
ctgagatgtgtgagaggagatatgtg

SEQ ID NO: 5483 - DNA, 19 bp, synthetic construct
  misc_feature 1..19: note = Synthetic Construct
  source 1..19: mol_type = other DNA
tggagagggctggcaatct

SEQ ID NO: 5484 - DNA, 29 bp, synthetic construct
  misc_feature 1..29: note = Synthetic Construct
  source 1..29: mol_type = other DNA
gctacaaataatctggattcctgacatca

SEQ ID NO: 5485 - DNA, 21 bp, synthetic construct
  misc_feature 1..21: note = Synthetic Construct
  source 1..21: mol_type = other DNA
tctggaagctctcccctatgc

SEQ ID NO: 5486 - DNA, 21 bp, synthetic construct
  misc_feature 1..21: note = Synthetic Construct
  source 1..21: mol_type = other DNA
gagcccccagcattcagtgtt

SEQ ID NO: 5487 - DNA, 22 bp, synthetic construct
  misc_feature 1..22: note = Synthetic Construct
  source 1..22: mol_type = other DNA
tttgctcctgggtgaagcaaga

SEQ ID NO: 5488 - DNA, 22 bp, synthetic construct
  misc_feature 1..22: note = Synthetic Construct
  source 1..22: mol_type = other DNA
ggggccaatcaggaaattccat

SEQ ID NO: 5489 - DNA, 22 bp, synthetic construct
  misc_feature 1..22: note = Synthetic Construct
  source 1..22: mol_type = other DNA
ctcatctgagggcttgaaacct

SEQ ID NO: 5490 - DNA, 20 bp, synthetic construct
  misc_feature 1..20: note = Synthetic Construct
  source 1..20: mol_type = other DNA
aggcaggggaaacagaacca

SEQ ID NO: 5491 - DNA, 24 bp, synthetic construct
  misc_feature 1..24: note = Synthetic Construct
  source 1..24: mol_type = other DNA
gtgctacagtagagacctgggaaa

SEQ ID NO: 5492 - DNA, 19 bp, synthetic construct
  misc_feature 1..19: note = Synthetic Construct
  source 1..19: mol_type = other DNA
tgctcccgggagtccattg

SEQ ID NO: 5493 - DNA, 26 bp, synthetic construct
  misc_feature 1..26: note = Synthetic Construct
  source 1..26: mol_type = other DNA
cactaggatgtttatcactgccatca

SEQ ID NO: 5494 - DNA, 23 bp, synthetic construct
  misc_feature 1..23: note = Synthetic Construct
  source 1..23: mol_type = other DNA
gcagggagccatctgaaggtact

SEQ ID NO: 5495 - DNA, 21 bp, synthetic construct
  misc_feature 1..21: note = Synthetic Construct
  source 1..21: mol_type = other DNA
tggaaggggatgatggagtgt

SEQ ID NO: 5496 - DNA, 22 bp, synthetic construct
  misc_feature 1..22: note = Synthetic Construct
  source 1..22: mol_type = other DNA
ctgccacaggacactcaaattg

SEQ ID NO: 5497 - DNA, 24 bp, synthetic construct
  misc_feature 1..24: note = Synthetic Construct
  source 1..24: mol_type = other DNA
aggtctcaccagacacagattcca

SEQ ID NO: 5498 - DNA, 21 bp, synthetic construct
  misc_feature 1..21: note = Synthetic Construct
  source 1..21: mol_type = other DNA
tgcctgggacttcagctagca

SEQ ID NO: 5499 - DNA, 24 bp, synthetic construct
  misc_feature 1..24: note = Synthetic Construct
  source 1..24: mol_type = other DNA
cactgctttattgtgtccagttgt

SEQ ID NO: 5500 - DNA, 23 bp, synthetic construct
  misc_feature 1..23: note = Synthetic Construct
  source 1..23: mol_type = other DNA
gggtggcaaagctacaaaggaat

SEQ ID NO: 5501 - DNA, 22 bp, synthetic construct
  misc_feature 1..22: note = Synthetic Construct
  source 1..22: mol_type = other DNA
gcaatggccacgtcaatatcct

SEQ ID NO: 5502 - DNA, 20 bp, synthetic construct
  misc_feature 1..20: note = Synthetic Construct
  source 1..20: mol_type = other DNA
agacccgaagcacgtggtat

SEQ ID NO: 5503 - DNA, 22 bp, synthetic construct
  misc_feature 1..22: note = Synthetic Construct
  source 1..22: mol_type = other DNA
tggagcatgtacctaggggaaa

SEQ ID NO: 5504 - DNA, 20 bp, synthetic construct
  misc_feature 1..20: note = Synthetic Construct
  source 1..20: mol_type = other DNA
aggccaccataccacatgct

SEQ ID NO: 5505 - DNA, 26 bp, synthetic construct
  misc_feature 1..26: note = Synthetic Construct
  source 1..26: mol_type = other DNA
ggctacacagtccatgtcataaatgc

SEQ ID NO: 5506 - DNA, 22 bp, synthetic construct
  misc_feature 1..22: note = Synthetic Construct
  source 1..22: mol_type = other DNA
agactggggacaagatggcata

SEQ ID NO: 5507 - DNA, 27 bp, synthetic construct
  misc_feature 1..27: note = Synthetic Construct
  source 1..27: mol_type = other DNA
ggccactgttaaaaaccaagttatgca

SEQ ID NO: 5508 - DNA, 24 bp, synthetic construct
  misc_feature 1..24: note = Synthetic Construct
  source 1..24: mol_type = other DNA
gtttcccctcttctcttgccataa

SEQ ID NO: 5509 - DNA, 21 bp, synthetic construct
  misc_feature 1..21: note = Synthetic Construct
  source 1..21: mol_type = other DNA
gcttggcggttgttgattggt

SEQ ID NO: 5510 - DNA, 21 bp, synthetic construct
  misc_feature 1..21: note = Synthetic Construct
  source 1..21: mol_type = other DNA
ttctacagggcccttgggaat

SEQ ID NO: 5511 - DNA, 21 bp, synthetic construct
  misc_feature 1..21: note = Synthetic Construct
  source 1..21: mol_type = other DNA
actggaggagacagcctttct

SEQ ID NO: 5512 - DNA, 26 bp, synthetic construct
  misc_feature 1..26: note = Synthetic Construct
  source 1..26: mol_type = other DNA
gggtagagagaccgtttccacaatac

SEQ ID NO: 5513 - DNA, 22 bp, synthetic construct
  misc_feature 1..22: note = Synthetic Construct
  source 1..22: mol_type = other DNA
aacttgctccagatcccatgtg

SEQ ID NO: 5514 - DNA, 23 bp, synthetic construct
  misc_feature 1..23: note = Synthetic Construct
  source 1..23: mol_type = other DNA
gtgtgccaaggaaaagagacact

SEQ ID NO: 5515 - DNA, 23 bp, synthetic construct
  misc_feature 1..23: note = Synthetic Construct
  source 1..23: mol_type = other DNA
cttgggataaggctctggttctc

SEQ ID NO: 5516 - DNA, 24 bp, synthetic construct
  misc_feature 1..24: note = Synthetic Construct
  source 1..24: mol_type = other DNA
gacagaggagaacacatccttctc

SEQ ID NO: 5517 - DNA, 24 bp, synthetic construct
  misc_feature 1..24: note = Synthetic Construct
  source 1..24: mol_type = other DNA
aaggtggatttatcgctcatgtct

SEQ ID NO: 5518 - DNA, 20 bp, synthetic construct
  misc_feature 1..20: note = Synthetic Construct
  source 1..20: mol_type = other DNA
tcctcatctggcacgatggt

SEQ ID NO: 5519 - DNA, 23 bp, synthetic construct
  misc_feature 1..23: note = Synthetic Construct
  source 1..23: mol_type = other DNA
tgcatcattgagggagtgtcatt

SEQ ID NO: 5520 - DNA, 27 bp, synthetic construct
  misc_feature 1..27: note = Synthetic Construct
  source 1..27: mol_type = other DNA
gctaccattgaacttagggtgaaagtc

SEQ ID NO: 5521 - DNA, 24 bp, synthetic construct
  misc_feature 1..24: note = Synthetic Construct
  source 1..24: mol_type = other DNA
ccgtaggtccctactactacaagt

SEQ ID NO: 5522 - DNA, 22 bp, synthetic construct
  misc_feature 1..22: note = Synthetic Construct
  source 1..22: mol_type = other DNA
ctccagactgaattggccaact

SEQ ID NO: 5523 - DNA, 26 bp, synthetic construct
  misc_feature 1..26: note = Synthetic Construct
  source 1..26: mol_type = other DNA
gggagagtgatctcaacatgtatcat

SEQ ID NO: 5524 - DNA, 23 bp, synthetic construct
  misc_feature 1..23: note = Synthetic Construct
  source 1..23: mol_type = other DNA
ctcatcaccattgacgtcctaca

SEQ ID NO: 5525 - DNA, 22 bp, synthetic construct
  misc_feature 1..22: note = Synthetic Construct
  source 1..22: mol_type = other DNA
cctgagtgttgggttgtgtgat

SEQ ID NO: 5526 - DNA, 22 bp, synthetic construct
  misc_feature 1..22: note = Synthetic Construct
  source 1..22: mol_type = other DNA
tgtacctttggggagtcatcct

SEQ ID NO: 5527 - DNA, 25 bp, synthetic construct
  misc_feature 1..25: note = Synthetic Construct
  source 1..25: mol_type = other DNA
tccttctaagacctgagagtgagaa

SEQ ID NO: 5528 - DNA, 23 bp, synthetic construct
  misc_feature 1..23: note = Synthetic Construct
  source 1..23: mol_type = other DNA
gggaacagcaaccttatccagtt

SEQ ID NO: 5529 - DNA, 20 bp, synthetic construct
  misc_feature 1..20: note = Synthetic Construct
  source 1..20: mol_type = other DNA
agtgggtagctggcacttct

SEQ ID NO: 5530 - DNA, 24 bp, synthetic construct
  misc_feature 1..24: note = Synthetic Construct
  source 1..24: mol_type = other DNA
gtgaggatcagtcaaccaaccaat

SEQ ID NO: 5531 - DNA, 22 bp, synthetic construct
  misc_feature 1..22: note = Synthetic Construct
  source 1..22: mol_type = other DNA
cctcaggtgtgctctccttgct

SEQ ID NO: 5532 - DNA, 23 bp, synthetic construct
  misc_feature 1..23: note = Synthetic Construct
  source 1..23: mol_type = other DNA
ttggacaggcccaggataacatc

SEQ ID NO: 5533 - DNA, 22 bp, synthetic construct
  misc_feature 1..22: note = Synthetic Construct
  source 1..22: mol_type = other DNA
tgttcacaccaggcagtgatct

SEQ ID NO: 5534 - DNA, 24 bp, synthetic construct
  misc_feature 1..24: note = Synthetic Construct
  source 1..24: mol_type = other DNA
gcaaaccaaatcctagcacagaga

SEQ ID NO: 5535 - DNA, 21 bp, synthetic construct
  misc_feature 1..21: note = Synthetic Construct
  source 1..21: mol_type = other DNA
tctgtcccacagctggagaag

SEQ ID NO: 5536 - DNA, 23 bp, synthetic construct
  misc_feature 1..23: note = Synthetic Construct
  source 1..23: mol_type = other DNA
ccacactgcatttggaatttggt

SEQ ID NO: 5537 - DNA, 24 bp, synthetic construct
  misc_feature 1..24: note = Synthetic Construct
  source 1..24: mol_type = other DNA
agtttctgggggaaggagtaacag

SEQ ID NO: 5538 - DNA, 22 bp, synthetic construct
  misc_feature 1..22: note = Synthetic Construct
  source 1..22: mol_type = other DNA
cgaggtcgctcctttctaacca

SEQ ID NO: 5539 - DNA, 24 bp, synthetic construct
  misc_feature 1..24: note = Synthetic Construct
  source 1..24: mol_type = other DNA
gggaagatttcctgcattcacctt

SEQ ID NO: 5540 - DNA, 22 bp, synthetic construct
  misc_feature 1..22: note = Synthetic Construct
  source 1..22: mol_type = other DNA
cttaaggcagcaggatggtcaa

SEQ ID NO: 5541 - DNA, 20 bp, synthetic construct
  misc_feature 1..20: note = Synthetic Construct
  source 1..20: mol_type = other DNA
agagtcagcagcatgcatgt

SEQ ID NO: 5542 - DNA, 22 bp, synthetic construct
  misc_feature 1..22: note = Synthetic Construct
  source 1..22: mol_type = other DNA
aggagagtgctgaatggctgat

SEQ ID NO: 5543 - DNA, 20 bp, synthetic construct
  misc_feature 1..20: note = Synthetic Construct
  source 1..20: mol_type = other DNA
ttgggggtcaggtgctcagt

SEQ ID NO: 5544 - DNA, 26 bp, synthetic construct
  misc_feature 1..26: note = Synthetic Construct
  source 1..26: mol_type = other DNA
agaacatgtctgtagtccagatgttt

SEQ ID NO: 5545 - DNA, 18 bp, synthetic construct
  misc_feature 1..18: note = Synthetic Construct
  source 1..18: mol_type = other DNA
ctgccaggccctgtcaca

SEQ ID NO: 5546 - DNA, 25 bp, synthetic construct
  misc_feature 1..25: note = Synthetic Construct
  source 1..25: mol_type = other DNA
gacaggacagaagagtaggtaagct

SEQ ID NO: 5547 - DNA, 27 bp, synthetic construct
  misc_feature 1..27: note = Synthetic Construct
  source 1..27: mol_type = other DNA
ggtgagaaatacataggtctcaggatt

SEQ ID NO: 5548 - DNA, 19 bp, synthetic construct
  misc_feature 1..19: note = Synthetic Construct
  source 1..19: mol_type = other DNA
ccaggcctgagtcctgtgt

SEQ ID NO: 5549 - DNA, 27 bp, synthetic construct
  misc_feature 1..27: note = Synthetic Construct
  source 1..27: mol_type = other DNA
aggaaggcatcatgctatataattgct

SEQ ID NO: 5550 - DNA, 28 bp, synthetic construct
  misc_feature 1..28: note = Synthetic Construct
  source 1..28: mol_type = other DNA
gcctaaccttcaaagatacttcagtgtt

SEQ ID NO: 5551 - DNA, 26 bp, synthetic construct
  misc_feature 1..26: note = Synthetic Construct
  source 1..26: mol_type = other DNA
ggtggtttagtacaaacatgctgagt

SEQ ID NO: 5552 - DNA, 22 bp, synthetic construct
  misc_feature 1..22: note = Synthetic Construct
  source 1..22: mol_type = other DNA
gtcacgagcagctgcctaattt

SEQ ID NO: 5553 - DNA, 22 bp, synthetic construct
  misc_feature 1..22: note = Synthetic Construct
  source 1..22: mol_type = other DNA
ccttttgcctttcccacctctt

SEQ ID NO: 5554 - DNA, 22 bp, synthetic construct
  misc_feature 1..22: note = Synthetic Construct
  source 1..22: mol_type = other DNA
tggaggtcaaagtctccagcat

SEQ ID NO: 5555 - DNA, 20 bp, synthetic construct
  misc_feature 1..20: note = Synthetic Construct
  source 1..20: mol_type = other DNA
gcctagcgcctgttgacctt

SEQ ID NO: 5556 - DNA, 26 bp, synthetic construct
  misc_feature 1..26: note = Synthetic Construct
  source 1..26: mol_type = other DNA
cccagcccttaatcttaagtctaagc

SEQ ID NO: 5557 - DNA, 21 bp, synthetic construct
  misc_feature 1..21: note = Synthetic Construct
  source 1..21: mol_type = other DNA
actgtgccagactctctttgg

SEQ ID NO: 5558 - DNA, 20 bp, synthetic construct
  misc_feature 1..20: note = Synthetic Construct
  source 1..20: mol_type = other DNA
caggccttccacagaacaca

SEQ ID NO: 5559 - DNA, 20 bp, synthetic construct
  misc_feature 1..20: note = Synthetic Construct
  source 1..20: mol_type = other DNA
ggccatccatgtgccaatcc

SEQ ID NO: 5560 - DNA, 24 bp, synthetic construct
  misc_feature 1..24: note = Synthetic Construct
  source 1..24: mol_type = other DNA
caggatgttccaaggactcagaga

SEQ ID NO: 5561 - DNA, 26 bp, synthetic construct
  misc_feature 1..26: note = Synthetic Construct
  source 1..26: mol_type = other DNA
ctgtgtgacatgtacaggtgaaagtt

SEQ ID NO: 5562 - DNA, 25 bp, synthetic construct
  misc_feature 1..25: note = Synthetic Construct
  source 1..25: mol_type = other DNA
tccatagcttgcctcttctcatact

SEQ ID NO: 5563 - DNA, 22 bp, synthetic construct
  misc_feature 1..22: note = Synthetic Construct
  source 1..22: mol_type = other DNA
ttggtgcagatgagaggtttgc

SEQ ID NO: 5564 - DNA, 23 bp, synthetic construct
  misc_feature 1..23: note = Synthetic Construct
  source 1..23: mol_type = other DNA
atgtagtctagcctgggattcca

SEQ ID NO: 5565 - DNA, 20 bp, synthetic construct
  misc_feature 1..20: note = Synthetic Construct
  source 1..20: mol_type = other DNA
aagccccacaccctggtaga

SEQ ID NO: 5566 - DNA, 19 bp, synthetic construct
  misc_feature 1..19: note = Synthetic Construct
  source 1..19: mol_type = other DNA
tgcttgagcgtggcaggtt

SEQ ID NO: 5567 - DNA, 19 bp, synthetic construct
  misc_feature 1..19: note = Synthetic Construct
  source 1..19: mol_type = other DNA
agccgtcctgaagctgtgt

SEQ ID NO: 5568 - DNA, 20 bp, synthetic construct
  misc_feature 1..20: note = Synthetic Construct
  source 1..20: mol_type = other DNA
ccactggctcaaccctcctt

SEQ ID NO: 5569 - DNA, 24 bp, synthetic construct
  misc_feature 1..24: note = Synthetic Construct
  source 1..24: mol_type = other DNA
ggtctcattttcctgccccttgaa

SEQ ID NO: 5570 - DNA, 24 bp, synthetic construct
  misc_feature 1..24: note = Synthetic Construct
  source 1..24: mol_type = other DNA
aggagagcaccactttcagttctc

SEQ ID NO: 5571 - DNA, 27 bp, synthetic construct
  misc_feature 1..27: note = Synthetic Construct
  source 1..27: mol_type = other DNA
cagagtgtcttacttttctcactgtca

SEQ ID NO: 5572 - DNA, 24 bp, synthetic construct
  misc_feature 1..24: note = Synthetic Construct
  source 1..24: mol_type = other DNA
gtgaagcagcagagttaacaagac

SEQ ID NO: 5573 - DNA, 21 bp, synthetic construct
  misc_feature 1..21: note = Synthetic Construct
  source 1..21: mol_type = other DNA
agatccgtcaggctcaacact

SEQ ID NO: 5574 - DNA, 26 bp, synthetic construct
  misc_feature 1..26: note = Synthetic Construct
  source 1..26: mol_type = other DNA
gctgggtcatgttaatcctgtttgtc

SEQ ID NO: 5575 - DNA, 22 bp, synthetic construct
  misc_feature 1..22: note = Synthetic Construct
  source 1..22: mol_type = other DNA
cctgggccttgtcattgtcttt

SEQ ID NO: 5576 - DNA, 27 bp, synthetic construct
  misc_feature 1..27: note = Synthetic Construct
  source 1..27: mol_type = other DNA
cccacaaaaattagctgtgtagtcttg

SEQ ID NO: 5577 - DNA, 28 bp, synthetic construct
  misc_feature 1..28: note = Synthetic Construct
  source 1..28: mol_type = other DNA
gcatgatatgtctttcagtcacctgtga

SEQ ID NO: 5578 - DNA, 26 bp, synthetic construct
  misc_feature 1..26: note = Synthetic Construct
  source 1..26: mol_type = other DNA
ttatatgcattcagctcttccaggat

SEQ ID NO: 5579 - DNA, 23 bp, synthetic construct
  misc_feature 1..23: note = Synthetic Construct
  source 1..23: mol_type = other DNA
atcctgggaggcatcggtgacaa

SEQ ID NO: 5580 - DNA, 24 bp, synthetic construct
  misc_feature 1..24: note = Synthetic Construct
  source 1..24: mol_type = other DNA
gccagttgttctctatggccttaa

SEQ ID NO: 5581 - DNA, 24 bp, synthetic construct
  misc_feature 1..24: note = Synthetic Construct
  source 1..24: mol_type = other DNA
tgtacctagagagacctgggaact

SEQ ID NO: 5582 - DNA, 26 bp, synthetic construct
  misc_feature 1..26: note = Synthetic Construct
  source 1..26: mol_type = other DNA
aggatgctgtaatacaatgtcaggat

SEQ ID NO: 5583 - DNA, 30 bp, synthetic construct
  misc_feature 1..30: note = Synthetic Construct
  source 1..30: mol_type = other DNA
tgatggttttgttgtaaaattctgtaggta

SEQ ID NO: 5584 - DNA, 26 bp, synthetic construct
  misc_feature 1..26: note = Synthetic Construct
  source 1..26: mol_type = other DNA
caacaacccacttttgacatcatctc

SEQ ID NO: 5585 - DNA, 21 bp, synthetic construct
  misc_feature 1..21: note = Synthetic Construct
  source 1..21: mol_type = other DNA
ttacctggctccaccgaaaca

SEQ ID NO: 5586 - DNA, 22 bp, synthetic construct
  misc_feature 1..22: note = Synthetic Construct
  source 1..22: mol_type = other DNA
actggaagttggggggatttca

SEQ ID NO: 5587 - DNA, 23 bp, synthetic construct
  misc_feature 1..23: note = Synthetic Construct
  source 1..23: mol_type = other DNA
gacagcccctgtccattaatagg

SEQ ID NO: 5588 - DNA, 21 bp, synthetic construct
  misc_feature 1..21: note = Synthetic Construct
  source 1..21: mol_type = other DNA
caggactaagcagccaagaca

SEQ ID NO: 5589 - DNA, 20 bp, synthetic construct
  misc_feature 1..20: note = Synthetic Construct
  source 1..20: mol_type = other DNA
tttgcaccaaggccatgcat

SEQ ID NO: 5590 - DNA, 21 bp, synthetic construct
  misc_feature 1..21: note = Synthetic Construct
  source 1..21: mol_type = other DNA
agggaggttccagctcaatcc

SEQ ID NO: 5591 - DNA, 26 bp, synthetic construct
  misc_feature 1..26: note = Synthetic Construct
  source 1..26: mol_type = other DNA
agtgaactgagtttttgtacctacct

SEQ ID NO: 5592 - DNA, 25 bp, synthetic construct
  misc_feature 1..25: note = Synthetic Construct
  source 1..25: mol_type = other DNA
tcactgtctgaaatgcttgttacca

SEQ ID NO: 5593 - DNA, 25 bp, synthetic construct
  misc_feature 1..25: note = Synthetic Construct
  source 1..25: mol_type = other DNA
ccaaagtaagtgacagcaaacttct

SEQ ID NO: 5594 - DNA, 22 bp, synthetic construct
  misc_feature 1..22: note = Synthetic Construct
  source 1..22: mol_type = other DNA
ctttaccattggagggcttcct

SEQ ID NO: 5595 - DNA, 24 bp, synthetic construct
  misc_feature 1..24: note = Synthetic Construct
  source 1..24: mol_type = other DNA
ccttctcttctcatgggacagaag

SEQ ID NO: 5596 - DNA, 28 bp, synthetic construct
  misc_feature 1..28: note = Synthetic Construct
  source 1..28: mol_type = other DNA
ggagtctgaatgaaaaacggttctctca

SEQ ID NO: 5597 - DNA, 21 bp, synthetic construct
  misc_feature 1..21: note = Synthetic Construct
  source 1..21: mol_type = other DNA
tccccaccaaagttgcagaca

SEQ ID NO: 5598 - DNA, 19 bp, synthetic construct
  misc_feature 1..19: note = Synthetic Construct
  source 1..19: mol_type = other DNA
ttaacccccgccagtcgta

SEQ ID NO: 5599 - DNA, 28 bp, synthetic construct
  misc_feature 1..28: note = Synthetic Construct
  source 1..28: mol_type = other DNA
atgaagaaattcaatctagacccatcct

SEQ ID NO: 5600 - DNA, 29 bp, synthetic construct
  misc_feature 1..29: note = Synthetic Construct
  source 1..29: mol_type = other DNA
cgggactatactctaccgtagttcatcag

SEQ ID NO: 5601 - DNA, 28 bp, synthetic construct
  misc_feature 1..28: note = Synthetic Construct
  source 1..28: mol_type = other DNA
gtccctatccactaaactgatatcacaa

SEQ ID NO: 5602 - DNA, 20 bp, synthetic construct
  misc_feature 1..20: note = Synthetic Construct
  source 1..20: mol_type = other DNA
gtgacagcaggcttctctgt

SEQ ID NO: 5603 - DNA, 21 bp, synthetic construct
  misc_feature 1..21: note = Synthetic Construct
  source 1..21: mol_type = other DNA
aactggggttgaggtgggaat

SEQ ID NO: 5604 - DNA, 27 bp, synthetic construct
  misc_feature 1..27: note = Synthetic Construct
  source 1..27: mol_type = other DNA
tggagaataaaccccagatttctagtg

SEQ ID NO: 5605 - DNA, 19 bp, synthetic construct
  misc_feature 1..19: note = Synthetic Construct
  source 1..19: mol_type = other DNA
agctgtgtgggccgcaaaa

SEQ ID NO: 5606 - DNA, 28 bp, synthetic construct
  misc_feature 1..28: note = Synthetic Construct
  source 1..28: mol_type = other DNA
gcaaagatcaatgtgaacccatcatctc

SEQ ID NO: 5607 - DNA, 24 bp, synthetic construct
  misc_feature 1..24: note = Synthetic Construct
  source 1..24: mol_type = other DNA
ctggttctgcagtaatacgtggtt

SEQ ID NO: 5608 - DNA, 22 bp, synthetic construct
  misc_feature 1..22: note = Synthetic Construct
  source 1..22: mol_type = other DNA
agcaaatgctccctctgtgcat

SEQ ID NO: 5609 - DNA, 21 bp, synthetic construct
  misc_feature 1..21: note = Synthetic Construct
  source 1..21: mol_type = other DNA
acccagtcctgaagccattgc

SEQ ID NO: 5610 - DNA, 22 bp, synthetic construct
  misc_feature 1..22: note = Synthetic Construct
  source 1..22: mol_type = other DNA
tcaagttgagcaggccagtgaa

SEQ ID NO: 5611 - DNA, 20 bp, synthetic construct
  misc_feature 1..20: note = Synthetic Construct
  source 1..20: mol_type = other DNA
cccctggggattgaccttga

SEQ ID NO: 5612 - DNA, 21 bp, synthetic construct
  misc_feature 1..21: note = Synthetic Construct
  source 1..21: mol_type = other DNA
tctcacccacacgagacaagt

SEQ ID NO: 5613 - DNA, 24 bp, synthetic construct
  misc_feature 1..24: note = Synthetic Construct
  source 1..24: mol_type = other DNA
agacatggattcctgagccatacc

SEQ ID NO: 5614 - DNA, 20 bp, synthetic construct
  misc_feature 1..20: note = Synthetic Construct
  source 1..20: mol_type = other DNA
gtcactgcgccagtcataca

SEQ ID NO: 5615 - DNA, 30 bp, synthetic construct
  misc_feature 1..30: note = Synthetic Construct
  source 1..30: mol_type = other DNA
cccaaaagtaagagatctccatttcatcag

SEQ ID NO: 5616 - DNA, 29 bp, synthetic construct
  misc_feature 1..29: note = Synthetic Construct
  source 1..29: mol_type = other DNA
cctgattcctagtattttggggaggaatg

SEQ ID NO: 5617 - DNA, 21 bp, synthetic construct
  misc_feature 1..21: note = Synthetic Construct
  source 1..21: mol_type = other DNA
ttgccacccatcgcatcaaga

SEQ ID NO: 5618 - DNA, 23 bp, synthetic construct
  misc_feature 1..23: note = Synthetic Construct
  source 1..23: mol_type = other DNA
tcgggaaaagaggcctttattgg

SEQ ID NO: 5619 - DNA, 24 bp, synthetic construct
  misc_feature 1..24: note = Synthetic Construct
  source 1..24: mol_type = other DNA
gataggccccaagatgatggtaag

SEQ ID NO: 5620 - DNA, 24 bp, synthetic construct
  misc_feature 1..24: note = Synthetic Construct
  source 1..24: mol_type = other DNA
ctgcctttgttgacctagaatgca

SEQ ID NO: 5621 - DNA, 23 bp, synthetic construct
  misc_feature 1..23: note = Synthetic Construct
  source 1..23: mol_type = other DNA
agattgcccctgacattttgtga

SEQ ID NO: 5622 - DNA, 23 bp, synthetic construct
  misc_feature 1..23: note = Synthetic Construct
  source 1..23: mol_type = other DNA
gctccttagaacaacctgtgtga

SEQ ID NO: 5623 - DNA, 22 bp, synthetic construct
  misc_feature 1..22: note = Synthetic Construct
  source 1..22: mol_type = other DNA
ggcagggaaagagtggacattt

SEQ ID NO: 5624 - DNA, 25 bp, synthetic construct
  misc_feature 1..25: note = Synthetic Construct
  source 1..25: mol_type = other DNA
atggaatgttgatcctcctttccat

SEQ ID NO: 5625 - DNA, 21 bp, synthetic construct
  misc_feature 1..21: note = Synthetic Construct
  source 1..21: mol_type = other DNA
caatgcccaccacagatgtga

SEQ ID NO: 5626 - DNA, 23 bp, synthetic construct
  misc_feature 1..23: note = Synthetic Construct
  source 1..23: mol_type = other DNA
gtggccaaggagatttcaatgca

SEQ ID NO: 5627 - DNA, 28 bp, synthetic construct
  misc_feature 1..28: note = Synthetic Construct
  source 1..28: mol_type = other DNA
tcattcctgaatctgggtatttgtagtc

SEQ ID NO: 5628 - DNA, 21 bp, synthetic construct
  misc_feature 1..21: note = Synthetic Construct
  source 1..21: mol_type = other DNA
gggcttcgcagagactgatct

SEQ ID NO: 5629 - DNA, 23 bp, synthetic construct
  misc_feature 1..23: note = Synthetic Construct
  source 1..23: mol_type = other DNA
cctgactttgcccccttttgatt

SEQ ID NO: 5630 - DNA, 22 bp, synthetic construct
  misc_feature 1..22: note = Synthetic Construct
  source 1..22: mol_type = other DNA
agtcaatcaacccaggaaagca

SEQ ID NO: 5631 - DNA, 30 bp, synthetic construct
  misc_feature 1..30: note = Synthetic Construct
  source 1..30: mol_type = other DNA
gtgttttttacccagattcctaaagtttcc

SEQ ID NO: 5632 - DNA, 21 bp, synthetic construct
  misc_feature 1..21: note = Synthetic Construct
  source 1..21: mol_type = other DNA
gcccagtgtacctgtgtctca

SEQ ID NO: 5633 - DNA, 26 bp, synthetic construct
  misc_feature 1..26: note = Synthetic Construct
  source 1..26: mol_type = other DNA
gcctggagtaccaaagtcactttgac

SEQ ID NO: 5634 - DNA, 25 bp, synthetic construct
  misc_feature 1..25: note = Synthetic Construct
  source 1..25: mol_type = other DNA
caagttactacttctggtggccaaa

SEQ ID NO: 5635 - DNA, 23 bp, synthetic construct
  misc_feature 1..23: note = Synthetic Construct
  source 1..23: mol_type = other DNA
aaagccaaggcatcccttagaaa

SEQ ID NO: 5636 - DNA, 19 bp, synthetic construct
  misc_feature 1..19: note = Synthetic Construct
  source 1..19: mol_type = other DNA
gcaacctgggagccttgct

SEQ ID NO: 5637 - DNA, 24 bp, synthetic construct
  misc_feature 1..24: note = Synthetic Construct
  source 1..24: mol_type = other DNA
cctcacagagtagtttgggcacta

SEQ ID NO: 5638 - DNA, 25 bp, synthetic construct
  misc_feature 1..25: note = Synthetic Construct
  source 1..25: mol_type = other DNA
gctagggaataagatgccacagctt

SEQ ID NO: 5639 - DNA, 24 bp, synthetic construct
  misc_feature 1..24: note = Synthetic Construct
  source 1..24: mol_type = other DNA
ggggtttaaatcacagaggtgttg

SEQ ID NO: 5640 - DNA, 22 bp, synthetic construct
  misc_feature 1..22: note = Synthetic Construct
  source 1..22: mol_type = other DNA
ctctgtctcactcagccatcgt

SEQ ID NO: 5641 - DNA, 20 bp, synthetic construct
  misc_feature 1..20: note = Synthetic Construct
  source 1..20: mol_type = other DNA
tgcctccacactggccaaag

SEQ ID NO: 5642 - DNA, 23 bp, synthetic construct
  misc_feature 1..23: note = Synthetic Construct
  source 1..23: mol_type = other DNA
acatggtgatgttggctgtatcc

SEQ ID NO: 5643 - DNA, 20 bp, synthetic construct
  misc_feature 1..20: note = Synthetic Construct
  source 1..20: mol_type = other DNA
accaaggcagcctcacaatt

SEQ ID NO: 5644 - DNA, 21 bp, synthetic construct
  misc_feature 1..21: note = Synthetic Construct
  source 1..21: mol_type = other DNA
aggaaccctcttcccaaacgt

SEQ ID NO: 5645 - DNA, 25 bp, synthetic construct
  misc_feature 1..25: note = Synthetic Construct
  source 1..25: mol_type = other DNA
caaaacaagttgtagaccggatctg

SEQ ID NO: 5646 - DNA, 28 bp, synthetic construct
  misc_feature 1..28: note = Synthetic Construct
  source 1..28: mol_type = other DNA
gtgaatctttaaagacccaacacttgac

SEQ ID NO: 5647 - DNA, 20 bp, synthetic construct
  misc_feature 1..20: note = Synthetic Construct
  source 1..20: mol_type = other DNA
ctgactgcgtgggacttctg

SEQ ID NO: 5648 - DNA, 28 bp, synthetic construct
  misc_feature 1..28: note = Synthetic Construct
  source 1..28: mol_type = other DNA
ggagcaatactcttccagttctttcttc

SEQ ID NO: 5649 - DNA, 24 bp, synthetic construct
  misc_feature 1..24: note = Synthetic Construct
  source 1..24: mol_type = other DNA
acatccgaatacccagttcctctt

SEQ ID NO: 5650 - DNA, 24 bp, synthetic construct
  misc_feature 1..24: note = Synthetic Construct
  source 1..24: mol_type = other DNA
ggcactgtatccaggtatgatgag

SEQ ID NO: 5651 - DNA, 26 bp, synthetic construct
  misc_feature 1..26: note = Synthetic Construct
  source 1..26: mol_type = other DNA
gggagaaagggtgatgtaaagggtta

SEQ ID NO: 5652 - DNA, 24 bp, synthetic construct
  misc_feature 1..24: note = Synthetic Construct
  source 1..24: mol_type = other DNA
gcacaaggggaaagcatgatttag

SEQ ID NO: 5653 - DNA, 24 bp, synthetic construct
  misc_feature 1..24: note = Synthetic Construct
  source 1..24: mol_type = other DNA
gctagcacacagcaagttaattgg

SEQ ID NO: 5654 - DNA, 20 bp, synthetic construct
  misc_feature 1..20: note = Synthetic Construct
  source 1..20: mol_type = other DNA
tgcccaaacttccgctactg

SEQ ID NO: 5655 - DNA, 25 bp, synthetic construct
  misc_feature 1..25: note = Synthetic Construct
  source 1..25: mol_type = other DNA
ctgcatagaaaaggagtgaggaaca

SEQ ID NO: 5656 - DNA, 26 bp, synthetic construct
  misc_feature 1..26: note = Synthetic Construct
  source 1..26: mol_type = other DNA
gaaaagagccttttccttctgttgac

SEQ ID NO: 5657 - DNA, 25 bp, synthetic construct
  misc_feature 1..25: note = Synthetic Construct
  source 1..25: mol_type = other DNA
atgatctcaacaccaaactcttcct

SEQ ID NO: 5658 - DNA, 27 bp, synthetic construct
  misc_feature 1..27: note = Synthetic Construct
  source 1..27: mol_type = other DNA
gagaagattttgtaagcaaggtgaact

SEQ ID NO: 5659 - DNA, 24 bp, synthetic construct
  misc_feature 1..24: note = Synthetic Construct
  source 1..24: mol_type = other DNA
ggaccatccctgactcttacattc

SEQ ID NO: 5660 - DNA, 26 bp, synthetic construct
  misc_feature 1..26: note = Synthetic Construct
  source 1..26: mol_type = other DNA
ttcctgaactaagtttggctctaaca

SEQ ID NO: 5661 - DNA, 21 bp, synthetic construct
  misc_feature 1..21: note = Synthetic Construct
  source 1..21: mol_type = other DNA
tgtgctctgaggactctctgt

SEQ ID NO: 5662 - DNA, 21 bp, synthetic construct
  misc_feature 1..21: note = Synthetic Construct
  source 1..21: mol_type = other DNA
agggcccagaccacattagat

SEQ ID NO: 5663 - DNA, 22 bp, synthetic construct
  misc_feature 1..22: note = Synthetic Construct
  source 1..22: mol_type = other DNA
aggagtttgcagagccaatcag

SEQ ID NO: 5664 - DNA, 23 bp, synthetic construct
  misc_feature 1..23: note = Synthetic Construct
  source 1..23: mol_type = other DNA
gtgagcagttgcaagtaggtgat

SEQ ID NO: 5665 - DNA, 28 bp, synthetic construct
  misc_feature 1..28: note = Synthetic Construct
  source 1..28: mol_type = other DNA
ggtttgcatgatgagagttgatggatac

SEQ ID NO: 5666 - DNA, 25 bp, synthetic construct
  misc_feature 1..25: note = Synthetic Construct
  source 1..25: mol_type = other DNA
catgcagctgataaaaagctttcca

SEQ ID NO: 5667 - DNA, 27 bp, synthetic construct
  misc_feature 1..27: note = Synthetic Construct
  source 1..27: mol_type = other DNA
gcatggataaccagaaaaagcctttgg

SEQ ID NO: 5668 - DNA, 23 bp, synthetic construct
  misc_feature 1..23: note = Synthetic Construct
  source 1..23: mol_type = other DNA
gtcactggccatcaaaagtcatc

SEQ ID NO: 5669 - DNA, 22 bp, synthetic construct
  misc_feature 1..22: note = Synthetic Construct
  source 1..22: mol_type = other DNA
ttcagggttactggcctaccaa

SEQ ID NO: 5670 - DNA, 23 bp, synthetic construct
  misc_feature 1..23: note = Synthetic Construct
  source 1..23: mol_type = other DNA
accttccagtccagcctctagtg

SEQ ID NO: 5671 - DNA, 18 bp, synthetic construct
  misc_feature 1..18: note = Synthetic Construct
  source 1..18: mol_type = other DNA
aggaggccagcccttgag

SEQ ID NO: 5672 - DNA, 23 bp, synthetic construct
  misc_feature 1..23: note = Synthetic Construct
  source 1..23: mol_type = other DNA
ctgtggtcatcactgtgaaatgc

SEQ ID NO: 5673 - DNA, 19 bp, synthetic construct
  misc_feature 1..19: note = Synthetic Construct
  source 1..19: mol_type = other DNA
cagcctccccatgggatca

SEQ ID NO: 5674 - DNA, 22 bp, synthetic construct
  misc_feature 1..22: note = Synthetic Construct
  source 1..22: mol_type = other DNA
cagctgcatggaaagaggaaga

SEQ ID NO: 5675 - DNA, 22 bp, synthetic construct
  misc_feature 1..22: note = Synthetic Construct
  source 1..22: mol_type = other DNA
tccccagcttatcctgaagtga

SEQ ID NO: 5676 - DNA, 24 bp, synthetic construct
  misc_feature 1..24: note = Synthetic Construct
  source 1..24: mol_type = other DNA
ccatggccatagttcccactgtaa

SEQ ID NO: 5677 - DNA, 23 bp, synthetic construct
  misc_feature 1..23: note = Synthetic Construct
  source 1..23: mol_type = other DNA
tcaccaggaccatgtacctagaa

SEQ ID NO: 5678 - DNA, 24 bp, synthetic construct
  misc_feature 1..24: note = Synthetic Construct
  source 1..24: mol_type = other DNA
caggtatctctgtgatcccagcat

SEQ ID NO: 5679 - DNA, 26 bp, synthetic construct
  misc_feature 1..26: note = Synthetic Construct
  source 1..26: mol_type = other DNA
agcatagcatttccaaatctctctct

SEQ ID NO: 5680 - DNA, 27 bp, synthetic construct
  misc_feature 1..27: note = Synthetic Construct
  source 1..27: mol_type = other DNA
ctgaattccagaggcatctttatctca

SEQ ID NO: 5681 - DNA, 22 bp, synthetic construct
  misc_feature 1..22: note = Synthetic Construct
  source 1..22: mol_type = other DNA
tggaatggctggcccttcatac

SEQ ID NO: 5682 - DNA, 22 bp, synthetic construct
  misc_feature 1..22: note = Synthetic Construct
  source 1..22: mol_type = other DNA
cagtgttctttggggcttttgg

SEQ ID NO: 5683 - DNA, 23 bp, synthetic construct
  misc_feature 1..23: note = Synthetic Construct
  source 1..23: mol_type = other DNA
ggtaaacagcccttacacttgga

SEQ ID NO: 5684 - DNA, 22 bp, synthetic construct
  misc_feature 1..22: note = Synthetic Construct
  source 1..22: mol_type = other DNA
cctacccagatccagtgaacca

SEQ ID NO: 5685 - DNA, 21 bp, synthetic construct
  misc_feature 1..21: note = Synthetic Construct
  source 1..21: mol_type = other DNA
tgctcagaaccccttgagtct

SEQ ID NO: 5686 - DNA, 26 bp, synthetic construct
  misc_feature 1..26: note = Synthetic Construct
  source 1..26: mol_type = other DNA
ccaccacactgatgtcaagagatctg

SEQ ID NO: 5687 - DNA, 27 bp, synthetic construct
  misc_feature 1..27: note = Synthetic Construct
  source 1..27: mol_type = other DNA
gcaggtagtttagatttcagtctatgc

SEQ ID NO: 5688 - DNA, 22 bp, synthetic construct
  misc_feature 1..22: note = Synthetic Construct
  source 1..22: mol_type = other DNA
cgaatcccatttggtcctggta

SEQ ID NO: 5689 - DNA, 24 bp, synthetic construct
  misc_feature 1..24: note = Synthetic Construct
  source 1..24: mol_type = other DNA
cacaacagcctttctccatgaagt

SEQ ID NO: 5690 - DNA, 22 bp, synthetic construct
  misc_feature 1..22: note = Synthetic Construct
  source 1..22: mol_type = other DNA
catgaggagggatcaccactga

SEQ ID NO: 5691 - DNA, 25 bp, synthetic construct
  misc_feature 1..25: note = Synthetic Construct
  source 1..25: mol_type = other DNA
acagtgaattctgttccaagtcaac

SEQ ID NO: 5692 - DNA, 24 bp, synthetic construct
  misc_feature 1..24: note = Synthetic Construct
  source 1..24: mol_type = other DNA
ggaaccttctcatgcatcgtttcc

SEQ ID NO: 5693 - DNA, 24 bp, synthetic construct
  misc_feature 1..24: note = Synthetic Construct
  source 1..24: mol_type = other DNA
tctctgagaagacacctgctcttc

SEQ ID NO: 5694 - DNA, 24 bp, synthetic construct
  misc_feature 1..24: note = Synthetic Construct
  source 1..24: mol_type = other DNA
ctcagccacaagtgctacaagatc

SEQ ID NO: 5695 - DNA, 21 bp, synthetic construct
  misc_feature 1..21: note = Synthetic Construct
  source 1..21: mol_type = other DNA
agtctgcctttctgggatgca

SEQ ID NO: 5696 - DNA, 29 bp, synthetic construct
  misc_feature 1..29: note = Synthetic Construct
  source 1..29: mol_type = other DNA
ccacaataagatgtctatccactaaacac

SEQ ID NO: 5697 - DNA, 22 bp, synthetic construct
  misc_feature 1..22: note = Synthetic Construct
  source 1..22: mol_type = other DNA
ggaccagcagccaagaagatta

SEQ ID NO: 5698 - DNA, 23 bp, synthetic construct
  misc_feature 1..23: note = Synthetic Construct
  source 1..23: mol_type = other DNA
aaagtgtgcacctgaagaatgtg

SEQ ID NO: 5699 - DNA, 22 bp, synthetic construct
  misc_feature 1..22: note = Synthetic Construct
  source 1..22: mol_type = other DNA
cagcaaagatgtgtggcatgac

SEQ ID NO: 5700 - DNA, 23 bp, synthetic construct
  misc_feature 1..23: note = Synthetic Construct
  source 1..23: mol_type = other DNA
gatactagctgccactggctaaa

SEQ ID NO: 5701 - DNA, 21 bp, synthetic construct
  misc_feature 1..21: note = Synthetic Construct
  source 1..21: mol_type = other DNA
tgtggcttggttacccactga

SEQ ID NO: 5702 - DNA, 22 bp, synthetic construct
  misc_feature 1..22: note = Synthetic Construct
  source 1..22: mol_type = other DNA
gcaagtgcaccctatttgttgt

SEQ ID NO: 5703 - DNA, 23 bp, synthetic construct
  misc_feature 1..23: note = Synthetic Construct
  source 1..23: mol_type = other DNA
gagacccatttgcttgtgagaca

SEQ ID NO: 5704 - DNA, 23 bp, synthetic construct
  misc_feature 1..23: note = Synthetic Construct
  source 1..23: mol_type = other DNA
ggctcaacattaggcactcaaca

SEQ ID NO: 5705 - DNA, 30 bp, synthetic construct
  misc_feature 1..30: note = Synthetic Construct
  source 1..30: mol_type = other DNA
gaaccaagtaaatttcacataacctggtat

SEQ ID NO: 5706 - DNA, 18 bp, synthetic construct
  misc_feature 1..18: note = Synthetic Construct
  source 1..18: mol_type = other DNA
ccctgtgtgccccatagc

SEQ ID NO: 5707 - DNA, 19 bp, synthetic construct
  misc_feature 1..19: note = Synthetic Construct
  source 1..19: mol_type = other DNA
gcagcccagttggacagaa

SEQ ID NO: 5708 - DNA, 24 bp, synthetic construct
  misc_feature 1..24: note = Synthetic Construct
  source 1..24: mol_type = other DNA
gtgattggccaagagactgatgag

SEQ ID NO: 5709 - DNA, 23 bp, synthetic construct
  misc_feature 1..23: note = Synthetic Construct
  source 1..23: mol_type = other DNA
acgacaaccacatacacgtcatc

SEQ ID NO: 5710 - DNA, 22 bp, synthetic construct
  misc_feature 1..22: note = Synthetic Construct
  source 1..22: mol_type = other DNA
aaatactctgcctccccttgtg

SEQ ID NO: 5711 - DNA, 24 bp, synthetic construct
  misc_feature 1..24: note = Synthetic Construct
  source 1..24: mol_type = other DNA
ccaattggcaatacgttgggtaac

SEQ ID NO: 5712 - DNA, 25 bp, synthetic construct
  misc_feature 1..25: note = Synthetic Construct
  source 1..25: mol_type = other DNA
gcctgtaacctcttcttccacattc

SEQ ID NO: 5713 - DNA, 22 bp, synthetic construct
  misc_feature 1..22: note = Synthetic Construct
  source 1..22: mol_type = other DNA
gtgggcttcatgctagggtttt

SEQ ID NO: 5714 - DNA, 21 bp, synthetic construct
  misc_feature 1..21: note = Synthetic Construct
  source 1..21: mol_type = other DNA
gcctggactgcaggaatgtct

SEQ ID NO: 5715 - DNA, 24 bp, synthetic construct
  misc_feature 1..24: note = Synthetic Construct
  source 1..24: mol_type = other DNA
gggaacagggaaggagttaaagtc

SEQ ID NO: 5716 - DNA, 23 bp, synthetic construct
  misc_feature 1..23: note = Synthetic Construct
  source 1..23: mol_type = other DNA
gccaagcacttgcatttctagca

SEQ ID NO: 5717 - DNA, 22 bp, synthetic construct
  misc_feature 1..22: note = Synthetic Construct
  source 1..22: mol_type = other DNA
cctggggagctatggaactgaa

SEQ ID NO: 5718 - DNA, 24 bp, synthetic construct
  misc_feature 1..24: note = Synthetic Construct
  source 1..24: mol_type = other DNA
caagcactggagatgcagagtatc

SEQ ID NO: 5719 - DNA, 24 bp, synthetic construct
  misc_feature 1..24: note = Synthetic Construct
  source 1..24: mol_type = other DNA
ggttacagactgcatccatttcca

SEQ ID NO: 5720 - DNA, 25 bp, synthetic construct
  misc_feature 1..25: note = Synthetic Construct
  source 1..25: mol_type = other DNA
ccctgtttttagtcggtccaaacac

SEQ ID NO: 5721 - DNA, 22 bp, synthetic construct
  misc_feature 1..22: note = Synthetic Construct
  source 1..22: mol_type = other DNA
ttccaggccttgagaggagtgt

SEQ ID NO: 5722 - DNA, 23 bp, synthetic construct
  misc_feature 1..23: note = Synthetic Construct
  source 1..23: mol_type = other DNA
gagcaaacattccaggtggatga

SEQ ID NO: 5723 - DNA, 25 bp, synthetic construct
  misc_feature 1..25: note = Synthetic Construct
  source 1..25: mol_type = other DNA
gtctcctcactttacccttcagcta

SEQ ID NO: 5724 - DNA, 22 bp, synthetic construct
  misc_feature 1..22: note = Synthetic Construct
  source 1..22: mol_type = other DNA
accaggtgctaggtactgtgtt

SEQ ID NO: 5725 - DNA, 24 bp, synthetic construct
  misc_feature 1..24: note = Synthetic Construct
  source 1..24: mol_type = other DNA
gtgcagatcctcatgcatttagga

SEQ ID NO: 5726 - DNA, 24 bp, synthetic construct
  misc_feature 1..24: note = Synthetic Construct
  source 1..24: mol_type = other DNA
gtcagaaggtcgatcatcctgtct

SEQ ID NO: 5727 - DNA, 27 bp, synthetic construct
  misc_feature 1..27: note = Synthetic Construct
  source 1..27: mol_type = other DNA
gggaactatgcagagatgatgggtaaa

SEQ ID NO: 5728 - DNA, 21 bp, synthetic construct
  misc_feature 1..21: note = Synthetic Construct
  source 1..21: mol_type = other DNA
gctgacagctgtggtcagaga

SEQ ID NO: 5729 - DNA, 23 bp, synthetic construct
  misc_feature 1..23: note = Synthetic Construct
  source 1..23: mol_type = other DNA
tctatctgctccatgctcattgc

SEQ ID NO: 5730 - DNA, 25 bp, synthetic construct
  misc_feature 1..25: note = Synthetic Construct
  source 1..25: mol_type = other DNA
agaggatgaagtaggctctaatcct

SEQ ID NO: 5731 - DNA, 22 bp, synthetic construct
  misc_feature 1..22: note = Synthetic Construct
  source 1..22: mol_type = other DNA
tgggagaggctgtcagttgtga

SEQ ID NO: 5732 - DNA, 21 bp, synthetic construct
  misc_feature 1..21: note = Synthetic Construct
  source 1..21: mol_type = other DNA
ttgggcccctcaagttctgtt

SEQ ID NO: 5733 - DNA, 22 bp, synthetic construct
  misc_feature 1..22: note = Synthetic Construct
  source 1..22: mol_type = other DNA
ggacacagagctctcaattgca

SEQ ID NO: 5734 - DNA, 24 bp, synthetic construct
  misc_feature 1..24: note = Synthetic Construct
  source 1..24: mol_type = other DNA
tccaggcacactgagatgcccata

SEQ ID NO: 5735 - DNA, 20 bp, synthetic construct
  misc_feature 1..20: note = Synthetic Construct
  source 1..20: mol_type = other DNA
aacagctcacccctggattg

SEQ ID NO: 5736 - DNA, 25 bp, synthetic construct
  misc_feature 1..25: note = Synthetic Construct
  source 1..25: mol_type = other DNA
acattgcagaaaggacaggttactc

SEQ ID NO: 5737 - DNA, 19 bp, synthetic construct
  misc_feature 1..19: note = Synthetic Construct
  source 1..19: mol_type = other DNA
tgggcttgcggtagacact

SEQ ID NO: 5738 - DNA, 23 bp, synthetic construct
  misc_feature 1..23: note = Synthetic Construct
  source 1..23: mol_type = other DNA
gccacattcaaagtccctgtagt

SEQ ID NO: 5739 - DNA, 19 bp, synthetic construct
  misc_feature 1..19: note = Synthetic Construct
  source 1..19: mol_type = other DNA
acgcacatggaggctttcc

SEQ ID NO: 5740 - DNA, 20 bp, synthetic construct
  misc_feature 1..20: note = Synthetic Construct
  source 1..20: mol_type = other DNA
agagcctcacagggaagcaa

SEQ ID NO: 5741 - DNA, 21 bp, synthetic construct
  misc_feature 1..21: note = Synthetic Construct
  source 1..21: mol_type = other DNA
tgaggtcctgcttccggtatt

SEQ ID NO: 5742 - DNA, 23 bp, synthetic construct
  misc_feature 1..23: note = Synthetic Construct
  source 1..23: mol_type = other DNA
actccagattggggatgatagct

SEQ ID NO: 5743 - DNA, 20 bp, synthetic construct
  misc_feature 1..20: note = Synthetic Construct
  source 1..20: mol_type = other DNA
aagaccaaggcagtgcaagt

SEQ ID NO: 5744 - DNA, 26 bp, synthetic construct
  misc_feature 1..26: note = Synthetic Construct
  source 1..26: mol_type = other DNA
gggctaagtttaagaagtgggattgg

SEQ ID NO: 5745 - DNA, 29 bp, synthetic construct
  misc_feature 1..29: note = Synthetic Construct
  source 1..29: mol_type = other DNA
ggctacaatctacacacttcattcccaat

SEQ ID NO: 5746 - DNA, 22 bp, synthetic construct
  misc_feature 1..22: note = Synthetic Construct
  source 1..22: mol_type = other DNA
agcccatacagccttccagaga

SEQ ID NO: 5747 - DNA, 21 bp, synthetic construct
  misc_feature 1..21: note = Synthetic Construct
  source 1..21: mol_type = other DNA
tcccaggctgaggctatcctt

SEQ ID NO: 5748 - DNA, 23 bp, synthetic construct
  misc_feature 1..23: note = Synthetic Construct
  source 1..23: mol_type = other DNA
cagactttcccttgcagaacagt

SEQ ID NO: 5749 - DNA, 24 bp, synthetic construct
  misc_feature 1..24: note = Synthetic Construct
  source 1..24: mol_type = other DNA
ctgccatacaggaagctaaaatcg

SEQ ID NO: 5750 - DNA, 22 bp, synthetic construct
  misc_feature 1..22: note = Synthetic Construct
  source 1..22: mol_type = other DNA
cacagtctctctcagcaatgca

SEQ ID NO: 5751 - DNA, 22 bp, synthetic construct
  misc_feature 1..22: note = Synthetic Construct
  source 1..22: mol_type = other DNA
tgctgaccttgtcttcctacca

SEQ ID NO: 5752 - DNA, 20 bp, synthetic construct
  misc_feature 1..20: note = Synthetic Construct
  source 1..20: mol_type = other DNA
tgactccagcacagggttga

SEQ ID NO: 5753 - DNA, 24 bp, synthetic construct
  misc_feature 1..24: note = Synthetic Construct
  source 1..24: mol_type = other DNA
gtgaggaagctatggctcataagt

SEQ ID NO: 5754 - DNA, 19 bp, synthetic construct
  misc_feature 1..19: note = Synthetic Construct
  source 1..19: mol_type = other DNA
ccgacgtaggctggaccaa

SEQ ID NO: 5755 - DNA, 21 bp, synthetic construct
  misc_feature 1..21: note = Synthetic Construct
  source 1..21: mol_type = other DNA
cccagcatcacccagctttgc

SEQ ID NO: 5756 - DNA, 24 bp, synthetic construct
  misc_feature 1..24: note = Synthetic Construct
  source 1..24: mol_type = other DNA
ggcgcttcctttagagtgtgtttc

SEQ ID NO: 5757 - DNA, 24 bp, synthetic construct
  misc_feature 1..24: note = Synthetic Construct
  source 1..24: mol_type = other DNA
gaagcgagcttggaacttcttact

SEQ ID NO: 5758 - DNA, 25 bp, synthetic construct
  misc_feature 1..25: note = Synthetic Construct
  source 1..25: mol_type = other DNA
actgggcctttatactccattactg

SEQ ID NO: 5759 - DNA, 18 bp, synthetic construct
  misc_feature 1..18: note = Synthetic Construct
  source 1..18: mol_type = other DNA
caagcaccggcccatgtg

SEQ ID NO: 5760 - DNA, 25 bp, synthetic construct
  misc_feature 1..25: note = Synthetic Construct
  source 1..25: mol_type = other DNA
gttaaccaagcacctccttatatgc

SEQ ID NO: 5761 - DNA, 18 bp, synthetic construct
  misc_feature 1..18: note = Synthetic Construct
  source 1..18: mol_type = other DNA
agccccaggaggcaatgg

SEQ ID NO: 5762 - DNA, 25 bp, synthetic construct
  misc_feature 1..25: note = Synthetic Construct
  source 1..25: mol_type = other DNA
ctgttttcacagttctctggcaaca

SEQ ID NO: 5763 - DNA, 24 bp, synthetic construct
  misc_feature 1..24: note = Synthetic Construct
  source 1..24: mol_type = other DNA
gcagatgctcagtggatgtttgtg

SEQ ID NO: 5764 - DNA, 24 bp, synthetic construct
  misc_feature 1..24: note = Synthetic Construct
  source 1..24: mol_type = other DNA
gggcttagtgatgctaaggatctg

SEQ ID NO: 5765 - DNA, 24 bp, synthetic construct
  misc_feature 1..24: note = Synthetic Construct
  source 1..24: mol_type = other DNA
caccttaaccacagcatgatgttg

SEQ ID NO: 5766 - DNA, 30 bp, synthetic construct
  misc_feature 1..30: note = Synthetic Construct
  source 1..30: mol_type = other DNA
ggagatagaagttagtttagcagttacctt

SEQ ID NO: 5767 - DNA, 23 bp, synthetic construct
  misc_feature 1..23: note = Synthetic Construct
  source 1..23: mol_type = other DNA
ggcctgtttcaagacaagaagga

SEQ ID NO: 5768 - DNA, 26 bp, synthetic construct
  misc_feature 1..26: note = Synthetic Construct
  source 1..26: mol_type = other DNA
cacaaacggtagggtagtaagtacct

SEQ ID NO: 5769 - DNA, 22 bp, synthetic construct
  misc_feature 1..22: note = Synthetic Construct
  source 1..22: mol_type = other DNA
aaccaaagtccccaaccccttt

SEQ ID NO: 5770 - DNA, 25 bp, synthetic construct
  misc_feature 1..25: note = Synthetic Construct
  source 1..25: mol_type = other DNA
aggggaaactatagagggggtaaac

SEQ ID NO: 5771 - DNA, 20 bp, synthetic construct
  misc_feature 1..20: note = Synthetic Construct
  source 1..20: mol_type = other DNA
actccaagatgccacaacgt

SEQ ID NO: 5772 - DNA, 25 bp, synthetic construct
  misc_feature 1..25: note = Synthetic Construct
  source 1..25: mol_type = other DNA
ggaacttatgggtcagatctggaaa

SEQ ID NO: 5773 - DNA, 26 bp, synthetic construct
  misc_feature 1..26: note = Synthetic Construct
  source 1..26: mol_type = other DNA
ggtcattgagaaagtcatcccatctt

SEQ ID NO: 5774 - DNA, 22 bp, synthetic construct
  misc_feature 1..22: note = Synthetic Construct
  source 1..22: mol_type = other DNA
aggtgggatccagttctgacaa

SEQ ID NO: 5775 - DNA, 22 bp, synthetic construct
  misc_feature 1..22: note = Synthetic Construct
  source 1..22: mol_type = other DNA
cttccccttccctactctcctt

SEQ ID NO: 5776 - DNA, 24 bp, synthetic construct
  misc_feature 1..24: note = Synthetic Construct
  source 1..24: mol_type = other DNA
atgtttgtgaacttggcagagaag

SEQ ID NO: 5777 - DNA, 28 bp, synthetic construct
  misc_feature 1..28: note = Synthetic Construct
  source 1..28: mol_type = other DNA
agcaaatagacaaggtttttctcattcc

SEQ ID NO: 5778 - DNA, 24 bp, synthetic construct
  misc_feature 1..24: note = Synthetic Construct
  source 1..24: mol_type = other DNA
ccctggtttagaggaatgctactc

SEQ ID NO: 5779 - DNA, 26 bp, synthetic construct
  misc_feature 1..26: note = Synthetic Construct
  source 1..26: mol_type = other DNA
gtatgattccatgtacgtgagtttgg

SEQ ID NO: 5780 - DNA, 20 bp, synthetic construct
  misc_feature 1..20: note = Synthetic Construct
  source 1..20: mol_type = other DNA
tgttggctgatggggggaaa

SEQ ID NO: 5781 - DNA, 22 bp, synthetic construct
  misc_feature 1..22: note = Synthetic Construct
  source 1..22: mol_type = other DNA
gaatagagaggcccttgtgcat

SEQ ID NO: 5782 - DNA, 25 bp, synthetic construct
  misc_feature 1..25: note = Synthetic Construct
  source 1..25: mol_type = other DNA
tttcagcccatagcatcatacttct

SEQ ID NO: 5783 - DNA, 24 bp, synthetic construct
  misc_feature 1..24: note = Synthetic Construct
  source 1..24: mol_type = other DNA
tgtggttagacttcctgagaacca

SEQ ID NO: 5784 - DNA, 21 bp, synthetic construct
  misc_feature 1..21: note = Synthetic Construct
  source 1..21: mol_type = other DNA
tggctagtgggcttgctttca

SEQ ID NO: 5785 - DNA, 22 bp, synthetic construct
  misc_feature 1..22: note = Synthetic Construct
  source 1..22: mol_type = other DNA
gctcatgaatcctgctggctat

SEQ ID NO: 5786 - DNA, 24 bp, synthetic construct
  misc_feature 1..24: note = Synthetic Construct
  source 1..24: mol_type = other DNA
tccctctctctccaacttttagct

SEQ ID NO: 5787 - DNA, 29 bp, synthetic construct
  misc_feature 1..29: note = Synthetic Construct
  source 1..29: mol_type = other DNA
gctgattctgagatgtaataggctacaca

SEQ ID NO: 5788 - DNA, 24 bp, synthetic construct
  misc_feature 1..24: note = Synthetic Construct
  source 1..24: mol_type = other DNA
ggttgggtttctgcatcctttgtg

SEQ ID NO: 5789 - DNA, 22 bp, synthetic construct
  misc_feature 1..22: note = Synthetic Construct
  source 1..22: mol_type = other DNA
gcaatgccaagttcagccactt

SEQ ID NO: 5790 - DNA, 18 bp, synthetic construct
  misc_feature 1..18: note = Synthetic Construct
  source 1..18: mol_type = other DNA
ggacaggcgagcgtatgg

SEQ ID NO: 5791 - DNA, 23 bp, synthetic construct
  misc_feature 1..23: note = Synthetic Construct
  source 1..23: mol_type = other DNA
gaccaaggggctgacaaagttct

SEQ ID NO: 5792 - DNA, 25 bp, synthetic construct
  misc_feature 1..25: note = Synthetic Construct
  source 1..25: mol_type = other DNA
gggtccaaatcagtgctggaaatga

SEQ ID NO: 5793 - DNA, 22 bp, synthetic construct
  misc_feature 1..22: note = Synthetic Construct
  source 1..22: mol_type = other DNA
tcccttaatcggaaggcagtga

SEQ ID NO: 5794 - DNA, 24 bp, synthetic construct
  misc_feature 1..24: note = Synthetic Construct
  source 1..24: mol_type = other DNA
aatgccacctggtaatgaagagaa

SEQ ID NO: 5795 - DNA, 23 bp, synthetic construct
  misc_feature 1..23: note = Synthetic Construct
  source 1..23: mol_type = other DNA
gcatcagatgttccttggttcct

SEQ ID NO: 5796 - DNA, 22 bp, synthetic construct
  misc_feature 1..22: note = Synthetic Construct
  source 1..22: mol_type = other DNA
agtggagctgggattctcaaca

SEQ ID NO: 5797 - DNA, 23 bp, synthetic construct
  misc_feature 1..23: note = Synthetic Construct
  source 1..23: mol_type = other DNA
tccagattgggagagtgtttcct

SEQ ID NO: 5798 - DNA, 25 bp, synthetic construct
  misc_feature 1..25: note = Synthetic Construct
  source 1..25: mol_type = other DNA
catttgttggtggctaattgaggat

SEQ ID NO: 5799 - DNA, 25 bp, synthetic construct
  misc_feature 1..25: note = Synthetic Construct
  source 1..25: mol_type = other DNA
acaaatgatgccaacactgagatga

SEQ ID NO: 5800 - DNA, 24 bp, synthetic construct
  misc_feature 1..24: note = Synthetic Construct
  source 1..24: mol_type = other DNA
ccatcagatgggtctattcacaca

SEQ ID NO: 5801 - DNA, 22 bp, synthetic construct
  misc_feature 1..22: note = Synthetic Construct
  source 1..22: mol_type = other DNA
gctgttggagctgaatcaccta

SEQ ID NO: 5802 - DNA, 19 bp, synthetic construct
  misc_feature 1..19: note = Synthetic Construct
  source 1..19: mol_type = other DNA
ggcaaggcctcgagaaagg

SEQ ID NO: 5803 - DNA, 23 bp, synthetic construct
  misc_feature 1..23: note = Synthetic Construct
  source 1..23: mol_type = other DNA
ggctggggctatcttctcattca

SEQ ID NO: 5804 - DNA, 22 bp, synthetic construct
  misc_feature 1..22: note = Synthetic Construct
  source 1..22: mol_type = other DNA
tccctgtgctgtcaatgagctt

SEQ ID NO: 5805 - DNA, 22 bp, synthetic construct
  misc_feature 1..22: note = Synthetic Construct
  source 1..22: mol_type = other DNA
aacctgcatcctaggctctctt

SEQ ID NO: 5806 - DNA, 24 bp, synthetic construct
  misc_feature 1..24: note = Synthetic Construct
  source 1..24: mol_type = other DNA
gacagcctattggtgaggataaca

SEQ ID NO: 5807 - DNA, 19 bp, synthetic construct
  misc_feature 1..19: note = Synthetic Construct
  source 1..19: mol_type = other DNA
cccaggccctttgcttcct

SEQ ID NO: 5808 - DNA, 21 bp, synthetic construct
  misc_feature 1..21: note = Synthetic Construct
  source 1..21: mol_type = other DNA
ttgatccgccctctctactca

SEQ ID NO: 5809 - DNA, 20 bp, synthetic construct
  misc_feature 1..20: note = Synthetic Construct
  source 1..20: mol_type = other DNA
agactggggatggggcaaaa

SEQ ID NO: 5810 - DNA, 24 bp, synthetic construct
  misc_feature 1..24: note = Synthetic Construct
  source 1..24: mol_type = other DNA
acctgaaaattgtcccgaatgtct

SEQ ID NO: 5811 - DNA, 26 bp, synthetic construct
  misc_feature 1..26: note = Synthetic Construct
  source 1..26: mol_type = other DNA
ggacagttacataaaccagcagttac

SEQ ID NO: 5812 - DNA, 25 bp, synthetic construct
  misc_feature 1..25: note = Synthetic Construct
  source 1..25: mol_type = other DNA
tctggatcttgaattccacactcaa

SEQ ID NO: 5813 - DNA, 21 bp, synthetic construct
  misc_feature 1..21: note = Synthetic Construct
  source 1..21: mol_type = other DNA
tccgtcgtccccactgagtaa

SEQ ID NO: 5814 - DNA, 23 bp, synthetic construct
  misc_feature 1..23: note = Synthetic Construct
  source 1..23: mol_type = other DNA
actatgtcactgaggctggagta

SEQ ID NO: 5815 - DNA, 24 bp, synthetic construct
  misc_feature 1..24: note = Synthetic Construct
  source 1..24: mol_type = other DNA
gctgactttcttagccaccgtaca

SEQ ID NO: 5816 - DNA, 26 bp, synthetic construct
  misc_feature 1..26: note = Synthetic Construct
  source 1..26: mol_type = other DNA
cccttgatctatctggagttcaccat

SEQ ID NO: 5817 - DNA, 22 bp, synthetic construct
  misc_feature 1..22: note = Synthetic Construct
  source 1..22: mol_type = other DNA
ccgcccatgaaaatgcgatcat

SEQ ID NO: 5818 - DNA, 27 bp, synthetic construct
  misc_feature 1..27: note = Synthetic Construct
  source 1..27: mol_type = other DNA
ctctgtcgaataatcatgtgtccacta

SEQ ID NO: 5819 - DNA, 24 bp, synthetic construct
  misc_feature 1..24: note = Synthetic Construct
  source 1..24: mol_type = other DNA
cctcctaagtgttgcgttctttcg

SEQ ID NO: 5820 - DNA, 24 bp, synthetic construct
  misc_feature 1..24: note = Synthetic Construct
  source 1..24: mol_type = other DNA
tgatccctgatgttggaggtaaga

SEQ ID NO: 5821 - DNA, 25 bp, synthetic construct
  misc_feature 1..25: note = Synthetic Construct
  source 1..25: mol_type = other DNA
ggctgatgaattgcatgtgggtttc

SEQ ID NO: 5822 - DNA, 24 bp, synthetic construct
  misc_feature 1..24: note = Synthetic Construct
  source 1..24: mol_type = other DNA
tctgacactgattcagggaaagag

SEQ ID NO: 5823 - DNA, 20 bp, synthetic construct
  misc_feature 1..20: note = Synthetic Construct
  source 1..20: mol_type = other DNA
acagtgggccggtgtgataa

SEQ ID NO: 5824 - DNA, 26 bp, synthetic construct
  misc_feature 1..26: note = Synthetic Construct
  source 1..26: mol_type = other DNA
gtcgtgaatcctagaatgtacatgct

SEQ ID NO: 5825 - DNA, 22 bp, synthetic construct
  misc_feature 1..22: note = Synthetic Construct
  source 1..22: mol_type = other DNA
ctcatttcccacccaactccat

SEQ ID NO: 5826 - DNA, 20 bp, synthetic construct
  misc_feature 1..20: note = Synthetic Construct
  source 1..20: mol_type = other DNA
atgccacacagcaagatcca

SEQ ID NO: 5827 - DNA, 20 bp, synthetic construct
  misc_feature 1..20: note = Synthetic Construct
  source 1..20: mol_type = other DNA
tgtagctctccagccattgc

SEQ ID NO: 5828 - DNA, 18 bp, synthetic construct
  misc_feature 1..18: note = Synthetic Construct
  source 1..18: mol_type = other DNA
ggcctgaggggagggaaa

SEQ ID NO: 5829 - DNA, 24 bp, synthetic construct
  misc_feature 1..24: note = Synthetic Construct
  source 1..24: mol_type = other DNA
ctctggaatagaccgtgacaaagg

SEQ ID NO: 5830 - DNA, 25 bp, synthetic construct
  misc_feature 1..25: note = Synthetic Construct
  source 1..25: mol_type = other DNA
cggagatttcaccattagcacttct

SEQ ID NO: 5831 - DNA, 20 bp, synthetic construct
  misc_feature 1..20: note = Synthetic Construct
  source 1..20: mol_type = other DNA
ttgccccttcaggaagcaaa

SEQ ID NO: 5832 - DNA, 20 bp, synthetic construct
  misc_feature 1..20: note = Synthetic Construct
  source 1..20: mol_type = other DNA
tggttgtggtgggggtggaa

SEQ ID NO: 5833 - DNA, 29 bp, synthetic construct
  misc_feature 1..29: note = Synthetic Construct
  source 1..29: mol_type = other DNA
gcaaactaacacagcagtgaattgtaagt

SEQ ID NO: 5834 - DNA, 24 bp, synthetic construct
  misc_feature 1..24: note = Synthetic Construct
  source 1..24: mol_type = other DNA
gggacatgggtaacagtcacattg

SEQ ID NO: 5835 - DNA, 24 bp, synthetic construct
  misc_feature 1..24: note = Synthetic Construct
  source 1..24: mol_type = other DNA
ggaatcccagaagtctgacagtgt

SEQ ID NO: 5836 - DNA, 28 bp, synthetic construct
  misc_feature 1..28: note = Synthetic Construct
  source 1..28: mol_type = other DNA
ccttttctactgacaaggggatatttgg

SEQ ID NO: 5837 - DNA, 23 bp, synthetic construct
  misc_feature 1..23: note = Synthetic Construct
  source 1..23: mol_type = other DNA
ctcctagccaaacaaagcaagac

SEQ ID NO: 5838 - DNA, 21 bp, synthetic construct
  misc_feature 1..21: note = Synthetic Construct
  source 1..21: mol_type = other DNA
tacctccactgccaccaccaa

SEQ ID NO: 5839 - DNA, 23 bp, synthetic construct
  misc_feature 1..23: note = Synthetic Construct
  source 1..23: mol_type = other DNA
cccagtctgtgcttcctccttct

SEQ ID NO: 5840 - DNA, 24 bp, synthetic construct
  misc_feature 1..24: note = Synthetic Construct
  source 1..24: mol_type = other DNA
ttgtaaaaaccaccctagcagtca

SEQ ID NO: 5841 - DNA, 22 bp, synthetic construct
  misc_feature 1..22: note = Synthetic Construct
  source 1..22: mol_type = other DNA
tcacagccaagcatacctctgt

SEQ ID NO: 5842 - DNA, 23 bp, synthetic construct
  misc_feature 1..23: note = Synthetic Construct
  source 1..23: mol_type = other DNA
aatcctggcaagatccccagatc

SEQ ID NO: 5843 - DNA, 20 bp, synthetic construct
  misc_feature 1..20: note = Synthetic Construct
  source 1..20: mol_type = other DNA
gcccatctcaagtggctctt

SEQ ID NO: 5844 - DNA, 21 bp, synthetic construct
  misc_feature 1..21: note = Synthetic Construct
  source 1..21: mol_type = other DNA
accgactgcagaaagctcaca

SEQ ID NO: 5845 - DNA, 24 bp, synthetic construct
  misc_feature 1..24: note = Synthetic Construct
  source 1..24: mol_type = other DNA
ctgttgaatccacaagaccaaacc

SEQ ID NO: 5846 - DNA, 28 bp, synthetic construct
  misc_feature 1..28: note = Synthetic Construct
  source 1..28: mol_type = other DNA
gactatactcacacacaaaattgctttg

SEQ ID NO: 5847 - DNA, 27 bp, synthetic construct
  misc_feature 1..27: note = Synthetic Construct
  source 1..27: mol_type = other DNA
gcaaaagcaagatgactaagtgttcgt

SEQ ID NO: 5848 - DNA, 25 bp, synthetic construct
  misc_feature 1..25: note = Synthetic Construct
  source 1..25: mol_type = other DNA
cctccagggtagtagacatatgtgt

SEQ ID NO: 5849 - DNA, 22 bp, synthetic construct
  misc_feature 1..22: note = Synthetic Construct
  source 1..22: mol_type = other DNA
aggaagcttaggccttgttagc

SEQ ID NO: 5850 - DNA, 21 bp, synthetic construct
  misc_feature 1..21: note = Synthetic Construct
  source 1..21: mol_type = other DNA
ggatgcaactgagggagcaaa

SEQ ID NO: 5851 - DNA, 19 bp, synthetic construct
  misc_feature 1..19: note = Synthetic Construct
  source 1..19: mol_type = other DNA
aggcctgagtggggatgtc

SEQ ID NO: 5852 - DNA, 24 bp, synthetic construct
  misc_feature 1..24: note = Synthetic Construct
  source 1..24: mol_type = other DNA
caccaagagatcgtgtcctcaaag

SEQ ID NO: 5853 - DNA, 28 bp, synthetic construct
  misc_feature 1..28: note = Synthetic Construct
  source 1..28: mol_type = other DNA
gggaactccatcaatatttgtcctcgtt

SEQ ID NO: 5854 - DNA, 22 bp, synthetic construct
  misc_feature 1..22: note = Synthetic Construct
  source 1..22: mol_type = other DNA
aggtctctaaagcccagtgcat

SEQ ID NO: 5855 - DNA, 24 bp, synthetic construct
  misc_feature 1..24: note = Synthetic Construct
  source 1..24: mol_type = other DNA
aatgctgtatgtaggttggaagct

SEQ ID NO: 5856 - DNA, 24 bp, synthetic construct
  misc_feature 1..24: note = Synthetic Construct
  source 1..24: mol_type = other DNA
gtgtttgagaaggtcagtctgaca

SEQ ID NO: 5857 - DNA, 25 bp, synthetic construct
  misc_feature 1..25: note = Synthetic Construct
  source 1..25: mol_type = other DNA
ccttctgttaaagccagaactgtgt

SEQ ID NO: 5858 - DNA, 20 bp, synthetic construct
  misc_feature 1..20: note = Synthetic Construct
  source 1..20: mol_type = other DNA
cccgcaatatgggcaacgtt

SEQ ID NO: 5859 - DNA, 27 bp, synthetic construct
  misc_feature 1..27: note = Synthetic Construct
  source 1..27: mol_type = other DNA
ctaaaatagtatgtgagctgcattggt

SEQ ID NO: 5860 - DNA, 24 bp, synthetic construct
  misc_feature 1..24: note = Synthetic Construct
  source 1..24: mol_type = other DNA
tgtaggtagttcccccaaactttc

SEQ ID NO: 5861 - DNA, 22 bp, synthetic construct
  misc_feature 1..22: note = Synthetic Construct
  source 1..22: mol_type = other DNA
gtgagggaggtagggtttcaag

SEQ ID NO: 5862 - DNA, 24 bp, synthetic construct
  misc_feature 1..24: note = Synthetic Construct
  source 1..24: mol_type = other DNA
caatctggtctcattgacgttgtc

SEQ ID NO: 5863 - DNA, 24 bp, synthetic construct
  misc_feature 1..24: note = Synthetic Construct
  source 1..24: mol_type = other DNA
cccacattttacgggtgcatgttc

SEQ ID NO: 5864 - DNA, 22 bp, synthetic construct
  misc_feature 1..22: note = Synthetic Construct
  source 1..22: mol_type = other DNA
ctatggagttttggcccacaga

SEQ ID NO: 5865 - DNA, 21 bp, synthetic construct
  misc_feature 1..21: note = Synthetic Construct
  source 1..21: mol_type = other DNA
actgttctggatgggcaagtg

SEQ ID NO: 5866 - DNA, 28 bp, synthetic construct
  misc_feature 1..28: note = Synthetic Construct
  source 1..28: mol_type = other DNA
ggcaatctactagctagaggtagttcag

SEQ ID NO: 5867 - DNA, 24 bp, synthetic construct
  misc_feature 1..24: note = Synthetic Construct
  source 1..24: mol_type = other DNA
cctattttcctgcttgtggttacg

SEQ ID NO: 5868 - DNA, 20 bp, synthetic construct
  misc_feature 1..20: note = Synthetic Construct
  source 1..20: mol_type = other DNA
atccacagccagcaaacagt

SEQ ID NO: 5869 - DNA, 22 bp, synthetic construct
  misc_feature 1..22: note = Synthetic Construct
  source 1..22: mol_type = other DNA
aggttctgctctggcattttgg

SEQ ID NO: 5870 - DNA, 21 bp, synthetic construct
  misc_feature 1..21: note = Synthetic Construct
  source 1..21: mol_type = other DNA
agagatgatggcagggacaga

SEQ ID NO: 5871 - DNA, 23 bp, synthetic construct
  misc_feature 1..23: note = Synthetic Construct
  source 1..23: mol_type = other DNA
gcaatgctcccctattctgaaca

SEQ ID NO: 5872 - DNA, 27 bp, synthetic construct
  misc_feature 1..27: note = Synthetic Construct
  source 1..27: mol_type = other DNA
cccaggtcaaaacccaaaatgttatcc

SEQ ID NO: 5873 - DNA, 24 bp, synthetic construct
  misc_feature 1..24: note = Synthetic Construct
  source 1..24: mol_type = other DNA
cctccattaccctagtgagtacca

SEQ ID NO: 5874 - DNA, 25 bp, synthetic construct
  misc_feature 1..25: note = Synthetic Construct
  source 1..25: mol_type = other DNA
ggcagtcattcaaacctaactctgt

SEQ ID NO: 5875 - DNA, 26 bp, synthetic construct
  misc_feature 1..26: note = Synthetic Construct
  source 1..26: mol_type = other DNA
tggtaggaagtaagaggcaggttagg

SEQ ID NO: 5876 - DNA, 22 bp, synthetic construct
  misc_feature 1..22: note = Synthetic Construct
  source 1..22: mol_type = other DNA
gcctagtgggttcagtcaagct

SEQ ID NO: 5877 - DNA, 23 bp, synthetic construct
  misc_feature 1..23: note = Synthetic Construct
  source 1..23: mol_type = other DNA
ctggacttcaaagaaccgtgatg

SEQ ID NO: 5878 - DNA, 21 bp, synthetic construct
  misc_feature 1..21: note = Synthetic Construct
  source 1..21: mol_type = other DNA
agccccacactactgatctca

SEQ ID NO: 5879 - DNA, 28 bp, synthetic construct
  misc_feature 1..28: note = Synthetic Construct
  source 1..28: mol_type = other DNA
cccagaacacatgttaaatttcccctta

SEQ ID NO: 5880 - DNA, 24 bp, synthetic construct
  misc_feature 1..24: note = Synthetic Construct
  source 1..24: mol_type = other DNA
acctgagcctacatctgagctctt

SEQ ID NO: 5881 - DNA, 26 bp, synthetic construct
  misc_feature 1..26: note = Synthetic Construct
  source 1..26: mol_type = other DNA
tctccaactgaaaaccaatgtaaggt

SEQ ID NO: 5882 - DNA, 21 bp, synthetic construct
  misc_feature 1..21: note = Synthetic Construct
  source 1..21: mol_type = other DNA
gcaaaaccctgaggcccttca

SEQ ID NO: 5883 - DNA, 21 bp, synthetic construct
  misc_feature 1..21: note = Synthetic Construct
  source 1..21: mol_type = other DNA
gctgatttgcattggctcaca

SEQ ID NO: 5884 - DNA, 24 bp, synthetic construct
  misc_feature 1..24: note = Synthetic Construct
  source 1..24: mol_type = other DNA
gtgcaggaagatggggagattaca

SEQ ID NO: 5885 - DNA, 21 bp, synthetic construct
  misc_feature 1..21: note = Synthetic Construct
  source 1..21: mol_type = other DNA
tgctagattccgaggctggaa

SEQ ID NO: 5886 - DNA, 22 bp, synthetic construct
  misc_feature 1..22: note = Synthetic Construct
  source 1..22: mol_type = other DNA
tggcatggctttaaaggttgga

SEQ ID NO: 5887 - DNA, 19 bp, synthetic construct
  misc_feature 1..19: note = Synthetic Construct
  source 1..19: mol_type = other DNA
gcctggtgaatggcaaggt

SEQ ID NO: 5888 - DNA, 23 bp, synthetic construct
  misc_feature 1..23: note = Synthetic Construct
  source 1..23: mol_type = other DNA
ccaacctgacaagtggagatctg

SEQ ID NO: 5889 - DNA, 21 bp, synthetic construct
  misc_feature 1..21: note = Synthetic Construct
  source 1..21: mol_type = other DNA
acgaacccacatcagccagta

SEQ ID NO: 5890 - DNA, 24 bp, synthetic construct
  misc_feature 1..24: note = Synthetic Construct
  source 1..24: mol_type = other DNA
tcctgctacctatgaagggtagga

SEQ ID NO: 5891 - DNA, 23 bp, synthetic construct
  misc_feature 1..23: note = Synthetic Construct
  source 1..23: mol_type = other DNA
tgtcctggcctgataaggaagga

SEQ ID NO: 5892 - DNA, 29 bp, synthetic construct
  misc_feature 1..29: note = Synthetic Construct
  source 1..29: mol_type = other DNA
tgatatcctgtgtcttggtgttaatacag

SEQ ID NO: 5893 - DNA, 27 bp, synthetic construct
  misc_feature 1..27: note = Synthetic Construct
  source 1..27: mol_type = other DNA
ggactgcagagtaaatttttggctttg

SEQ ID NO: 5894 - DNA, 26 bp, synthetic construct
  misc_feature 1..26: note = Synthetic Construct
  source 1..26: mol_type = other DNA
aagtgttgcagtaaaagaccatacag

SEQ ID NO: 5895 - DNA, 25 bp, synthetic construct
  misc_feature 1..25: note = Synthetic Construct
  source 1..25: mol_type = other DNA
aggatgctgttgattgtatgtagca

SEQ ID NO: 5896 - DNA, 22 bp, synthetic construct
  misc_feature 1..22: note = Synthetic Construct
  source 1..22: mol_type = other DNA
cacaagctcacctcactgctta

SEQ ID NO: 5897 - DNA, 24 bp, synthetic construct
  misc_feature 1..24: note = Synthetic Construct
  source 1..24: mol_type = other DNA
tgtacccccttcttcctacagcta

SEQ ID NO: 5898 - DNA, 24 bp, synthetic construct
  misc_feature 1..24: note = Synthetic Construct
  source 1..24: mol_type = other DNA
gctgttatagtcgtggtggttgtg

SEQ ID NO: 5899 - DNA, 21 bp, synthetic construct
  misc_feature 1..21: note = Synthetic Construct
  source 1..21: mol_type = other DNA
tgctctgctcactccccattc

SEQ ID NO: 5900 - DNA, 23 bp, synthetic construct
  misc_feature 1..23: note = Synthetic Construct
  source 1..23: mol_type = other DNA
ctaggaaaggccctacactgttc

SEQ ID NO: 5901 - DNA, 20 bp, synthetic construct
  misc_feature 1..20: note = Synthetic Construct
  source 1..20: mol_type = other DNA
aactgaaaggccacgtgcaa

SEQ ID NO: 5902 - DNA, 20 bp, synthetic construct
  misc_feature 1..20: note = Synthetic Construct
  source 1..20: mol_type = other DNA
ttcctggtggctggaatgct

SEQ ID NO: 5903 - DNA, 25 bp, synthetic construct
  misc_feature 1..25: note = Synthetic Construct
  source 1..25: mol_type = other DNA
cgacttgactgaacaggtcttagac

SEQ ID NO: 5904 - DNA, 21 bp, synthetic construct
  misc_feature 1..21: note = Synthetic Construct
  source 1..21: mol_type = other DNA
agctgagctcttcgccaggta

SEQ ID NO: 5905 - DNA, 22 bp, synthetic construct
  misc_feature 1..22: note = Synthetic Construct
  source 1..22: mol_type = other DNA
gcttcagcagcatcatccagaa

SEQ ID NO: 5906 - DNA, 21 bp, synthetic construct
  misc_feature 1..21: note = Synthetic Construct
  source 1..21: mol_type = other DNA
aatgcctggaggggtgtgtca

SEQ ID NO: 5907 - DNA, 20 bp, synthetic construct
  misc_feature 1..20: note = Synthetic Construct
  source 1..20: mol_type = other DNA
aggggggttgggaacttcca

SEQ ID NO: 5908 - DNA, 22 bp, synthetic construct
  misc_feature 1..22: note = Synthetic Construct
  source 1..22: mol_type = other DNA
tctcaaccaaggggtacagaga

SEQ ID NO: 5909 - DNA, 24 bp, synthetic construct
  misc_feature 1..24: note = Synthetic Construct
  source 1..24: mol_type = other DNA
cctttgtgctcaggctttgaaggt

SEQ ID NO: 5910 - DNA, 24 bp, synthetic construct
  misc_feature 1..24: note = Synthetic Construct
  source 1..24: mol_type = other DNA
ctgtcttgccatttttgcccaata

SEQ ID NO: 5911 - DNA, 25 bp, synthetic construct
  misc_feature 1..25: note = Synthetic Construct
  source 1..25: mol_type = other DNA
gaaaggctcagtacagctttttagc

SEQ ID NO: 5912 - DNA, 20 bp, synthetic construct
  misc_feature 1..20: note = Synthetic Construct
  source 1..20: mol_type = other DNA
ggcttggccacaatgttgct

SEQ ID NO: 5913 - DNA, 19 bp, synthetic construct
  misc_feature 1..19: note = Synthetic Construct
  source 1..19: mol_type = other DNA
aaccaccagtgcctttgca

SEQ ID NO: 5914 - DNA, 22 bp, synthetic construct
  misc_feature 1..22: note = Synthetic Construct
  source 1..22: mol_type = other DNA
ggggagcctcacatttgacatt

SEQ ID NO: 5915 - DNA, 22 bp, synthetic construct
  misc_feature 1..22: note = Synthetic Construct
  source 1..22: mol_type = other DNA
gacaatggcagagaaggcagtt

SEQ ID NO: 5916 - DNA, 22 bp, synthetic construct
  misc_feature 1..22: note = Synthetic Construct
  source 1..22: mol_type = other DNA
ccttggtttgcactgtgtttgg

SEQ ID NO: 5917 - DNA, 22 bp, synthetic construct
  misc_feature 1..22: note = Synthetic Construct
  source 1..22: mol_type = other DNA
tgccctttttgtgctggtaggt

SEQ ID NO: 5918 - DNA, 20 bp, synthetic construct
  misc_feature 1..20: note = Synthetic Construct
  source 1..20: mol_type = other DNA
ttccccaggctggcctttaa

SEQ ID NO: 5919 - DNA, 25 bp, synthetic construct
  misc_feature 1..25: note = Synthetic Construct
  source 1..25: mol_type = other DNA
tgatgttgagtagaggtgtgatgtc

SEQ ID NO: 5920 - DNA, 22 bp, synthetic construct
  misc_feature 1..22: note = Synthetic Construct
  source 1..22: mol_type = other DNA
caaaccccacccagtttagctt

SEQ ID NO: 5921 - DNA, 22 bp, synthetic construct
  misc_feature 1..22: note = Synthetic Construct
  source 1..22: mol_type = other DNA
gtgtcctggtatgtggaacgtt

SEQ ID NO: 5922 - DNA, 26 bp, synthetic construct
  misc_feature 1..26: note = Synthetic Construct
  source 1..26: mol_type = other DNA
tcaaaagtttttagcctgccttagtc

SEQ ID NO: 5923 - DNA, 25 bp, synthetic construct
  misc_feature 1..25: note = Synthetic Construct
  source 1..25: mol_type = other DNA
cgtgaagcttgggttaacagttcca

SEQ ID NO: 5924 - DNA, 22 bp, synthetic construct
  misc_feature 1..22: note = Synthetic Construct
  source 1..22: mol_type = other DNA
ggcaaaaacctgctggaatgct

SEQ ID NO: 5925 - DNA, 23 bp, synthetic construct
  misc_feature 1..23: note = Synthetic Construct
  source 1..23: mol_type = other DNA
cccaggatgcaggatctactgta

SEQ ID NO: 5926 - DNA, 25 bp, synthetic construct
  misc_feature 1..25: note = Synthetic Construct
  source 1..25: mol_type = other DNA
gggaatggagaacactcttcttgct

SEQ ID NO: 5927 - DNA, 22 bp, synthetic construct
  misc_feature 1..22: note = Synthetic Construct
  source 1..22: mol_type = other DNA
tgcagctggacaaactcccatt

SEQ ID NO: 5928 - DNA, 24 bp, synthetic construct
  misc_feature 1..24: note = Synthetic Construct
  source 1..24: mol_type = other DNA
agctgaaagaaaacccactttgtc

SEQ ID NO: 5929 - DNA, 24 bp, synthetic construct
  misc_feature 1..24: note = Synthetic Construct
  source 1..24: mol_type = other DNA
cgcgtagggtgttggattcttttg

SEQ ID NO: 5930 - DNA, 26 bp, synthetic construct
  misc_feature 1..26: note = Synthetic Construct
  source 1..26: mol_type = other DNA
atttgggaagtaagacttgcaatctg

SEQ ID NO: 5931 - DNA, 26 bp, synthetic construct
  misc_feature 1..26: note = Synthetic Construct
  source 1..26: mol_type = other DNA
gggttaataatgtggaggtcactgaa

SEQ ID NO: 5932 - DNA, 25 bp, synthetic construct
  misc_feature 1..25: note = Synthetic Construct
  source 1..25: mol_type = other DNA
catttacatcctcgaagtcctgtgt

SEQ ID NO: 5933 - DNA, 23 bp, synthetic construct
  misc_feature 1..23: note = Synthetic Construct
  source 1..23: mol_type = other DNA
ggatgagtttggccctgattttc

SEQ ID NO: 5934 - DNA, 24 bp, synthetic construct
  misc_feature 1..24: note = Synthetic Construct
  source 1..24: mol_type = other DNA
cactccttggcattcaggtaacac

SEQ ID NO: 5935 - DNA, 25 bp, synthetic construct
  misc_feature 1..25: note = Synthetic Construct
  source 1..25: mol_type = other DNA
gtttccaccattgctttcacaatct

SEQ ID NO: 5936 - DNA, 25 bp, synthetic construct
  misc_feature 1..25: note = Synthetic Construct
  source 1..25: mol_type = other DNA
ctgttaccttgactcatctcaggtt

SEQ ID NO: 5937 - DNA, 24 bp, synthetic construct
  misc_feature 1..24: note = Synthetic Construct
  source 1..24: mol_type = other DNA
tggtgctattacaggcataaacca

SEQ ID NO: 5938 - DNA, 22 bp, synthetic construct
  misc_feature 1..22: note = Synthetic Construct
  source 1..22: mol_type = other DNA
agtttcagcagctaagccagaa

SEQ ID NO: 5939 - DNA, 25 bp, synthetic construct
  misc_feature 1..25: note = Synthetic Construct
  source 1..25: mol_type = other DNA
ctgaaaagttgcatagctggaatcc

SEQ ID NO: 5940 - DNA, 23 bp, synthetic construct
  misc_feature 1..23: note = Synthetic Construct
  source 1..23: mol_type = other DNA
gataccagagcaagccttcatga

SEQ ID NO: 5941 - DNA, 22 bp, synthetic construct
  misc_feature 1..22: note = Synthetic Construct
  source 1..22: mol_type = other DNA
tggactggatgaggacagcatt

SEQ ID NO: 5942 - DNA, 24 bp, synthetic construct
  misc_feature 1..24: note = Synthetic Construct
  source 1..24: mol_type = other DNA
gggggtcttttatctccaggaaag

SEQ ID NO: 5943 - DNA, 20 bp, synthetic construct
  misc_feature 1..20: note = Synthetic Construct
  source 1..20: mol_type = other DNA
tctcacccgacaccccatat

SEQ ID NO: 5944 - DNA, 24 bp, synthetic construct
  misc_feature 1..24: note = Synthetic Construct
  source 1..24: mol_type = other DNA
aataacctgttgcactggttctct

SEQ ID NO: 5945 - DNA, 22 bp, synthetic construct
  misc_feature 1..22: note = Synthetic Construct
  source 1..22: mol_type = other DNA
tcacagtggaagaggcaaaggt

SEQ ID NO: 5946 - DNA, 25 bp, synthetic construct
  misc_feature 1..25: note = Synthetic Construct
  source 1..25: mol_type = other DNA
ggttgcaccggaaaagaacagattc

SEQ ID NO: 5947 - DNA, 26 bp, synthetic construct
  misc_feature 1..26: note = Synthetic Construct
  source 1..26: mol_type = other DNA
ggtcacagaaatgggcagaaattgtt

SEQ ID NO: 5948 - DNA, 28 bp, synthetic construct
  misc_feature 1..28: note = Synthetic Construct
  source 1..28: mol_type = other DNA
ggtttgggtcatgacaatagatccctta

SEQ ID NO: 5949 - DNA, 22 bp, synthetic construct
  misc_feature 1..22: note = Synthetic Construct
  source 1..22: mol_type = other DNA
ttctcacttgccagtggtgact

SEQ ID NO: 5950 - DNA, 20 bp, synthetic construct
  misc_feature 1..20: note = Synthetic Construct
  source 1..20: mol_type = other DNA
tgcagtggctgagttgctaa

SEQ ID NO: 5951 - DNA, 22 bp, synthetic construct
  misc_feature 1..22: note = Synthetic Construct
  source 1..22: mol_type = other DNA
agtagagtttctcgccctctga

SEQ ID NO: 5952 - DNA, 22 bp, synthetic construct
  misc_feature 1..22: note = Synthetic Construct
  source 1..22: mol_type = other DNA
actccagtactggcactatcca

SEQ ID NO: 5953 - DNA, 22 bp, synthetic construct
  misc_feature 1..22: note = Synthetic Construct
  source 1..22: mol_type = other DNA
agcagtatgcactggggaaagg

SEQ ID NO: 5954 - DNA, 21 bp, synthetic construct
  misc_feature 1..21: note = Synthetic Construct
  source 1..21: mol_type = other DNA
tgccttcgttccccggtacta

SEQ ID NO: 5955 - DNA, 19 bp, synthetic construct
  misc_feature 1..19: note = Synthetic Construct
  source 1..19: mol_type = other DNA
tgtgcctggtggggagaca

SEQ ID NO: 5956 - DNA, 28 bp, synthetic construct
  misc_feature 1..28: note = Synthetic Construct
  source 1..28: mol_type = other DNA
gcagatcttggtgaaatacatggatgct

SEQ ID NO: 5957 - DNA, 22 bp, synthetic construct
  misc_feature 1..22: note = Synthetic Construct
  source 1..22: mol_type = other DNA
tgagctcaggtgtgggaaattc

SEQ ID NO: 5958 - DNA, 26 bp, synthetic construct
  misc_feature 1..26: note = Synthetic Construct
  source 1..26: mol_type = other DNA
cttgggaaatacacaaatacgtggaa

SEQ ID NO: 5959 - DNA, 22 bp, synthetic construct
  misc_feature 1..22: note = Synthetic Construct
  source 1..22: mol_type = other DNA
agaagaagtccccgtcaaacct

SEQ ID NO: 5960 - DNA, 27 bp, synthetic construct
  misc_feature 1..27: note = Synthetic Construct
  source 1..27: mol_type = other DNA
gactcagacagcgaagtaaattgttca

SEQ ID NO: 5961 - DNA, 28 bp, synthetic construct
  misc_feature 1..28: note = Synthetic Construct
  source 1..28: mol_type = other DNA
agtctaatcggtctgaagtgaaagtaaa

SEQ ID NO: 5962 - DNA, 24 bp, synthetic construct
  misc_feature 1..24: note = Synthetic Construct
  source 1..24: mol_type = other DNA
ttctcaaaaccccaaatcctgagt

SEQ ID NO: 5963 - DNA, 25 bp, synthetic construct
  misc_feature 1..25: note = Synthetic Construct
  source 1..25: mol_type = other DNA
cagaagttactgctggtcctttcag

SEQ ID NO: 5964 - DNA, 24 bp, synthetic construct
  misc_feature 1..24: note = Synthetic Construct
  source 1..24: mol_type = other DNA
ccttagggaaagccatgcaagaag

SEQ ID NO: 5965 - DNA, 25 bp, synthetic construct
  misc_feature 1..25: note = Synthetic Construct
  source 1..25: mol_type = other DNA
gttgctatccatgcagaaactgttg

SEQ ID NO: 5966 - DNA, 27 bp, synthetic construct
  misc_feature 1..27: note = Synthetic Construct
  source 1..27: mol_type = other DNA
ccaaacttttcctacttaggtgcaatt

SEQ ID NO: 5967 - DNA, 23 bp, synthetic construct
  misc_feature 1..23: note = Synthetic Construct
  source 1..23: mol_type = other DNA
ggtttggcatccttcagctcata

SEQ ID NO: 5968 - DNA, 29 bp, synthetic construct
  misc_feature 1..29: note = Synthetic Construct
  source 1..29: mol_type = other DNA
cctttttggactgctggcttatattaaat

SEQ ID NO: 5969 - DNA, 23 bp, synthetic construct
  misc_feature 1..23: note = Synthetic Construct
  source 1..23: mol_type = other DNA
caagccctgcattttgttactga

SEQ ID NO: 5970 - DNA, 22 bp, synthetic construct
  misc_feature 1..22: note = Synthetic Construct
  source 1..22: mol_type = other DNA
ttggagcacaccagtttaagct

SEQ ID NO: 5971 - DNA, 25 bp, synthetic construct
  misc_feature 1..25: note = Synthetic Construct
  source 1..25: mol_type = other DNA
ggagtctggggaggtactaataaca

SEQ ID NO: 5972 - DNA, 22 bp, synthetic construct
  misc_feature 1..22: note = Synthetic Construct
  source 1..22: mol_type = other DNA
ttgccagtgggaggatgaagta

SEQ ID NO: 5973 - DNA, 25 bp, synthetic construct
  misc_feature 1..25: note = Synthetic Construct
  source 1..25: mol_type = other DNA
cctccatgcagattagacacttgtg

SEQ ID NO: 5974 - DNA, 20 bp, synthetic construct
  misc_feature 1..20: note = Synthetic Construct
  source 1..20: mol_type = other DNA
ttacaggcgtcaggcattgt

SEQ ID NO: 5975 - DNA, 24 bp, synthetic construct
  misc_feature 1..24: note = Synthetic Construct
  source 1..24: mol_type = other DNA
caggggatcagggaagtgagtaaa

SEQ ID NO: 5976 - DNA, 20 bp, synthetic construct
  misc_feature 1..20: note = Synthetic Construct
  source 1..20: mol_type = other DNA
actggttggttggctggttt

SEQ ID NO: 5977 - DNA, 22 bp, synthetic construct
  misc_feature 1..22: note = Synthetic Construct
  source 1..22: mol_type = other DNA
ggtgaaagtgttgggaggcttt

SEQ ID NO: 5978 - DNA, 27 bp, synthetic construct
  misc_feature 1..27: note = Synthetic Construct
  source 1..27: mol_type = other DNA
caagactgttttagaaacgggattaca

SEQ ID NO: 5979 - DNA, 28 bp, synthetic construct
  misc_feature 1..28: note = Synthetic Construct
  source 1..28: mol_type = other DNA
aaaagatctgttctatcagtaccaaggt

SEQ ID NO: 5980 - DNA, 29 bp, synthetic construct
  misc_feature 1..29: note = Synthetic Construct
  source 1..29: mol_type = other DNA
tggtaatgaagggttatcttaacagttca

SEQ ID NO: 5981 - DNA, 27 bp, synthetic construct
  misc_feature 1..27: note = Synthetic Construct
  source 1..27: mol_type = other DNA
ccctgacaatgtattcattctcaagca

SEQ ID NO: 5982 - DNA, 24 bp, synthetic construct
  misc_feature 1..24: note = Synthetic Construct
  source 1..24: mol_type = other DNA
gcaggtaggctttgaggtgtgaat

SEQ ID NO: 5983 - DNA, 21 bp, synthetic construct
  misc_feature 1..21: note = Synthetic Construct
  source 1..21: mol_type = other DNA
ggagtggggaggtgtgtgaat

SEQ ID NO: 5984 - DNA, 22 bp, synthetic construct
  misc_feature 1..22: note = Synthetic Construct
  source 1..22: mol_type = other DNA
tgagctgtatgggtgcctagta

SEQ ID NO: 5985 - DNA, 19 bp, synthetic construct
  misc_feature 1..19: note = Synthetic Construct
  source 1..19: mol_type = other DNA
ggctcgttctgcccacttg

SEQ ID NO: 5986 - DNA, 27 bp, synthetic construct
  misc_feature 1..27: note = Synthetic Construct
  source 1..27: mol_type = other DNA
tctgttaaaaatctgcatgttggatca

SEQ ID NO: 5987 - DNA, 22 bp, synthetic construct
  misc_feature 1..22: note = Synthetic Construct
  source 1..22: mol_type = other DNA
cccgatggtttcctttgctctt

SEQ ID NO: 5988 - DNA, 23 bp, synthetic construct
  misc_feature 1..23: note = Synthetic Construct
  source 1..23: mol_type = other DNA
ctggcatgaatgtcactcaggtt

SEQ ID NO: 5989 - DNA, 27 bp, synthetic construct
  misc_feature 1..27: note = Synthetic Construct
  source 1..27: mol_type = other DNA
gtgagaccatcaaaaagaaaggagtgt

SEQ ID NO: 5990 - DNA, 24 bp, synthetic construct
  misc_feature 1..24: note = Synthetic Construct
  source 1..24: mol_type = other DNA
ctgcctattgttgccatcaacttg

SEQ ID NO: 5991 - DNA, 29 bp, synthetic construct
  misc_feature 1..29: note = Synthetic Construct
  source 1..29: mol_type = other DNA
ggcaagaaatgacttccaatgacattgta

SEQ ID NO: 5992 - DNA, 26 bp, synthetic construct
  misc_feature 1..26: note = Synthetic Construct
  source 1..26: mol_type = other DNA
tgcgagagtataggttacaggatttg

SEQ ID NO: 5993 - DNA, 24 bp, synthetic construct
  misc_feature 1..24: note = Synthetic Construct
  source 1..24: mol_type = other DNA
tgttcggaggttgtctgagatcac

SEQ ID NO: 5994 - DNA, 25 bp, synthetic construct
  misc_feature 1..25: note = Synthetic Construct
  source 1..25: mol_type = other DNA
gagcccgagttactggtttaatagt

SEQ ID NO: 5995 - DNA, 22 bp, synthetic construct
  misc_feature 1..22: note = Synthetic Construct
  source 1..22: mol_type = other DNA
aggatgtctgttgggtccctta

SEQ ID NO: 5996 - DNA, 26 bp, synthetic construct
  misc_feature 1..26: note = Synthetic Construct
  source 1..26: mol_type = other DNA
gggagtagcatacttcctttcaggat

SEQ ID NO: 5997 - DNA, 27 bp, synthetic construct
  misc_feature 1..27: note = Synthetic Construct
  source 1..27: mol_type = other DNA
catggacaaaagcttgatggaagtatt

SEQ ID NO: 5998 - DNA, 25 bp, synthetic construct
  misc_feature 1..25: note = Synthetic Construct
  source 1..25: mol_type = other DNA
gttcaggtaagtcaaatgggtctga

SEQ ID NO: 5999 - DNA, 23 bp, synthetic construct
  misc_feature 1..23: note = Synthetic Construct
  source 1..23: mol_type = other DNA
gccttggcaggtgtgaatgtgat

SEQ ID NO: 6000 - DNA, 21 bp, synthetic construct
  misc_feature 1..21: note = Synthetic Construct
  source 1..21: mol_type = other DNA
gttcttccaggccaccgttgt

SEQ ID NO: 6001 - DNA, 22 bp, synthetic construct
  misc_feature 1..22: note = Synthetic Construct
  source 1..22: mol_type = other DNA
ctctgaacctccctgagacaga

SEQ ID NO: 6002 - DNA, 20 bp, synthetic construct
  misc_feature 1..20: note = Synthetic Construct
  source 1..20: mol_type = other DNA
tgggaccaggaacaggcatt

SEQ ID NO: 6003 - DNA, 19 bp, synthetic construct
  misc_feature 1..19: note = Synthetic Construct
  source 1..19: mol_type = other DNA
tgcctggccgaggggttca

SEQ ID NO: 6004 - DNA, 25 bp, synthetic construct
  misc_feature 1..25: note = Synthetic Construct
  source 1..25: mol_type = other DNA
cagacccacaatgcagcaatttagg

SEQ ID NO: 6005 - DNA, 21 bp, synthetic construct
  misc_feature 1..21: note = Synthetic Construct
  source 1..21: mol_type = other DNA
tcacccatcagcgtgtagtga

SEQ ID NO: 6006 - DNA, 21 bp, synthetic construct
  misc_feature 1..21: note = Synthetic Construct
  source 1..21: mol_type = other DNA
agcactgtccaggccaaacat

SEQ ID NO: 6007 - DNA, 21 bp, synthetic construct
  misc_feature 1..21: note = Synthetic Construct
  source 1..21: mol_type = other DNA
tgtgtggggagagcctgtctt

SEQ ID NO: 6008 - DNA, 24 bp, synthetic construct
  misc_feature 1..24: note = Synthetic Construct
  source 1..24: mol_type = other DNA
cggaccttagagacaagctagaca

SEQ ID NO: 6009 - DNA, 24 bp, synthetic construct
  misc_feature 1..24: note = Synthetic Construct
  source 1..24: mol_type = other DNA
cccatttgttctcagaaagcaagt

SEQ ID NO: 6010 - DNA, 21 bp, synthetic construct
  misc_feature 1..21: note = Synthetic Construct
  source 1..21: mol_type = other DNA
ctggccttggatgtcttcagt

SEQ ID NO: 6011 - DNA, 21 bp, synthetic construct
  misc_feature 1..21: note = Synthetic Construct
  source 1..21: mol_type = other DNA
tggagtcttcccagtctgtga

SEQ ID NO: 6012 - DNA, 24 bp, synthetic construct
  misc_feature 1..24: note = Synthetic Construct
  source 1..24: mol_type = other DNA
gagttggaatggggtaggtacttc

SEQ ID NO: 6013 - DNA, 22 bp, synthetic construct
  misc_feature 1..22: note = Synthetic Construct
  source 1..22: mol_type = other DNA
cctttcagttccagagcaagca

SEQ ID NO: 6014 - DNA, 22 bp, synthetic construct
  misc_feature 1..22: note = Synthetic Construct
  source 1..22: mol_type = other DNA
gctgagcacacctgagaacata

SEQ ID NO: 6015 - DNA, 20 bp, synthetic construct
  misc_feature 1..20: note = Synthetic Construct
  source 1..20: mol_type = other DNA
tgtgtgcaaagcaggagaca

SEQ ID NO: 6016 - DNA, 24 bp, synthetic construct
  misc_feature 1..24: note = Synthetic Construct
  source 1..24: mol_type = other DNA
gactcagtacccagttcttttcca

SEQ ID NO: 6017 - DNA, 22 bp, synthetic construct
  misc_feature 1..22: note = Synthetic Construct
  source 1..22: mol_type = other DNA
aggatgcctcggctaaagaaga

SEQ ID NO: 6018 - DNA, 24 bp, synthetic construct
  misc_feature 1..24: note = Synthetic Construct
  source 1..24: mol_type = other DNA
tggtacccctaatgactgtcagaa

SEQ ID NO: 6019 - DNA, 23 bp, synthetic construct
  misc_feature 1..23: note = Synthetic Construct
  source 1..23: mol_type = other DNA
gttcctctgtccagatcttgtgt

SEQ ID NO: 6020 - DNA, 26 bp, synthetic construct
  misc_feature 1..26: note = Synthetic Construct
  source 1..26: mol_type = other DNA
caaggatagtggttcaacactagtga

SEQ ID NO: 6021 - DNA, 19 bp, synthetic construct
  misc_feature 1..19: note = Synthetic Construct
  source 1..19: mol_type = other DNA
gggacaggtcaggcttcct

SEQ ID NO: 6022 - DNA, 26 bp, synthetic construct
  misc_feature 1..26: note = Synthetic Construct
  source 1..26: mol_type = other DNA
atggaacaatgaaacgatgatgaaca

SEQ ID NO: 6023 - DNA, 19 bp, synthetic construct
  misc_feature 1..19: note = Synthetic Construct
  source 1..19: mol_type = other DNA
acagtgcagccaccccatt

SEQ ID NO: 6024 - DNA, 25 bp, synthetic construct
  misc_feature 1..25: note = Synthetic Construct
  source 1..25: mol_type = other DNA
cagaactgctggaaccactactttg

SEQ ID NO: 6025 - DNA, 19 bp, synthetic construct
  misc_feature 1..19: note = Synthetic Construct
  source 1..19: mol_type = other DNA
aggaacagagcggcagaga

SEQ ID NO: 6026 - DNA, 24 bp, synthetic construct
  misc_feature 1..24: note = Synthetic Construct
  source 1..24: mol_type = other DNA
acaacacagatctaccaccaacag

SEQ ID NO: 6027 - DNA, 25 bp, synthetic construct
  misc_feature 1..25: note = Synthetic Construct
  source 1..25: mol_type = other DNA
gtggtgtatctgggcattgatttct

SEQ ID NO: 6028 - DNA, 25 bp, synthetic construct
  misc_feature 1..25: note = Synthetic Construct
  source 1..25: mol_type = other DNA
gagatctcctttcagctcctaatgg

SEQ ID NO: 6029 - DNA, 24 bp, synthetic construct
  misc_feature 1..24: note = Synthetic Construct
  source 1..24: mol_type = other DNA
ccagccaccagtagcaatattgtg

SEQ ID NO: 6030 - DNA, 22 bp, synthetic construct
  misc_feature 1..22: note = Synthetic Construct
  source 1..22: mol_type = other DNA
tcaccagcagagatccttcact

SEQ ID NO: 6031 - DNA, 21 bp, synthetic construct
  misc_feature 1..21: note = Synthetic Construct
  source 1..21: mol_type = other DNA
tgggtctgcttctgggaactg

SEQ ID NO: 6032 - DNA, 24 bp, synthetic construct
  misc_feature 1..24: note = Synthetic Construct
  source 1..24: mol_type = other DNA
tcgtccctacatttgagggctcta

SEQ ID NO: 6033 - DNA, 22 bp, synthetic construct
  misc_feature 1..22: note = Synthetic Construct
  source 1..22: mol_type = other DNA
tccagggctttgggtgttcaat

SEQ ID NO: 6034 - DNA, 22 bp, synthetic construct
  misc_feature 1..22: note = Synthetic Construct
  source 1..22: mol_type = other DNA
atggctcacctcttctccaatg

SEQ ID NO: 6035 - DNA, 25 bp, synthetic construct
  misc_feature 1..25: note = Synthetic Construct
  source 1..25: mol_type = other DNA
caggaattgattctcggattgcatt

SEQ ID NO: 6036 - DNA, 21 bp, synthetic construct
  misc_feature 1..21: note = Synthetic Construct
  source 1..21: mol_type = other DNA
aggcccatcctctcactagac

SEQ ID NO: 6037 - DNA, 22 bp, synthetic construct
  misc_feature 1..22: note = Synthetic Construct
  source 1..22: mol_type = other DNA
tgagaactggagtgtgcaagca

SEQ ID NO: 6038 - DNA, 23 bp, synthetic construct
  misc_feature 1..23: note = Synthetic Construct
  source 1..23: mol_type = other DNA
ctggcccaggtaatgtccataaa

SEQ ID NO: 6039 - DNA, 26 bp, synthetic construct
  misc_feature 1..26: note = Synthetic Construct
  source 1..26: mol_type = other DNA
gacacccctctcacttgtaatgatac

SEQ ID NO: 6040 - DNA, 20 bp, synthetic construct
  misc_feature 1..20: note = Synthetic Construct
  source 1..20: mol_type = other DNA
cctttcagcccagcatctgt

SEQ ID NO: 6041 - DNA, 24 bp, synthetic construct
  misc_feature 1..24: note = Synthetic Construct
  source 1..24: mol_type = other DNA
ggtcaggaacatgcatgagccata

SEQ ID NO: 6042 - DNA, 23 bp, synthetic construct
  misc_feature 1..23: note = Synthetic Construct
  source 1..23: mol_type = other DNA
gggaaatggtgagactcagtgat

SEQ ID NO: 6043 - DNA, 26 bp, synthetic construct
  misc_feature 1..26: note = Synthetic Construct
  source 1..26: mol_type = other DNA
ttatgctagattgcaaaacccaagag

SEQ ID NO: 6044 - DNA, 22 bp, synthetic construct
  misc_feature 1..22: note = Synthetic Construct
  source 1..22: mol_type = other DNA
agcacctaggaggagagatgtg

SEQ ID NO: 6045 - DNA, 22 bp, synthetic construct
  misc_feature 1..22: note = Synthetic Construct
  source 1..22: mol_type = other DNA
ccaaggacagagggtgaggtat

SEQ ID NO: 6046 - DNA, 23 bp, synthetic construct
  misc_feature 1..23: note = Synthetic Construct
  source 1..23: mol_type = other DNA
agcatggacaacctgcatttttc

SEQ ID NO: 6047 - DNA, 24 bp, synthetic construct
  misc_feature 1..24: note = Synthetic Construct
  source 1..24: mol_type = other DNA
gggaagaagacagcaatggtaagc

SEQ ID NO: 6048 - DNA, 25 bp, synthetic construct
  misc_feature 1..25: note = Synthetic Construct
  source 1..25: mol_type = other DNA
tgtctaccctgccttagtattttgc

SEQ ID NO: 6049 - DNA, 23 bp, synthetic construct
  misc_feature 1..23: note = Synthetic Construct
  source 1..23: mol_type = other DNA
gcactgagttcaatgccaattcc

SEQ ID NO: 6050 - DNA, 24 bp, synthetic construct
  misc_feature 1..24: note = Synthetic Construct
  source 1..24: mol_type = other DNA
acctgtctaggggttaggctatct

SEQ ID NO: 6051 - DNA, 24 bp, synthetic construct
  misc_feature 1..24: note = Synthetic Construct
  source 1..24: mol_type = other DNA
tcggctgttagcaactctgttagc

SEQ ID NO: 6052 - DNA, 25 bp, synthetic construct
  misc_feature 1..25: note = Synthetic Construct
  source 1..25: mol_type = other DNA
gggctcagaacttaacttcacatct

SEQ ID NO: 6053 - DNA, 25 bp, synthetic construct
  misc_feature 1..25: note = Synthetic Construct
  source 1..25: mol_type = other DNA
gctggatatctatggatggctgcat

SEQ ID NO: 6054 - DNA, 21 bp, synthetic construct
  misc_feature 1..21: note = Synthetic Construct
  source 1..21: mol_type = other DNA
tcccttgggcatgactttctg

SEQ ID NO: 6055 - DNA, 24 bp, synthetic construct
  misc_feature 1..24: note = Synthetic Construct
  source 1..24: mol_type = other DNA
gtgaacagtatcccaaagcagttc

SEQ ID NO: 6056 - DNA, 23 bp, synthetic construct
  misc_feature 1..23: note = Synthetic Construct
  source 1..23: mol_type = other DNA
tgggtaggagttaggcagagagt

SEQ ID NO: 6057 - DNA, 21 bp, synthetic construct
  misc_feature 1..21: note = Synthetic Construct
  source 1..21: mol_type = other DNA
gctggcttttgggactggtta

SEQ ID NO: 6058 - DNA, 22 bp, synthetic construct
  misc_feature 1..22: note = Synthetic Construct
  source 1..22: mol_type = other DNA
aggaaggctgctgttccatgaa

SEQ ID NO: 6059 - DNA, 25 bp, synthetic construct
  misc_feature 1..25: note = Synthetic Construct
  source 1..25: mol_type = other DNA
ggctatcatggtggctagatttcac

SEQ ID NO: 6060 - DNA, 20 bp, synthetic construct
  misc_feature 1..20: note = Synthetic Construct
  source 1..20: mol_type = other DNA
tggatctgggatgggcaaca

SEQ ID NO: 6061 - DNA, 24 bp, synthetic construct
  misc_feature 1..24: note = Synthetic Construct
  source 1..24: mol_type = other DNA
gtcctggagctgctatatgctaga

SEQ ID NO: 6062 - DNA, 23 bp, synthetic construct
  misc_feature 1..23: note = Synthetic Construct
  source 1..23: mol_type = other DNA
gctgattctgccatatcctgtga

SEQ ID NO: 6063 - DNA, 28 bp, synthetic construct
  misc_feature 1..28: note = Synthetic Construct
  source 1..28: mol_type = other DNA
cactgctttgaaggttagaaggaagtag

SEQ ID NO: 6064 - DNA, 20 bp, synthetic construct
  misc_feature 1..20: note = Synthetic Construct
  source 1..20: mol_type = other DNA
accaactcatgccgccttca

SEQ ID NO: 6065 - DNA, 25 bp, synthetic construct
  misc_feature 1..25: note = Synthetic Construct
  source 1..25: mol_type = other DNA
gacttgcttaggaattgctgtcttt

SEQ ID NO: 6066 - DNA, 25 bp, synthetic construct
  misc_feature 1..25: note = Synthetic Construct
  source 1..25: mol_type = other DNA
caacagatgtttggtgtgattagca

SEQ ID NO: 6067 - DNA, 24 bp, synthetic construct
  misc_feature 1..24: note = Synthetic Construct
  source 1..24: mol_type = other DNA
gagtttttgtcctacctccaggaa

SEQ ID NO: 6068 - DNA, 23 bp, synthetic construct
  misc_feature 1..23: note = Synthetic Construct
  source 1..23: mol_type = other DNA
cagtcacacagagcgtaaatgga

SEQ ID NO: 6069 - DNA, 24 bp, synthetic construct
  misc_feature 1..24: note = Synthetic Construct
  source 1..24: mol_type = other DNA
ctgctttcactcctcctattagca

SEQ ID NO: 6070 - DNA, 26 bp, synthetic construct
  misc_feature 1..26: note = Synthetic Construct
  source 1..26: mol_type = other DNA
aggaccaggtaattttcttcaagtca

SEQ ID NO: 6071 - DNA, 22 bp, synthetic construct
  misc_feature 1..22: note = Synthetic Construct
  source 1..22: mol_type = other DNA
gagctgagatcaggatggcatt

SEQ ID NO: 6072 - DNA, 25 bp, synthetic construct
  misc_feature 1..25: note = Synthetic Construct
  source 1..25: mol_type = other DNA
cttggggaaactttgctctctctaa

SEQ ID NO: 6073 - DNA, 23 bp, synthetic construct
  misc_feature 1..23: note = Synthetic Construct
  source 1..23: mol_type = other DNA
tggatggtgccctttcaaaaact

SEQ ID NO: 6074 - DNA, 26 bp, synthetic construct
  misc_feature 1..26: note = Synthetic Construct
  source 1..26: mol_type = other DNA
gttgcattgaattaaggggagaacac

SEQ ID NO: 6075 - DNA, 26 bp, synthetic construct
  misc_feature 1..26: note = Synthetic Construct
  source 1..26: mol_type = other DNA
tcacagggtattatgtatggaaagca

SEQ ID NO: 6076 - DNA, 24 bp, synthetic construct
  misc_feature 1..24: note = Synthetic Construct
  source 1..24: mol_type = other DNA
agtggggttagggaaagaactact

SEQ ID NO: 6077 - DNA, 20 bp, synthetic construct
  misc_feature 1..20: note = Synthetic Construct
  source 1..20: mol_type = other DNA
tcaacagtgcccggcaatat

SEQ ID NO: 6078 - DNA, 21 bp, synthetic construct
  misc_feature 1..21: note = Synthetic Construct
  source 1..21: mol_type = other DNA
gtgctattgggatggcatgga

SEQ ID NO: 6079 - DNA, 28 bp, synthetic construct
  misc_feature 1..28: note = Synthetic Construct
  source 1..28: mol_type = other DNA
gaagagagttttcccagttcagtttaag

SEQ ID NO: 6080 - DNA, 29 bp, synthetic construct
  misc_feature 1..29: note = Synthetic Construct
  source 1..29: mol_type = other DNA
agtagagtgaaattgtgattctctctcat

SEQ ID NO: 6081 - DNA, 25 bp, synthetic construct
  misc_feature 1..25: note = Synthetic Construct
  source 1..25: mol_type = other DNA
ctgagctccttctctggaattaacc

SEQ ID NO: 6082 - DNA, 21 bp, synthetic construct
  misc_feature 1..21: note = Synthetic Construct
  source 1..21: mol_type = other DNA
tgagcccaccagtaagcaaaa

SEQ ID NO: 6083 - DNA, 27 bp, synthetic construct
  misc_feature 1..27: note = Synthetic Construct
  source 1..27: mol_type = other DNA
atcaccctctttgaaagtaaactacct

SEQ ID NO: 6084 - DNA, 23 bp, synthetic construct
  misc_feature 1..23: note = Synthetic Construct
  source 1..23: mol_type = other DNA
gaagggtactgcatgtacaggaa

SEQ ID NO: 6085 - DNA, 25 bp, synthetic construct
  misc_feature 1..25: note = Synthetic Construct
  source 1..25: mol_type = other DNA
gcctctgcctagtgtgtcaataatc

SEQ ID NO: 6086 - DNA, 25 bp, synthetic construct
  misc_feature 1..25: note = Synthetic Construct
  source 1..25: mol_type = other DNA
gcagccatctgaacttttgattcag

SEQ ID NO: 6087 - DNA, 24 bp, synthetic construct
  misc_feature 1..24: note = Synthetic Construct
  source 1..24: mol_type = other DNA
ctggagactgcctaagactaccaa

SEQ ID NO: 6088 - DNA, 22 bp, synthetic construct
  misc_feature 1..22: note = Synthetic Construct
  source 1..22: mol_type = other DNA
gcggccattaggaagtgatgaa

SEQ ID NO: 6089 - DNA, 20 bp, synthetic construct
  misc_feature 1..20: note = Synthetic Construct
  source 1..20: mol_type = other DNA
acctccaaggtcccagcatt

SEQ ID NO: 6090 - DNA, 23 bp, synthetic construct
  misc_feature 1..23: note = Synthetic Construct
  source 1..23: mol_type = other DNA
gactgaaaccagcctcattgtct

SEQ ID NO: 6091 - DNA, 24 bp, synthetic construct
  misc_feature 1..24: note = Synthetic Construct
  source 1..24: mol_type = other DNA
tccttggacagaggctggtatagg

SEQ ID NO: 6092 - DNA, 24 bp, synthetic construct
  misc_feature 1..24: note = Synthetic Construct
  source 1..24: mol_type = other DNA
cccctctctggttcatgtagacaa

SEQ ID NO: 6093 - DNA, 22 bp, synthetic construct
  misc_feature 1..22: note = Synthetic Construct
  source 1..22: mol_type = other DNA
acagtggccaaagcttcctact

SEQ ID NO: 6094 - DNA, 20 bp, synthetic construct
  misc_feature 1..20: note = Synthetic Construct
  source 1..20: mol_type = other DNA
tgcagtagccaccagtcaca

SEQ ID NO: 6095 - DNA, 23 bp, synthetic construct
  misc_feature 1..23: note = Synthetic Construct
  source 1..23: mol_type = other DNA
gcccagttttcactcacaatgaa

SEQ ID NO: 6096 - DNA, 22 bp, synthetic construct
  misc_feature 1..22: note = Synthetic Construct
  source 1..22: mol_type = other DNA
agggcttcaggtgaaggttaca

SEQ ID NO: 6097 - DNA, 29 bp, synthetic construct
  misc_feature 1..29: note = Synthetic Construct
  source 1..29: mol_type = other DNA
ggaatggctgtaaaagtaagaggaaaacc

SEQ ID NO: 6098 - DNA, 22 bp, synthetic construct
  misc_feature 1..22: note = Synthetic Construct
  source 1..22: mol_type = other DNA
tcctgctaagagtgggaatcca

SEQ ID NO: 6099 - DNA, 28 bp, synthetic construct
  misc_feature 1..28: note = Synthetic Construct
  source 1..28: mol_type = other DNA
atatgtgaaatcctgtgctgtaagtttt

SEQ ID NO: 6100 - DNA, 21 bp, synthetic construct
  misc_feature 1..21: note = Synthetic Construct
  source 1..21: mol_type = other DNA
agggctgccatttctggttgt

SEQ ID NO: 6101 - DNA, 22 bp, synthetic construct
  misc_feature 1..22: note = Synthetic Construct
  source 1..22: mol_type = other DNA
ggctgacactgtgtcacatgaa

SEQ ID NO: 6102 - DNA, 25 bp, synthetic construct
  misc_feature 1..25: note = Synthetic Construct
  source 1..25: mol_type = other DNA
ggcatccttcaatccagtcaacaac

SEQ ID NO: 6103 - DNA, 25 bp, synthetic construct
  misc_feature 1..25: note = Synthetic Construct
  source 1..25: mol_type = other DNA
ggactcagtgagaattggacaaacg

SEQ ID NO: 6104 - DNA, 24 bp, synthetic construct
  misc_feature 1..24: note = Synthetic Construct
  source 1..24: mol_type = other DNA
ggactatgtcctgtaccagatgtg

SEQ ID NO: 6105 - DNA, 25 bp, synthetic construct
  misc_feature 1..25: note = Synthetic Construct
  source 1..25: mol_type = other DNA
ccacattttccatctgctcctggaa

SEQ ID NO: 6106 - DNA, 23 bp, synthetic construct
  misc_feature 1..23: note = Synthetic Construct
  source 1..23: mol_type = other DNA
actcaaggccatagaccctttca

SEQ ID NO: 6107 - DNA, 25 bp, synthetic construct
  misc_feature 1..25: note = Synthetic Construct
  source 1..25: mol_type = other DNA
tgtggaaataagggagggattaagg

SEQ ID NO: 6108 - DNA, 22 bp, synthetic construct
  misc_feature 1..22: note = Synthetic Construct
  source 1..22: mol_type = other DNA
tcagatggactgccaaggtcaa

SEQ ID NO: 6109 - DNA, 21 bp, synthetic construct
  misc_feature 1..21: note = Synthetic Construct
  source 1..21: mol_type = other DNA
gcctcatctcatgggcaagac

SEQ ID NO: 6110 - DNA, 25 bp, synthetic construct
  misc_feature 1..25: note = Synthetic Construct
  source 1..25: mol_type = other DNA
ctaaacctaggactcaacagtcgtt

SEQ ID NO: 6111 - DNA, 24 bp, synthetic construct
  misc_feature 1..24: note = Synthetic Construct
  source 1..24: mol_type = other DNA
gttgtatcagtggagggaaagtct

SEQ ID NO: 6112 - DNA, 27 bp, synthetic construct
  misc_feature 1..27: note = Synthetic Construct
  source 1..27: mol_type = other DNA
tctttgctatttgggctagttattcca

SEQ ID NO: 6113 - DNA, 26 bp, synthetic construct
  misc_feature 1..26: note = Synthetic Construct
  source 1..26: mol_type = other DNA
aactaagagacttggctttcaaatcg

SEQ ID NO: 6114 - DNA, 21 bp, synthetic construct
  misc_feature 1..21: note = Synthetic Construct
  source 1..21: mol_type = other DNA
tccaggagtcagggagtcaca

SEQ ID NO: 6115 - DNA, 27 bp, synthetic construct
  misc_feature 1..27: note = Synthetic Construct
  source 1..27: mol_type = other DNA
tgggtaactacacctactactttcaag

SEQ ID NO: 6116 - DNA, 24 bp, synthetic construct
  misc_feature 1..24: note = Synthetic Construct
  source 1..24: mol_type = other DNA
gtataaggcatgcttagccattgc

SEQ ID NO: 6117 - DNA, 23 bp, synthetic construct
  misc_feature 1..23: note = Synthetic Construct
  source 1..23: mol_type = other DNA
acagaaattggaggaagcaggaa

SEQ ID NO: 6118 - DNA, 25 bp, synthetic construct
  misc_feature 1..25: note = Synthetic Construct
  source 1..25: mol_type = other DNA
gcagacctatgtcttgcaaagcttt

SEQ ID NO: 6119 - DNA, 22 bp, synthetic construct
  misc_feature 1..22: note = Synthetic Construct
  source 1..22: mol_type = other DNA
ttctggctcctgctaagttgga

SEQ ID NO: 6120 - DNA, 26 bp, synthetic construct
  misc_feature 1..26: note = Synthetic Construct
  source 1..26: mol_type = other DNA
ggttgtcaaaagtcagggatgataag

SEQ ID NO: 6121 - DNA, 24 bp, synthetic construct
  misc_feature 1..24: note = Synthetic Construct
  source 1..24: mol_type = other DNA
cttgctgtttctaaggtcgtgaag

SEQ ID NO: 6122 - DNA, 22 bp, synthetic construct
  misc_feature 1..22: note = Synthetic Construct
  source 1..22: mol_type = other DNA
ggaacacaatggaggtgaggtt

SEQ ID NO: 6123 - DNA, 25 bp, synthetic construct
  misc_feature 1..25: note = Synthetic Construct
  source 1..25: mol_type = other DNA
ctcccgaatggatcaaagcttactg

SEQ ID NO: 6124 - DNA, 28 bp, synthetic construct
  misc_feature 1..28: note = Synthetic Construct
  source 1..28: mol_type = other DNA
gggaaaaacatttctctgtgctcatttc

SEQ ID NO: 6125 - DNA, 22 bp, synthetic construct
  misc_feature 1..22: note = Synthetic Construct
  source 1..22: mol_type = other DNA
cctccatttcaggccatagctt

SEQ ID NO: 6126 - DNA, 25 bp, synthetic construct
  misc_feature 1..25: note = Synthetic Construct
  source 1..25: mol_type = other DNA
caatttctgcaaaatctgggtccaa

SEQ ID NO: 6127 - DNA, 23 bp, synthetic construct
  misc_feature 1..23: note = Synthetic Construct
  source 1..23: mol_type = other DNA
tgggaagaattcactcccaacct

SEQ ID NO: 6128 - DNA, 24 bp, synthetic construct
  misc_feature 1..24: note = Synthetic Construct
  source 1..24: mol_type = other DNA
ggctttcttcatagcccaagtaca

SEQ ID NO: 6129 - DNA, 26 bp, synthetic construct
  misc_feature 1..26: note = Synthetic Construct
  source 1..26: mol_type = other DNA
gcagagagcctggaattaacaagact

SEQ ID NO: 6130 - DNA, 26 bp, synthetic construct
  misc_feature 1..26: note = Synthetic Construct
  source 1..26: mol_type = other DNA
cagcgttatgactcatgcctgaatta

SEQ ID NO: 6131 - DNA, 28 bp, synthetic construct
  misc_feature 1..28: note = Synthetic Construct
  source 1..28: mol_type = other DNA
tggtctgggttttatagttttgtattgc

SEQ ID NO: 6132 - DNA, 21 bp, synthetic construct
  misc_feature 1..21: note = Synthetic Construct
  source 1..21: mol_type = other DNA
tgcatctgcagccttcattcc

SEQ ID NO: 6133 - DNA, 20 bp, synthetic construct
  misc_feature 1..20: note = Synthetic Construct
  source 1..20: mol_type = other DNA
atggccagctgttgggttga

SEQ ID NO: 6134 - DNA, 21 bp, synthetic construct
  misc_feature 1..21: note = Synthetic Construct
  source 1..21: mol_type = other DNA
tcaactgggcgcatagttcaa

SEQ ID NO: 6135 - DNA, 22 bp, synthetic construct
  misc_feature 1..22: note = Synthetic Construct
  source 1..22: mol_type = other DNA
gtggtcagcaagacaagaccat

SEQ ID NO: 6136 - DNA, 22 bp, synthetic construct
  misc_feature 1..22: note = Synthetic Construct
  source 1..22: mol_type = other DNA
gacatgctcactgagtgccatt

SEQ ID NO: 6137 - DNA, 21 bp, synthetic construct
  misc_feature 1..21: note = Synthetic Construct
  source 1..21: mol_type = other DNA
aacaggtttccggcagagttt

SEQ ID NO: 6138 - DNA, 24 bp, synthetic construct
  misc_feature 1..24: note = Synthetic Construct
  source 1..24: mol_type = other DNA
ctccaggaatcagtgatggatgaa

SEQ ID NO: 6139 - DNA, 27 bp, synthetic construct
  misc_feature 1..27: note = Synthetic Construct
  source 1..27: mol_type = other DNA
cccaaggaagatagtcagactcttctc

SEQ ID NO: 6140 - DNA, 22 bp, synthetic construct
  misc_feature 1..22: note = Synthetic Construct
  source 1..22: mol_type = other DNA
tccaaggaaacgtcaccaggaa

SEQ ID NO: 6141 - DNA, 21 bp, synthetic construct
  misc_feature 1..21: note = Synthetic Construct
  source 1..21: mol_type = other DNA
atgtggaggaagggcaaaacc

SEQ ID NO: 6142 - DNA, 26 bp, synthetic construct
  misc_feature 1..26: note = Synthetic Construct
  source 1..26: mol_type = other DNA
ggaggactgataacaaatgccatttt

SEQ ID NO: 6143 - DNA, 23 bp, synthetic construct
  misc_feature 1..23: note = Synthetic Construct
  source 1..23: mol_type = other DNA
gcaggttttagctgcatggtctt

SEQ ID NO: 6144 - DNA, 23 bp, synthetic construct
  misc_feature 1..23: note = Synthetic Construct
  source 1..23: mol_type = other DNA
gtggctgctgttttcatggaaga

SEQ ID NO: 6145 - DNA, 28 bp, synthetic construct
  misc_feature 1..28: note = Synthetic Construct
  source 1..28: mol_type = other DNA
agcaggaaaatgataatttgtaggcaaa

SEQ ID NO: 6146 - DNA, 26 bp, synthetic construct
  misc_feature 1..26: note = Synthetic Construct
  source 1..26: mol_type = other DNA
ccaaaaaaaggtcatggtcagtttgt

SEQ ID NO: 6147 - DNA, 24 bp, synthetic construct
  misc_feature 1..24: note = Synthetic Construct
  source 1..24: mol_type = other DNA
ggctcacagaaacagatggtttgg

SEQ ID NO: 6148 - DNA, 25 bp, synthetic construct
  misc_feature 1..25: note = Synthetic Construct
  source 1..25: mol_type = other DNA
agccttgataaaacgtcatctccat

SEQ ID NO: 6149 - DNA, 24 bp, synthetic construct
  misc_feature 1..24: note = Synthetic Construct
  source 1..24: mol_type = other DNA
ggtcacctaaacacagccaatctc

SEQ ID NO: 6150 - DNA, 26 bp, synthetic construct
  misc_feature 1..26: note = Synthetic Construct
  source 1..26: mol_type = other DNA
ctgaattggtaaacacaatggatgca

SEQ ID NO: 6151 - DNA, 29 bp, synthetic construct
  misc_feature 1..29: note = Synthetic Construct
  source 1..29: mol_type = other DNA
tgtgtttatggttaaacaggaaagtagga

SEQ ID NO: 6152 - DNA, 24 bp, synthetic construct
  misc_feature 1..24: note = Synthetic Construct
  source 1..24: mol_type = other DNA
tgcttttggacctcattcttttcc

SEQ ID NO: 6153 - DNA, 30 bp, synthetic construct
  misc_feature 1..30: note = Synthetic Construct
  source 1..30: mol_type = other DNA
cttccattgtagagtggtagtctaattttc

SEQ ID NO: 6154 - DNA, 26 bp, synthetic construct
  misc_feature 1..26: note = Synthetic Construct
  source 1..26: mol_type = other DNA
cagaagtttctctgccatagtcattg

SEQ ID NO: 6155 - DNA, 27 bp, synthetic construct
  misc_feature 1..27: note = Synthetic Construct
  source 1..27: mol_type = other DNA
gccacaccctaaaattctaataatgca

SEQ ID NO: 6156 - DNA, 22 bp, synthetic construct
  misc_feature 1..22: note = Synthetic Construct
  source 1..22: mol_type = other DNA
tctggtgagtgctgctctctat

SEQ ID NO: 6157 - DNA, 27 bp, synthetic construct
  misc_feature 1..27: note = Synthetic Construct
  source 1..27: mol_type = other DNA
ctgagtctgtgttcaggaatgaactag

SEQ ID NO: 6158 - DNA, 21 bp, synthetic construct
  misc_feature 1..21: note = Synthetic Construct
  source 1..21: mol_type = other DNA
agccacttccaaggtgagcta

SEQ ID NO: 6159 - DNA, 24 bp, synthetic construct
  misc_feature 1..24: note = Synthetic Construct
  source 1..24: mol_type = other DNA
caccaagcagatagcactaagcaa

SEQ ID NO: 6160 - DNA, 20 bp, synthetic construct
  misc_feature 1..20: note = Synthetic Construct
  source 1..20: mol_type = other DNA
ccattgctgccaccattgct

SEQ ID NO: 6161 - DNA, 27 bp, synthetic construct
  misc_feature 1..27: note = Synthetic Construct
  source 1..27: mol_type = other DNA
gtcttccaactacctgaatctgaaagc

SEQ ID NO: 6162 - DNA, 22 bp, synthetic construct
  misc_feature 1..22: note = Synthetic Construct
  source 1..22: mol_type = other DNA
ctatgcccagttctgccttagg

SEQ ID NO: 6163 - DNA, 23 bp, synthetic construct
  misc_feature 1..23: note = Synthetic Construct
  source 1..23: mol_type = other DNA
catgccccttctttaaggtgctt

SEQ ID NO: 6164 - DNA, 27 bp, synthetic construct
  misc_feature 1..27: note = Synthetic Construct
  source 1..27: mol_type = other DNA
ggagaaagcaacaaatgaattctcctt

SEQ ID NO: 6165 - DNA, 27 bp, synthetic construct
  misc_feature 1..27: note = Synthetic Construct
  source 1..27: mol_type = other DNA
gttcagtaatggaaaatggttgtcagt

SEQ ID NO: 6166 - DNA, 29 bp, synthetic construct
  misc_feature 1..29: note = Synthetic Construct
  source 1..29: mol_type = other DNA
caccctataaaaatcaatcagggtattcc

SEQ ID NO: 6167 - DNA, 25 bp, synthetic construct
  misc_feature 1..25: note = Synthetic Construct
  source 1..25: mol_type = other DNA
catggtgccctatactagctttcac

SEQ ID NO: 6168 - DNA, 24 bp, synthetic construct
  misc_feature 1..24: note = Synthetic Construct
  source 1..24: mol_type = other DNA
cccaaaaagagggaatcagaccat

SEQ ID NO: 6169 - DNA, 26 bp, synthetic construct
  misc_feature 1..26: note = Synthetic Construct
  source 1..26: mol_type = other DNA
ggtaatgagaatctcagctgggactt

SEQ ID NO: 6170 - DNA, 29 bp, synthetic construct
  misc_feature 1..29: note = Synthetic Construct
  source 1..29: mol_type = other DNA
catacaatttatcattgtcacaccaccta

SEQ ID NO: 6171 - DNA, 24 bp, synthetic construct
  misc_feature 1..24: note = Synthetic Construct
  source 1..24: mol_type = other DNA
agaagcccctggtaaaggaagaag

SEQ ID NO: 6172 - DNA, 22 bp, synthetic construct
  misc_feature 1..22: note = Synthetic Construct
  source 1..22: mol_type = other DNA
gctctaagtcaagggaggcttt

SEQ ID NO: 6173 - DNA, 24 bp, synthetic construct
  misc_feature 1..24: note = Synthetic Construct
  source 1..24: mol_type = other DNA
gcaggcatgaattcatagcttcca

SEQ ID NO: 6174 - DNA, 22 bp, synthetic construct
  misc_feature 1..22: note = Synthetic Construct
  source 1..22: mol_type = other DNA
agggccctcttcctggttgata

SEQ ID NO: 6175 - DNA, 27 bp, synthetic construct
  misc_feature 1..27: note = Synthetic Construct
  source 1..27: mol_type = other DNA
gtgggtaaatgaggttttgaaaactct

SEQ ID NO: 6176 - DNA, 25 bp, synthetic construct
  misc_feature 1..25: note = Synthetic Construct
  source 1..25: mol_type = other DNA
aagcaaagtagttaaggccaagaac

SEQ ID NO: 6177 - DNA, 24 bp, synthetic construct
  misc_feature 1..24: note = Synthetic Construct
  source 1..24: mol_type = other DNA
gaagtgctggtctgttgttttgtt

SEQ ID NO: 6178 - DNA, 28 bp, synthetic construct
  misc_feature 1..28: note = Synthetic Construct
  source 1..28: mol_type = other DNA
aggttacaagagaagacttacaccttag

SEQ ID NO: 6179 - DNA, 25 bp, synthetic construct
  misc_feature 1..25: note = Synthetic Construct
  source 1..25: mol_type = other DNA
cagggggaaactttgaagagacttc

SEQ ID NO: 6180 - DNA, 22 bp, synthetic construct
  misc_feature 1..22: note = Synthetic Construct
  source 1..22: mol_type = other DNA
tgacagcaccagtgacagaaat

SEQ ID NO: 6181 - DNA, 28 bp, synthetic construct
  misc_feature 1..28: note = Synthetic Construct
  source 1..28: mol_type = other DNA
tcaaaatcctactcatatgtcagttgga

SEQ ID NO: 6182 - DNA, 29 bp, synthetic construct
  misc_feature 1..29: note = Synthetic Construct
  source 1..29: mol_type = other DNA
gggctacaaatcaaggttaattccacttc

SEQ ID NO: 6183 - DNA, 27 bp, synthetic construct
  misc_feature 1..27: note = Synthetic Construct
  source 1..27: mol_type = other DNA
cctattttcacagcaccttttgatgac

SEQ ID NO: 6184 - DNA, 26 bp, synthetic construct
  misc_feature 1..26: note = Synthetic Construct
  source 1..26: mol_type = other DNA
ctctcccatgactaggattgtaaagg

SEQ ID NO: 6185 - DNA, 24 bp, synthetic construct
  misc_feature 1..24: note = Synthetic Construct
  source 1..24: mol_type = other DNA
gcatctcagaagttaccactccat

SEQ ID NO: 6186 - DNA, 22 bp, synthetic construct
  misc_feature 1..22: note = Synthetic Construct
  source 1..22: mol_type = other DNA
gcccaggaagtcaaaccactta

SEQ ID NO: 6187 - DNA, 26 bp, synthetic construct
  misc_feature 1..26: note = Synthetic Construct
  source 1..26: mol_type = other DNA
gacaagttttgagtttaccactgcta

SEQ ID NO: 6188 - DNA, 22 bp, synthetic construct
  misc_feature 1..22: note = Synthetic Construct
  source 1..22: mol_type = other DNA
ggggtcatgaagcattgccttt

SEQ ID NO: 6189 - DNA, 26 bp, synthetic construct
  misc_feature 1..26: note = Synthetic Construct
  source 1..26: mol_type = other DNA
tcgtgattatgtgagtcagcaatttg

SEQ ID NO: 6190 - DNA, 28 bp, synthetic construct
  misc_feature 1..28: note = Synthetic Construct
  source 1..28: mol_type = other DNA
ggagtctccatttcaaaccacatttcag

SEQ ID NO: 6191 - DNA, 28 bp, synthetic construct
  misc_feature 1..28: note = Synthetic Construct
  source 1..28: mol_type = other DNA
ctcaatgaaaatgagggggtatttttgt

SEQ ID NO: 6192 - DNA, 25 bp, synthetic construct
  misc_feature 1..25: note = Synthetic Construct
  source 1..25: mol_type = other DNA
gtgaaatatgctgcctccaaaatct

SEQ ID NO: 6193 - DNA, 26 bp, synthetic construct
  misc_feature 1..26: note = Synthetic Construct
  source 1..26: mol_type = other DNA
ctttaccagttgtcaagtgaaacgta

SEQ ID NO: 6194 - DNA, 28 bp, synthetic construct
  misc_feature 1..28: note = Synthetic Construct
  source 1..28: mol_type = other DNA
ggtcctgaggaaatgctatatatggaat

SEQ ID NO: 6195 - DNA, 23 bp, synthetic construct
  misc_feature 1..23: note = Synthetic Construct
  source 1..23: mol_type = other DNA
cacacttgccctatctgatgtca

SEQ ID NO: 6196 - DNA, 21 bp, synthetic construct
  misc_feature 1..21: note = Synthetic Construct
  source 1..21: mol_type = other DNA
ccactcccacaggaccctaaa

SEQ ID NO: 6197 - DNA, 27 bp, synthetic construct
  misc_feature 1..27: note = Synthetic Construct
  source 1..27: mol_type = other DNA
cgtctatggaattcgagggagatcata

SEQ ID NO: 6198 - DNA, 20 bp, synthetic construct
  misc_feature 1..20: note = Synthetic Construct
  source 1..20: mol_type = other DNA
cggctgttgatcctgacgta

SEQ ID NO: 6199 - DNA, 22 bp, synthetic construct
  misc_feature 1..22: note = Synthetic Construct
  source 1..22: mol_type = other DNA
tggggatcatggggattatgga

SEQ ID NO: 6200 - DNA, 27 bp, synthetic construct
  misc_feature 1..27: note = Synthetic Construct
  source 1..27: mol_type = other DNA
ctactcgctctaaattggattgattcc

SEQ ID NO: 6201 - DNA, 20 bp, synthetic construct
  misc_feature 1..20: note = Synthetic Construct
  source 1..20: mol_type = other DNA
gccacacccaccagtgttct

SEQ ID NO: 6202 - DNA, 29 bp, synthetic construct
  misc_feature 1..29: note = Synthetic Construct
  source 1..29: mol_type = other DNA
cactgtctggaattatttatacccatcct

SEQ ID NO: 6203 - DNA, 24 bp, synthetic construct
  misc_feature 1..24: note = Synthetic Construct
  source 1..24: mol_type = other DNA
gggtctcatctttgcaagcagata

SEQ ID NO: 6204 - DNA, 22 bp, synthetic construct
  misc_feature 1..22: note = Synthetic Construct
  source 1..22: mol_type = other DNA
cctgaagccgtatgacaagaca

SEQ ID NO: 6205 - DNA, 22 bp, synthetic construct
  misc_feature 1..22: note = Synthetic Construct
  source 1..22: mol_type = other DNA
tcctctggcccatctcttctag

SEQ ID NO: 6206 - DNA, 24 bp, synthetic construct
  misc_feature 1..24: note = Synthetic Construct
  source 1..24: mol_type = other DNA
gccctctctacagtaagtgagttc

SEQ ID NO: 6207 - DNA, 27 bp, synthetic construct
  misc_feature 1..27: note = Synthetic Construct
  source 1..27: mol_type = other DNA
gggatgaactgtgatgttggagatagc

SEQ ID NO: 6208 - DNA, 24 bp, synthetic construct
  misc_feature 1..24: note = Synthetic Construct
  source 1..24: mol_type = other DNA
actccatcactgttacctgttgtg

SEQ ID NO: 6209 - DNA, 26 bp, synthetic construct
  misc_feature 1..26: note = Synthetic Construct
  source 1..26: mol_type = other DNA
ctgagttcagtgtaaacttccccatt

SEQ ID NO: 6210 - DNA, 28 bp, synthetic construct
  misc_feature 1..28: note = Synthetic Construct
  source 1..28: mol_type = other DNA
aacatccatttcctccagatttatgaac

SEQ ID NO: 6211 - DNA, 28 bp, synthetic construct
  misc_feature 1..28: note = Synthetic Construct
  source 1..28: mol_type = other DNA
ctcatgcaagagttttcttaaagcctta

SEQ ID NO: 6212 - DNA, 27 bp, synthetic construct
  misc_feature 1..27: note = Synthetic Construct
  source 1..27: mol_type = other DNA
gtcagtgggtctctgaaacttttagtg

SEQ ID NO: 6213 - DNA, 26 bp, synthetic construct
  misc_feature 1..26: note = Synthetic Construct
  source 1..26: mol_type = other DNA
actgactgaaaattggcttgaaaagg

SEQ ID NO: 6214 - DNA, 28 bp, synthetic construct
  misc_feature 1..28: note = Synthetic Construct
  source 1..28: mol_type = other DNA
gcttcttgcttataccattgcagtaagc

SEQ ID NO: 6215 - DNA, 26 bp, synthetic construct
  misc_feature 1..26: note = Synthetic Construct
  source 1..26: mol_type = other DNA
caacaaaactgtaatactggcactgt

SEQ ID NO: 6216 - DNA, 23 bp, synthetic construct
  misc_feature 1..23: note = Synthetic Construct
  source 1..23: mol_type = other DNA
tggtaaggccatgttttccttga

SEQ ID NO: 6217 - DNA, 25 bp, synthetic construct
  misc_feature 1..25: note = Synthetic Construct
  source 1..25: mol_type = other DNA
ccctcacttcaatgaatccaagaca

SEQ ID NO: 6218 - DNA, 24 bp, synthetic construct
  misc_feature 1..24: note = Synthetic Construct
  source 1..24: mol_type = other DNA
tcctcagaaatgtgccaaaactct

SEQ ID NO: 6219 - DNA, 25 bp, synthetic construct
  misc_feature 1..25: note = Synthetic Construct
  source 1..25: mol_type = other DNA
acagctatttcactgccacaatttg

SEQ ID NO: 6220 - DNA, 24 bp, synthetic construct
  misc_feature 1..24: note = Synthetic Construct
  source 1..24: mol_type = other DNA
cagtctggaagtccgtgttaattg

SEQ ID NO: 6221 - DNA, 24 bp, synthetic construct
  misc_feature 1..24: note = Synthetic Construct
  source 1..24: mol_type = other DNA
cacttttttggtgccagagagaag

SEQ ID NO: 6222 - DNA, 24 bp, synthetic construct
  misc_feature 1..24: note = Synthetic Construct
  source 1..24: mol_type = other DNA
ttatgggggaggagaaagtgattg

SEQ ID NO: 6223 - DNA, 22 bp, synthetic construct
  misc_feature 1..22: note = Synthetic Construct
  source 1..22: mol_type = other DNA
acccatgccttgtgtgtgcata

SEQ ID NO: 6224 - DNA, 22 bp, synthetic construct
  misc_feature 1..22: note = Synthetic Construct
  source 1..22: mol_type = other DNA
cctgcttgcttggtgatgtgtt

SEQ ID NO: 6225 - DNA, 25 bp, synthetic construct
  misc_feature 1..25: note = Synthetic Construct
  source 1..25: mol_type = other DNA
gctgagtcctgtcaattacccagta

SEQ ID NO: 6226 - DNA, 20 bp, synthetic construct
  misc_feature 1..20: note = Synthetic Construct
  source 1..20: mol_type = other DNA
gggcgattccagcactctct

SEQ ID NO: 6227 - DNA, 24 bp, synthetic construct
  misc_feature 1..24: note = Synthetic Construct
  source 1..24: mol_type = other DNA
cattcaataagggccacctctttg

SEQ ID NO: 6228 - DNA, 28 bp, synthetic construct
  misc_feature 1..28: note = Synthetic Construct
  source 1..28: mol_type = other DNA
ctgtaaccgcatagtatagtttcaagct

SEQ ID NO: 6229 - DNA, 22 bp, synthetic construct
  misc_feature 1..22: note = Synthetic Construct
  source 1..22: mol_type = other DNA
tgtgtcaggtctccttgtgtct

SEQ ID NO: 6230 - DNA, 27 bp, synthetic construct
  misc_feature 1..27: note = Synthetic Construct
  source 1..27: mol_type = other DNA
ccaaggttaaatgactcacctgaagtc

SEQ ID NO: 6231 - DNA, 27 bp, synthetic construct
  misc_feature 1..27: note = Synthetic Construct
  source 1..27: mol_type = other DNA
cctgcctctatggttgtaactttaaag

SEQ ID NO: 6232 - DNA, 26 bp, synthetic construct
  misc_feature 1..26: note = Synthetic Construct
  source 1..26: mol_type = other DNA
gagggagggtaagttactacaagtca

SEQ ID NO: 6233 - DNA, 30 bp, synthetic construct
  misc_feature 1..30: note = Synthetic Construct
  source 1..30: mol_type = other DNA
cccaaaatttctttgttaccaattggcaaa

SEQ ID NO: 6234 - DNA, 28 bp, synthetic construct
  misc_feature 1..28: note = Synthetic Construct
  source 1..28: mol_type = other DNA
ctcctgattcctatgcaaagaatttgag

SEQ ID NO: 6235 - DNA, 24 bp, synthetic construct
  misc_feature 1..24: note = Synthetic Construct
  source 1..24: mol_type = other DNA
ccctccaggcctcataaaaactag

SEQ ID NO: 6236 - DNA, 27 bp, synthetic construct
  misc_feature 1..27: note = Synthetic Construct
  source 1..27: mol_type = other DNA
gggcaatacttccaaggttatcccata

SEQ ID NO: 6237 - DNA, 22 bp, synthetic construct
  misc_feature 1..22: note = Synthetic Construct
  source 1..22: mol_type = other DNA
cttgccactgtgagttcaagtg

SEQ ID NO: 6238 - DNA, 30 bp, synthetic construct
  misc_feature 1..30: note = Synthetic Construct
  source 1..30: mol_type = other DNA
acaaactaaataaacgacccattctgttat

SEQ ID NO: 6239 - DNA, 22 bp, synthetic construct
  misc_feature 1..22: note = Synthetic Construct
  source 1..22: mol_type = other DNA
tggagacaagtggcacgtaaaa

SEQ ID NO: 6240 - DNA, 30 bp, synthetic construct
  misc_feature 1..30: note = Synthetic Construct
  source 1..30: mol_type = other DNA
gtgtccctctaaatacaactattgcttacc

SEQ ID NO: 6241 - DNA, 22 bp, synthetic construct
  misc_feature 1..22: note = Synthetic Construct
  source 1..22: mol_type = other DNA
gtcgccgaagtactgagatgaa

SEQ ID NO: 6242 - DNA, 21 bp, synthetic construct
  misc_feature 1..21: note = Synthetic Construct
  source 1..21: mol_type = other DNA
aaagctgcctgggagggaaaa

SEQ ID NO: 6243 - DNA, 23 bp, synthetic construct
  misc_feature 1..23: note = Synthetic Construct
  source 1..23: mol_type = other DNA
ctcctagcaaacctgtgaggaaa

SEQ ID NO: 6244 - DNA, 25 bp, synthetic construct
  misc_feature 1..25: note = Synthetic Construct
  source 1..25: mol_type = other DNA
ggcattgctaagagttgtaactgtt

SEQ ID NO: 6245 - DNA, 26 bp, synthetic construct
  misc_feature 1..26: note = Synthetic Construct
  source 1..26: mol_type = other DNA
aacatctgtcagactgtaatcaccat

SEQ ID NO: 6246 - DNA, 22 bp, synthetic construct
  misc_feature 1..22: note = Synthetic Construct
  source 1..22: mol_type = other DNA
tcctgctccactctcactctgt

SEQ ID NO: 6247 - DNA, 29 bp, synthetic construct
  misc_feature 1..29: note = Synthetic Construct
  source 1..29: mol_type = other DNA
ggttgggtagaatactttagctttgattc

SEQ ID NO: 6248 - DNA, 26 bp, synthetic construct
  misc_feature 1..26: note = Synthetic Construct
  source 1..26: mol_type = other DNA
ggtcaacactcagaattgaccctgat

SEQ ID NO: 6249 - DNA, 27 bp, synthetic construct
  misc_feature 1..27: note = Synthetic Construct
  source 1..27: mol_type = other DNA
gtgatagataaccctcttcctcattgt

SEQ ID NO: 6250 - DNA, 23 bp, synthetic construct
  misc_feature 1..23: note = Synthetic Construct
  source 1..23: mol_type = other DNA
actggatgtcctcccatgctaaa

SEQ ID NO: 6251 - DNA, 29 bp, synthetic construct
  misc_feature 1..29: note = Synthetic Construct
  source 1..29: mol_type = other DNA
agaactttattcccagtaggatacacaaa

SEQ ID NO: 6252 - DNA, 28 bp, synthetic construct
  misc_feature 1..28: note = Synthetic Construct
  source 1..28: mol_type = other DNA
aagctgtaataaaactctgccagtaatg

SEQ ID NO: 6253 - DNA, 26 bp, synthetic construct
  misc_feature 1..26: note = Synthetic Construct
  source 1..26: mol_type = other DNA
gcctttaaagcaggtgtgtaccaatc

SEQ ID NO: 6254 - DNA, 29 bp, synthetic construct
  misc_feature 1..29: note = Synthetic Construct
  source 1..29: mol_type = other DNA
cctgtagatagaccctaaccattgtaacc

SEQ ID NO: 6255 - DNA, 21 bp, synthetic construct
  misc_feature 1..21: note = Synthetic Construct
  source 1..21: mol_type = other DNA
ctaagcgataaggcggcaaac

SEQ ID NO: 6256 - DNA, 28 bp, synthetic construct
  misc_feature 1..28: note = Synthetic Construct
  source 1..28: mol_type = other DNA
gcgatgtgcttttcagatagatggtatc

SEQ ID NO: 6257 - DNA, 26 bp, synthetic construct
  misc_feature 1..26: note = Synthetic Construct
  source 1..26: mol_type = other DNA
ccatggaactaagacagagaccaact

SEQ ID NO: 6258 - DNA, 22 bp, synthetic construct
  misc_feature 1..22: note = Synthetic Construct
  source 1..22: mol_type = other DNA
gtccctaacctctgcaatttgc

SEQ ID NO: 6259 - DNA, 28 bp, synthetic construct
  misc_feature 1..28: note = Synthetic Construct
  source 1..28: mol_type = other DNA
aatacttatgcaagcttttcatgaaacg

SEQ ID NO: 6260 - DNA, 20 bp, synthetic construct
  misc_feature 1..20: note = Synthetic Construct
  source 1..20: mol_type = other DNA
agaaaggctgcctgcagatg

SEQ ID NO: 6261 - DNA, 26 bp, synthetic construct
  misc_feature 1..26: note = Synthetic Construct
  source 1..26: mol_type = other DNA
ggctttgagttaacctttgaagtctt

SEQ ID NO: 6262 - DNA, 27 bp, synthetic construct
  misc_feature 1..27: note = Synthetic Construct
  source 1..27: mol_type = other DNA
ggaaagtttgaccacaaattgacaatc

SEQ ID NO: 6263 - DNA, 26 bp, synthetic construct
  misc_feature 1..26: note = Synthetic Construct
  source 1..26: mol_type = other DNA
ggctgattaccctgggtaaaggtatc

SEQ ID NO: 6264 - DNA, 28 bp, synthetic construct
  misc_feature 1..28: note = Synthetic Construct
  source 1..28: mol_type = other DNA
gcttgaatagtgaaagcaatcctaatcc

SEQ ID NO: 6265 - DNA, 26 bp, synthetic construct
  misc_feature 1..26: note = Synthetic Construct
  source 1..26: mol_type = other DNA
ctgtgttgtgtttcttttggttgaca

SEQ ID NO: 6266 - DNA, 23 bp, synthetic construct
  misc_feature 1..23: note = Synthetic Construct
  source 1..23: mol_type = other DNA
ggcagaagagtaatggactgcat

SEQ ID NO: 6267 - DNA, 25 bp, synthetic construct
  misc_feature 1..25: note = Synthetic Construct
  source 1..25: mol_type = other DNA
ctcagttcacacaaaggatcttcca

SEQ ID NO: 6268 - DNA, 29 bp, synthetic construct
  misc_feature 1..29: note = Synthetic Construct
  source 1..29: mol_type = other DNA
gtgattaccacaccagttaaagaaagaac

SEQ ID NO: 6269 - DNA, 22 bp, synthetic construct
  misc_feature 1..22: note = Synthetic Construct
  source 1..22: mol_type = other DNA
aactgagctgatggcagttagg

SEQ ID NO: 6270 - DNA, 27 bp, synthetic construct
  misc_feature 1..27: note = Synthetic Construct
  source 1..27: mol_type = other DNA
ctattggcaggatctttctgtttgtag

SEQ ID NO: 6271 - DNA, 26 bp, synthetic construct
  misc_feature 1..26: note = Synthetic Construct
  source 1..26: mol_type = other DNA
ttaatctgtcttacactctgctgaca

SEQ ID NO: 6272 - DNA, 21 bp, synthetic construct
  misc_feature 1..21: note = Synthetic Construct
  source 1..21: mol_type = other DNA
ggaggccctccattctttgtt

SEQ ID NO: 6273 - DNA, 30 bp, synthetic construct
  misc_feature 1..30: note = Synthetic Construct
  source 1..30: mol_type = other DNA
cacaataatagcttcttacttgtgcatttc

SEQ ID NO: 6274 - DNA, 21 bp, synthetic construct
  misc_feature 1..21: note = Synthetic Construct
  source 1..21: mol_type = other DNA
agccttccagatccccttgtt

SEQ ID NO: 6275 - DNA, 30 bp, synthetic construct
  misc_feature 1..30: note = Synthetic Construct
  source 1..30: mol_type = other DNA
ccagttgactaccatcacagatacaagatg

SEQ ID NO: 6276 - DNA, 26 bp, synthetic construct
  misc_feature 1..26: note = Synthetic Construct
  source 1..26: mol_type = other DNA
gcatataactgtggtgggtaattgtg

SEQ ID NO: 6277 - DNA, 28 bp, synthetic construct
  misc_feature 1..28: note = Synthetic Construct
  source 1..28: mol_type = other DNA
ccactagaatacaaatccacttctgaca

SEQ ID NO: 6278 - DNA, 22 bp, synthetic construct
  misc_feature 1..22: note = Synthetic Construct
  source 1..22: mol_type = other DNA
agggtgacatgcttcacagatc

SEQ ID NO: 6279 - DNA, 28 bp, synthetic construct
  misc_feature 1..28: note = Synthetic Construct
  source 1..28: mol_type = other DNA
aggttagtagtcaaggcctatgttttac

SEQ ID NO: 6280 - DNA, 22 bp, synthetic construct
  misc_feature 1..22: note = Synthetic Construct
  source 1..22: mol_type = other DNA
gcaacctatagcagcctggatt

SEQ ID NO: 6281 - DNA, 21 bp, synthetic construct
  misc_feature 1..21: note = Synthetic Construct
  source 1..21: mol_type = other DNA
aaaggccccaaaccctttgct

SEQ ID NO: 6282 - DNA, 28 bp, synthetic construct
  misc_feature 1..28: note = Synthetic Construct
  source 1..28: mol_type = other DNA
ccctcattctatggtattgattccacaa

SEQ ID NO: 6283 - DNA, 24 bp, synthetic construct
  misc_feature 1..24: note = Synthetic Construct
  source 1..24: mol_type = other DNA
ggggatcacaaaactgtcattctg

SEQ ID NO: 6284 - DNA, 29 bp, synthetic construct
  misc_feature 1..29: note = Synthetic Construct
  source 1..29: mol_type = other DNA
gcattattcggatactacaaccagacgaa

SEQ ID NO: 6285 - DNA, 26 bp, synthetic construct
  misc_feature 1..26: note = Synthetic Construct
  source 1..26: mol_type = other DNA
tgaaagacaatttgccggtatgttac

SEQ ID NO: 6286 - DNA, 26 bp, synthetic construct
  misc_feature 1..26: note = Synthetic Construct
  source 1..26: mol_type = other DNA
cctgaggtccccatgaagagctataa

SEQ ID NO: 6287 - DNA, 22 bp, synthetic construct
  misc_feature 1..22: note = Synthetic Construct
  source 1..22: mol_type = other DNA
tcgggaatgctgaggaaaagag

SEQ ID NO: 6288 - DNA, 21 bp, synthetic construct
  misc_feature 1..21: note = Synthetic Construct
  source 1..21: mol_type = other DNA
gagccctctccgtttgtcaca

SEQ ID NO: 6289 - DNA, 22 bp, synthetic construct
  misc_feature 1..22: note = Synthetic Construct
  source 1..22: mol_type = other DNA
gctggacaaactactgcctctt

SEQ ID NO: 6290 - DNA, 22 bp, synthetic construct
  misc_feature 1..22: note = Synthetic Construct
  source 1..22: mol_type = other DNA
cagcttccctcttttgctctgt

SEQ ID NO: 6291 - DNA, 23 bp, synthetic construct
  misc_feature 1..23: note = Synthetic Construct
  source 1..23: mol_type = other DNA
gaactcaaatggcctgtgaagtc

SEQ ID NO: 6292 - DNA, 22 bp, synthetic construct
  misc_feature 1..22: note = Synthetic Construct
  source 1..22: mol_type = other DNA
caacggatggagatgcaaccat

SEQ ID NO: 6293 - DNA, 20 bp, synthetic construct
  misc_feature 1..20: note = Synthetic Construct
  source 1..20: mol_type = other DNA
atctggggcccatcctttgg

SEQ ID NO: 6294 - DNA, 22 bp, synthetic construct
  misc_feature 1..22: note = Synthetic Construct
  source 1..22: mol_type = other DNA
gcctggagaagaggtagatgtg

SEQ ID NO: 6295 - DNA, 25 bp, synthetic construct
  misc_feature 1..25: note = Synthetic Construct
  source 1..25: mol_type = other DNA
cgatctccttgtttcacctctttcc

SEQ ID NO: 6296 - DNA, 20 bp, synthetic construct
  misc_feature 1..20: note = Synthetic Construct
  source 1..20: mol_type = other DNA
agccccatgtctgtgatggt

SEQ ID NO: 6297 - DNA, 18 bp, synthetic construct
  misc_feature 1..18: note = Synthetic Construct
  source 1..18: mol_type = other DNA
ctcgccagcatggtgaca

SEQ ID NO: 6298 - DNA, 20 bp, synthetic construct
  misc_feature 1..20: note = Synthetic Construct
  source 1..20: mol_type = other DNA
tccactgggcccatctctct

SEQ ID NO: 6299 - DNA, 22 bp, synthetic construct
  misc_feature 1..22: note = Synthetic Construct
  source 1..22: mol_type = other DNA
ggtggacaaggtggaaaagtct

SEQ ID NO: 6300 - DNA, 30 bp, synthetic construct
  misc_feature 1..30: note = Synthetic Construct
  source 1..30: mol_type = other DNA
ctagtcttaagagtataaggtagggtgaga

SEQ ID NO: 6301 - DNA, 22 bp, synthetic construct
  misc_feature 1..22: note = Synthetic Construct
  source 1..22: mol_type = other DNA
tttgcccttcccagacaagaca

SEQ ID NO: 6302 - DNA, 20 bp, synthetic construct
  misc_feature 1..20: note = Synthetic Construct
  source 1..20: mol_type = other DNA
ccaccgagctcctcctgtct

SEQ ID NO: 6303 - DNA, 20 bp, synthetic construct
  misc_feature 1..20: note = Synthetic Construct
  source 1..20: mol_type = other DNA
tgcagggaaggactgttgtc

SEQ ID NO: 6304 - DNA, 22 bp, synthetic construct
  misc_feature 1..22: note = Synthetic Construct
  source 1..22: mol_type = other DNA
tcacccaccattcatgcaagag

SEQ ID NO: 6305 - DNA, 23 bp, synthetic construct
  misc_feature 1..23: note = Synthetic Construct
  source 1..23: mol_type = other DNA
gggaatacagtgcaaagcaagga

SEQ ID NO: 6306 - DNA, 24 bp, synthetic construct
  misc_feature 1..24: note = Synthetic Construct
  source 1..24: mol_type = other DNA
gcgcagtagagaagaggcttttag

SEQ ID NO: 6307 - DNA, 25 bp, synthetic construct
  misc_feature 1..25: note = Synthetic Construct
  source 1..25: mol_type = other DNA
caagctaattctgcagcaagtatga

SEQ ID NO: 6308 - DNA, 26 bp, synthetic construct
  misc_feature 1..26: note = Synthetic Construct
  source 1..26: mol_type = other DNA
actcttagttaacacagccatggtat

SEQ ID NO: 6309 - DNA, 21 bp, synthetic construct
  misc_feature 1..21: note = Synthetic Construct
  source 1..21: mol_type = other DNA
attgtggaggcctgaaatgct

SEQ ID NO: 6310 - DNA, 26 bp, synthetic construct
  misc_feature 1..26: note = Synthetic Construct
  source 1..26: mol_type = other DNA
gggctgtttccataatcatcctacct

SEQ ID NO: 6311 - DNA, 23 bp, synthetic construct
  misc_feature 1..23: note = Synthetic Construct
  source 1..23: mol_type = other DNA
tcacaaccagttttcaccaacca

SEQ ID NO: 6312 - DNA, 23 bp, synthetic construct
  misc_feature 1..23: note = Synthetic Construct
  source 1..23: mol_type = other DNA
gagctgagtaaagccatgtgtca

SEQ ID NO: 6313 - DNA, 25 bp, synthetic construct
  misc_feature 1..25: note = Synthetic Construct
  source 1..25: mol_type = other DNA
gtcacccatcccacctatttacttg

SEQ ID NO: 6314 - DNA, 27 bp, synthetic construct
  misc_feature 1..27: note = Synthetic Construct
  source 1..27: mol_type = other DNA
aaggaaatagacccatttagcttcagt

SEQ ID NO: 6315 - DNA, 25 bp, synthetic construct
  misc_feature 1..25: note = Synthetic Construct
  source 1..25: mol_type = other DNA
ggaagttctggctctgtacctgaaa

SEQ ID NO: 6316 - DNA, 20 bp, synthetic construct
  misc_feature 1..20: note = Synthetic Construct
  source 1..20: mol_type = other DNA
tccgtgtgctcagcttgact

SEQ ID NO: 6317 - DNA, 27 bp, synthetic construct
  misc_feature 1..27: note = Synthetic Construct
  source 1..27: mol_type = other DNA
gttttagtcctccttatagcccattgg

SEQ ID NO: 6318 - DNA, 22 bp, synthetic construct
  misc_feature 1..22: note = Synthetic Construct
  source 1..22: mol_type = other DNA
tttggtcaccagcagtggaagt

SEQ ID NO: 6319 - DNA, 23 bp, synthetic construct
  misc_feature 1..23: note = Synthetic Construct
  source 1..23: mol_type = other DNA
gccagtggtggattcaaaaagca

SEQ ID NO: 6320 - DNA, 23 bp, synthetic construct
  misc_feature 1..23: note = Synthetic Construct
  source 1..23: mol_type = other DNA
gctgctggcccttatgcctgaag

SEQ ID NO: 6321 - DNA, 23 bp, synthetic construct
  misc_feature 1..23: note = Synthetic Construct
  source 1..23: mol_type = other DNA
agtctctcaaagcctgacgtttc

SEQ ID NO: 6322 - DNA, 24 bp, synthetic construct
  misc_feature 1..24: note = Synthetic Construct
  source 1..24: mol_type = other DNA
gtggaataagatggaagccacact

SEQ ID NO: 6323 - DNA, 28 bp, synthetic construct
  misc_feature 1..28: note = Synthetic Construct
  source 1..28: mol_type = other DNA
aatattactagccacactgctattcctt

SEQ ID NO: 6324 - DNA, 19 bp, synthetic construct
  misc_feature 1..19: note = Synthetic Construct
  source 1..19: mol_type = other DNA
cgaggacccaccacagtct

SEQ ID NO: 6325 - DNA, 28 bp, synthetic construct
  misc_feature 1..28: note = Synthetic Construct
  source 1..28: mol_type = other DNA
gagtgggataaataaaggctgtaaagag

SEQ ID NO: 6326 - DNA, 22 bp, synthetic construct
  misc_feature 1..22: note = Synthetic Construct
  source 1..22: mol_type = other DNA
tccaatcccacctctgacaatg

SEQ ID NO: 6327 - DNA, 24 bp, synthetic construct
  misc_feature 1..24: note = Synthetic Construct
  source 1..24: mol_type = other DNA
cctgcttagtggcctatgtgatca

SEQ ID NO: 6328 - DNA, 20 bp, synthetic construct
  misc_feature 1..20: note = Synthetic Construct
  source 1..20: mol_type = other DNA
ttgtccccccaacccattca

SEQ ID NO: 6329 - DNA, 22 bp, synthetic construct
  misc_feature 1..22: note = Synthetic Construct
  source 1..22: mol_type = other DNA
ggcaacactccgcttcactatt

SEQ ID NO: 6330 - DNA, 28 bp, synthetic construct
  misc_feature 1..28: note = Synthetic Construct
  source 1..28: mol_type = other DNA
ggtagtaagattaagagctctgattgca

SEQ ID NO: 6331 - DNA, 23 bp, synthetic construct
  misc_feature 1..23: note = Synthetic Construct
  source 1..23: mol_type = other DNA
ccaggaaaagacacccccataca

SEQ ID NO: 6332 - DNA, 25 bp, synthetic construct
  misc_feature 1..25: note = Synthetic Construct
  source 1..25: mol_type = other DNA
gaatggttggtatctaggcatcact

SEQ ID NO: 6333 - DNA, 22 bp, synthetic construct
  misc_feature 1..22: note = Synthetic Construct
  source 1..22: mol_type = other DNA
gagtgccaacagctcagctaat

SEQ ID NO: 6334 - DNA, 27 bp, synthetic construct
  misc_feature 1..27: note = Synthetic Construct
  source 1..27: mol_type = other DNA
gcatcaaactcaactcaaatggaatgt

SEQ ID NO: 6335 - DNA, 21 bp, synthetic construct
  misc_feature 1..21: note = Synthetic Construct
  source 1..21: mol_type = other DNA
tccacatcccctttccacctt

SEQ ID NO: 6336 - DNA, 22 bp, synthetic construct
  misc_feature 1..22: note = Synthetic Construct
  source 1..22: mol_type = other DNA
aggcacccacctctagacagta

SEQ ID NO: 6337 - DNA, 24 bp, synthetic construct
  misc_feature 1..24: note = Synthetic Construct
  source 1..24: mol_type = other DNA
gagtgatggtcaggcagttcatat

SEQ ID NO: 6338 - DNA, 21 bp, synthetic construct
  misc_feature 1..21: note = Synthetic Construct
  source 1..21: mol_type = other DNA
tgcttcctgggcctgttttgt

SEQ ID NO: 6339 - DNA, 20 bp, synthetic construct
  misc_feature 1..20: note = Synthetic Construct
  source 1..20: mol_type = other DNA
tcggcagggagggaagcttt

SEQ ID NO: 6340 - DNA, 20 bp, synthetic construct
  misc_feature 1..20: note = Synthetic Construct
  source 1..20: mol_type = other DNA
ccagggtgcactctcttcct

SEQ ID NO: 6341 - DNA, 21 bp, synthetic construct
  misc_feature 1..21: note = Synthetic Construct
  source 1..21: mol_type = other DNA
agcccctgctgagcttatcca

SEQ ID NO: 6342 - DNA, 27 bp, synthetic construct
  misc_feature 1..27: note = Synthetic Construct
  source 1..27: mol_type = other DNA
cacacctgttatcacagtcttcctagt

SEQ ID NO: 6343 - DNA, 23 bp, synthetic construct
  misc_feature 1..23: note = Synthetic Construct
  source 1..23: mol_type = other DNA
aagtagcctagatttgcctgctt

SEQ ID NO: 6344 - DNA, 23 bp, synthetic construct
  misc_feature 1..23: note = Synthetic Construct
  source 1..23: mol_type = other DNA
atttcctcgaaccactcgctaaa

SEQ ID NO: 6345 - DNA, 22 bp, synthetic construct
  misc_feature 1..22: note = Synthetic Construct
  source 1..22: mol_type = other DNA
caaagccctccttgacttgctt

SEQ ID NO: 6346 - DNA, 21 bp, synthetic construct
  misc_feature 1..21: note = Synthetic Construct
  source 1..21: mol_type = other DNA
ttggctgacccctggtgtagt

SEQ ID NO: 6347 - DNA, 22 bp, synthetic construct
  misc_feature 1..22: note = Synthetic Construct
  source 1..22: mol_type = other DNA
tgcccttagtctagcacagctt

SEQ ID NO: 6348 - DNA, 21 bp, synthetic construct
  misc_feature 1..21: note = Synthetic Construct
  source 1..21: mol_type = other DNA
cccatcaggaaggctgagatg

SEQ ID NO: 6349 - DNA, 26 bp, synthetic construct
  misc_feature 1..26: note = Synthetic Construct
  source 1..26: mol_type = other DNA
gctacttcccctgcatatctattagg

SEQ ID NO: 6350 - DNA, 28 bp, synthetic construct
  misc_feature 1..28: note = Synthetic Construct
  source 1..28: mol_type = other DNA
ggaaattaggtaagcatttcctgaatgg

SEQ ID NO: 6351 - DNA, 27 bp, synthetic construct
  misc_feature 1..27: note = Synthetic Construct
  source 1..27: mol_type = other DNA
ccaaggaacaattttctgtcagtgaga

SEQ ID NO: 6352 - DNA, 26 bp, synthetic construct
  misc_feature 1..26: note = Synthetic Construct
  source 1..26: mol_type = other DNA
gtgatcatcaactggattgcacaaag

SEQ ID NO: 6353 - DNA, 22 bp, synthetic construct
  misc_feature 1..22: note = Synthetic Construct
  source 1..22: mol_type = other DNA
caggcatgctctccaaattctg

SEQ ID NO: 6354 - DNA, 23 bp, synthetic construct
  misc_feature 1..23: note = Synthetic Construct
  source 1..23: mol_type = other DNA
tgggagtctttgccagtggacta

SEQ ID NO: 6355 - DNA, 27 bp, synthetic construct
  misc_feature 1..27: note = Synthetic Construct
  source 1..27: mol_type = other DNA
ctgggggaatagctatatctagttggt

SEQ ID NO: 6356 - DNA, 21 bp, synthetic construct
  misc_feature 1..21: note = Synthetic Construct
  source 1..21: mol_type = other DNA
agatgggcctctcctgtcttc

SEQ ID NO: 6357 - DNA, 20 bp, synthetic construct
  misc_feature 1..20: note = Synthetic Construct
  source 1..20: mol_type = other DNA
gagcccccattgctgtgaat

SEQ ID NO: 6358 - DNA, 21 bp, synthetic construct
  misc_feature 1..21: note = Synthetic Construct
  source 1..21: mol_type = other DNA
agactctggggctctccactt

SEQ ID NO: 6359 - DNA, 20 bp, synthetic construct
  misc_feature 1..20: note = Synthetic Construct
  source 1..20: mol_type = other DNA
cgatggcaggtgcttcagaa

SEQ ID NO: 6360 - DNA, 24 bp, synthetic construct
  misc_feature 1..24: note = Synthetic Construct
  source 1..24: mol_type = other DNA
gactggcaagactgttcacttctg

SEQ ID NO: 6361 - DNA, 20 bp, synthetic construct
  misc_feature 1..20: note = Synthetic Construct
  source 1..20: mol_type = other DNA
ctctccctccctgactgaca

SEQ ID NO: 6362 - DNA, 22 bp, synthetic construct
  misc_feature 1..22: note = Synthetic Construct
  source 1..22: mol_type = other DNA
ggtagcttggggtagcaatgga

SEQ ID NO: 6363 - DNA, 24 bp, synthetic construct
  misc_feature 1..24: note = Synthetic Construct
  source 1..24: mol_type = other DNA
tcctctcaccccctctgataaaag

SEQ ID NO: 6364 - DNA, 25 bp, synthetic construct
  misc_feature 1..25: note = Synthetic Construct
  source 1..25: mol_type = other DNA
gtggtagatttccacgggtcatttg

SEQ ID NO: 6365 - DNA, 20 bp, synthetic construct
  misc_feature 1..20: note = Synthetic Construct
  source 1..20: mol_type = other DNA
agccagcagaagcctccaaa

SEQ ID NO: 6366 - DNA, 22 bp, synthetic construct
  misc_feature 1..22: note = Synthetic Construct
  source 1..22: mol_type = other DNA
tctgaccctcggcaaaaatctg

SEQ ID NO: 6367 - DNA, 25 bp, synthetic construct
  misc_feature 1..25: note = Synthetic Construct
  source 1..25: mol_type = other DNA
cactgaagcaggtaagtgtgaacag

SEQ ID NO: 6368 - DNA, 21 bp, synthetic construct
  misc_feature 1..21: note = Synthetic Construct
  source 1..21: mol_type = other DNA
ccccagcataatgagggtgtt

SEQ ID NO: 6369 - DNA, 18 bp, synthetic construct
  misc_feature 1..18: note = Synthetic Construct
  source 1..18: mol_type = other DNA
agccccgggacagacact

SEQ ID NO: 6370 - DNA, 27 bp, synthetic construct
  misc_feature 1..27: note = Synthetic Construct
  source 1..27: mol_type = other DNA
gaacagtttatgggaatagacgatgtc

SEQ ID NO: 6371 - DNA, 29 bp, synthetic construct
  misc_feature 1..29: note = Synthetic Construct
  source 1..29: mol_type = other DNA
gaaccggaaatatgtaggattatgattgc

SEQ ID NO: 6372 - DNA, 23 bp, synthetic construct
  misc_feature 1..23: note = Synthetic Construct
  source 1..23: mol_type = other DNA
agccgagaatctcagaggatcca

SEQ ID NO: 6373 - DNA, 24 bp, synthetic construct
  misc_feature 1..24: note = Synthetic Construct
  source 1..24: mol_type = other DNA
ctggtcaacgtagtgaggtacaga

SEQ ID NO: 6374 - DNA, 24 bp, synthetic construct
  misc_feature 1..24: note = Synthetic Construct
  source 1..24: mol_type = other DNA
gctagaattcacaggacacagaga

SEQ ID NO: 6375 - DNA, 23 bp, synthetic construct
  misc_feature 1..23: note = Synthetic Construct
  source 1..23: mol_type = other DNA
tctcctccctaaccccctctcaa

SEQ ID NO: 6376 - DNA, 22 bp, synthetic construct
  misc_feature 1..22: note = Synthetic Construct
  source 1..22: mol_type = other DNA
ggagtccaagctccactactca

SEQ ID NO: 6377 - DNA, 25 bp, synthetic construct
  misc_feature 1..25: note = Synthetic Construct
  source 1..25: mol_type = other DNA
ccaccagcaattctcgatgataagg

SEQ ID NO: 6378 - DNA, 21 bp, synthetic construct
  misc_feature 1..21: note = Synthetic Construct
  source 1..21: mol_type = other DNA
tcaggcttccactgcatcttc

SEQ ID NO: 6379 - DNA, 18 bp, synthetic construct
  misc_feature 1..18: note = Synthetic Construct
  source 1..18: mol_type = other DNA
tggctcgcagggtcaaag

SEQ ID NO: 6380 - DNA, 21 bp, synthetic construct
  misc_feature 1..21: note = Synthetic Construct
  source 1..21: mol_type = other DNA
cagaggaagggggcttctctt

SEQ ID NO: 6381 - DNA, 20 bp, synthetic construct
  misc_feature 1..20: note = Synthetic Construct
  source 1..20: mol_type = other DNA
ccagcctcgtggagttttgt

SEQ ID NO: 6382 - DNA, 19 bp, synthetic construct
  misc_feature 1..19: note = Synthetic Construct
  source 1..19: mol_type = other DNA
aggtgggaggcaggaagaa

SEQ ID NO: 6383 - DNA, 25 bp, synthetic construct
  misc_feature 1..25: note = Synthetic Construct
  source 1..25: mol_type = other DNA
agagactcagagagaaactgttcca

SEQ ID NO: 6384 - DNA, 20 bp, synthetic construct
  misc_feature 1..20: note = Synthetic Construct
  source 1..20: mol_type = other DNA
agccggttgttcctctctga

SEQ ID NO: 6385 - DNA, 20 bp, synthetic construct
  misc_feature 1..20: note = Synthetic Construct
  source 1..20: mol_type = other DNA
agcagctcctccaaccttga

SEQ ID NO: 6386 - DNA, 22 bp, synthetic construct
  misc_feature 1..22: note = Synthetic Construct
  source 1..22: mol_type = other DNA
ccaaggctttgtgtccccaaaa

SEQ ID NO: 6387 - DNA, 24 bp, synthetic construct
  misc_feature 1..24: note = Synthetic Construct
  source 1..24: mol_type = other DNA
acctagctatccttccagcatttc

SEQ ID NO: 6388 - DNA, 25 bp, synthetic construct
  misc_feature 1..25: note = Synthetic Construct
  source 1..25: mol_type = other DNA
catcttgtgaaatgccagcattacc

SEQ ID NO: 6389 - DNA, 24 bp, synthetic construct
  misc_feature 1..24: note = Synthetic Construct
  source 1..24: mol_type = other DNA
aagggatgaaagcaatgcattgag

SEQ ID NO: 6390 - DNA, 23 bp, synthetic construct
  misc_feature 1..23: note = Synthetic Construct
  source 1..23: mol_type = other DNA
ggctgtcagtgttcaatctgagt

SEQ ID NO: 6391 - DNA, 23 bp, synthetic construct
  misc_feature 1..23: note = Synthetic Construct
  source 1..23: mol_type = other DNA
cccagaaacacagagtcattgca

SEQ ID NO: 6392 - DNA, 24 bp, synthetic construct
  misc_feature 1..24: note = Synthetic Construct
  source 1..24: mol_type = other DNA
ccatgttacccaagctggaatcct

SEQ ID NO: 6393 - DNA, 18 bp, synthetic construct
  misc_feature 1..18: note = Synthetic Construct
  source 1..18: mol_type = other DNA
ccgtgcccggccattaga

SEQ ID NO: 6394 - DNA, 24 bp, synthetic construct
  misc_feature 1..24: note = Synthetic Construct
  source 1..24: mol_type = other DNA
tggactactacatgtccagaagga

SEQ ID NO: 6395 - DNA, 26 bp, synthetic construct
  misc_feature 1..26: note = Synthetic Construct
  source 1..26: mol_type = other DNA
gccatttaggtaaacacctgggttgt

SEQ ID NO: 6396 - DNA, 25 bp, synthetic construct
  misc_feature 1..25: note = Synthetic Construct
  source 1..25: mol_type = other DNA
ctcaatagtgagggtgggatctaac

SEQ ID NO: 6397 - DNA, 19 bp, synthetic construct
  misc_feature 1..19: note = Synthetic Construct
  source 1..19: mol_type = other DNA
accgtggtggcagcttgat

SEQ ID NO: 6398 - DNA, 25 bp, synthetic construct
  misc_feature 1..25: note = Synthetic Construct
  source 1..25: mol_type = other DNA
caactcctgcttgtttttcctttgg

SEQ ID NO: 6399 - DNA, 24 bp, synthetic construct
  misc_feature 1..24: note = Synthetic Construct
  source 1..24: mol_type = other DNA
gagaaaacatccagtgcagaggaa

SEQ ID NO: 6400 - DNA, 20 bp, synthetic construct
  misc_feature 1..20: note = Synthetic Construct
  source 1..20: mol_type = other DNA
tgccaggaagggagtggatt

SEQ ID NO: 6401 - DNA, 24 bp, synthetic construct
  misc_feature 1..24: note = Synthetic Construct
  source 1..24: mol_type = other DNA
cgtagccccagtggtagcaattaa

SEQ ID NO: 6402 - DNA, 20 bp, synthetic construct
  misc_feature 1..20: note = Synthetic Construct
  source 1..20: mol_type = other DNA
accccaccctctcacaatgt

SEQ ID NO: 6403 - DNA, 22 bp, synthetic construct
  misc_feature 1..22: note = Synthetic Construct
  source 1..22: mol_type = other DNA
gccacctagggaaacaagaaca

SEQ ID NO: 6404 - DNA, 24 bp, synthetic construct
  misc_feature 1..24: note = Synthetic Construct
  source 1..24: mol_type = other DNA
gggagagaaaactgggttctgagt

SEQ ID NO: 6405 - DNA, 18 bp, synthetic construct
  misc_feature 1..18: note = Synthetic Construct
  source 1..18: mol_type = other DNA
cagaagccctgcctgcat

SEQ ID NO: 6406 - DNA, 22 bp, synthetic construct
  misc_feature 1..22: note = Synthetic Construct
  source 1..22: mol_type = other DNA
gagttccagttctggccctttt

SEQ ID NO: 6407 - DNA, 21 bp, synthetic construct
  misc_feature 1..21: note = Synthetic Construct
  source 1..21: mol_type = other DNA
ggacacaagcttgctgaagga

SEQ ID NO: 6408 - DNA, 20 bp, synthetic construct
  misc_feature 1..20: note = Synthetic Construct
  source 1..20: mol_type = other DNA
tgtgttccagagcagttgca

SEQ ID NO: 6409 - DNA, 21 bp, synthetic construct
  misc_feature 1..21: note = Synthetic Construct
  source 1..21: mol_type = other DNA
ggccatagtctcatgcagtgt

SEQ ID NO: 6410 - DNA, 19 bp, synthetic construct
  misc_feature 1..19: note = Synthetic Construct
  source 1..19: mol_type = other DNA
agcagtcacggaaggcaaa

SEQ ID NO: 6411 - DNA, 23 bp, synthetic construct
  misc_feature 1..23: note = Synthetic Construct
  source 1..23: mol_type = other DNA
gctgagttttgagtgcgatatgc

SEQ ID NO: 6412 - DNA, 25 bp, synthetic construct
  misc_feature 1..25: note = Synthetic Construct
  source 1..25: mol_type = other DNA
gcccatagtacactctcactttctg

SEQ ID NO: 6413 - DNA, 24 bp, synthetic construct
  misc_feature 1..24: note = Synthetic Construct
  source 1..24: mol_type = other DNA
cagacgggaagatgggttttgatg

SEQ ID NO: 6414 - DNA, 24 bp, synthetic construct
  misc_feature 1..24: note = Synthetic Construct
  source 1..24: mol_type = other DNA
gggaaaggagaatgttcccagtga

SEQ ID NO: 6415 - DNA, 22 bp, synthetic construct
  misc_feature 1..22: note = Synthetic Construct
  source 1..22: mol_type = other DNA
ctggccataagacacagaagct

SEQ ID NO: 6416 - DNA, 24 bp, synthetic construct
  misc_feature 1..24: note = Synthetic Construct
  source 1..24: mol_type = other DNA
ggaggggatcagtagtgcagataa

SEQ ID NO: 6417 - DNA, 22 bp, synthetic construct
  misc_feature 1..22: note = Synthetic Construct
  source 1..22: mol_type = other DNA
gcgacagagtgagactgagaca

SEQ ID NO: 6418 - DNA, 24 bp, synthetic construct
  misc_feature 1..24: note = Synthetic Construct
  source 1..24: mol_type = other DNA
catcaatggcaaatagcagttgca

SEQ ID NO: 6419 - DNA, 24 bp, synthetic construct
  misc_feature 1..24: note = Synthetic Construct
  source 1..24: mol_type = other DNA
gggaatttaaggagcccgagtgat

SEQ ID NO: 6420 - DNA, 20 bp, synthetic construct
  misc_feature 1..20: note = Synthetic Construct
  source 1..20: mol_type = other DNA
tggaaacccagccaaagtgt

SEQ ID NO: 6421 - DNA, 22 bp, synthetic construct
  misc_feature 1..22: note = Synthetic Construct
  source 1..22: mol_type = other DNA
cagcttccttcaccatgacctt

SEQ ID NO: 6422 - DNA, 23 bp, synthetic construct
  misc_feature 1..23: note = Synthetic Construct
  source 1..23: mol_type = other DNA
gcctatgccaatttgatgccaaa

SEQ ID NO: 6423 - DNA, 27 bp, synthetic construct
  misc_feature 1..27: note = Synthetic Construct
  source 1..27: mol_type = other DNA
ggcaaaggaggatgacaaataggtatt

SEQ ID NO: 6424 - DNA, 19 bp, synthetic construct
  misc_feature 1..19: note = Synthetic Construct
  source 1..19: mol_type = other DNA
agagctgctggcctatgct

SEQ ID NO: 6425 - DNA, 25 bp, synthetic construct
  misc_feature 1..25: note = Synthetic Construct
  source 1..25: mol_type = other DNA
agtggcagaagtgtggatatattgt

SEQ ID NO: 6426 - DNA, 21 bp, synthetic construct
  misc_feature 1..21: note = Synthetic Construct
  source 1..21: mol_type = other DNA
gccttggatggctgagtactg

SEQ ID NO: 6427 - DNA, 24 bp, synthetic construct
  misc_feature 1..24: note = Synthetic Construct
  source 1..24: mol_type = other DNA
gctcagggcttatgagttgtctgt

SEQ ID NO: 6428 - DNA, 26 bp, synthetic construct
  misc_feature 1..26: note = Synthetic Construct
  source 1..26: mol_type = other DNA
ggaggccagaacattttagaggtttg

SEQ ID NO: 6429 - DNA, 20 bp, synthetic construct
  misc_feature 1..20: note = Synthetic Construct
  source 1..20: mol_type = other DNA
gctgggcaggaaggtaccat

SEQ ID NO: 6430 - DNA, 23 bp, synthetic construct
  misc_feature 1..23: note = Synthetic Construct
  source 1..23: mol_type = other DNA
gaggactgaatgaatcggaacca

SEQ ID NO: 6431 - DNA, 19 bp, synthetic construct
  misc_feature 1..19: note = Synthetic Construct
  source 1..19: mol_type = other DNA
cctgctggtgcctgtactg

SEQ ID NO: 6432 - DNA, 20 bp, synthetic construct
  misc_feature 1..20: note = Synthetic Construct
  source 1..20: mol_type = other DNA
gggcctgtggttccagtgat

SEQ ID NO: 6433 - DNA, 20 bp, synthetic construct
  misc_feature 1..20: note = Synthetic Construct
  source 1..20: mol_type = other DNA
tgtttgcaggctgcttggtt

SEQ ID NO: 6434 - DNA, 22 bp, synthetic construct
  misc_feature 1..22: note = Synthetic Construct
  source 1..22: mol_type = other DNA
ggcttcccaaggtcacatctaa

SEQ ID NO: 6435 - DNA, 21 bp, synthetic construct
  misc_feature 1..21: note = Synthetic Construct
  source 1..21: mol_type = other DNA
ctgcctgtgccaatcatcaag

SEQ ID NO: 6436 - DNA, 26 bp, synthetic construct
  misc_feature 1..26: note = Synthetic Construct
  source 1..26: mol_type = other DNA
cactctagtgaaccaagagtgaaggt

SEQ ID NO: 6437 - DNA, 20 bp, synthetic construct
  misc_feature 1..20: note = Synthetic Construct
  source 1..20: mol_type = other DNA
tgagcatccactcccacact

SEQ ID NO: 6438 - DNA, 18 bp, synthetic construct
  misc_feature 1..18: note = Synthetic Construct
  source 1..18: mol_type = other DNA
acgcagctctggggtaca

SEQ ID NO: 6439 - DNA, 27 bp, synthetic construct
  misc_feature 1..27: note = Synthetic Construct
  source 1..27: mol_type = other DNA
cagtgcctgataaagtaagcagtatgg

SEQ ID NO: 6440 - DNA, 20 bp, synthetic construct
  misc_feature 1..20: note = Synthetic Construct
  source 1..20: mol_type = other DNA
atgttgcggtcaccttctgt

SEQ ID NO: 6441 - DNA, 21 bp, synthetic construct
  misc_feature 1..21: note = Synthetic Construct
  source 1..21: mol_type = other DNA
acgggccaagatgctttcagt

SEQ ID NO: 6442 - DNA, 22 bp, synthetic construct
  misc_feature 1..22: note = Synthetic Construct
  source 1..22: mol_type = other DNA
aacttccagcctccactaggaa

SEQ ID NO: 6443 - DNA, 20 bp, synthetic construct
  misc_feature 1..20: note = Synthetic Construct
  source 1..20: mol_type = other DNA
agggcagcgcatgtaagatg

SEQ ID NO: 6444 - DNA, 20 bp, synthetic construct
  misc_feature 1..20: note = Synthetic Construct
  source 1..20: mol_type = other DNA
caccccttcgtgaagcatga

SEQ ID NO: 6445 - DNA, 28 bp, synthetic construct
  misc_feature 1..28: note = Synthetic Construct
  source 1..28: mol_type = other DNA
cccatcatcatataaatctaggcagtct

SEQ ID NO: 6446 - DNA, 23 bp, synthetic construct
  misc_feature 1..23: note = Synthetic Construct
  source 1..23: mol_type = other DNA
catcgatccagagaaccccatag

SEQ ID NO: 6447 - DNA, 22 bp, synthetic construct
  misc_feature 1..22: note = Synthetic Construct
  source 1..22: mol_type = other DNA
cacgtgtttgtcagctccagaa

SEQ ID NO: 6448 - DNA, 26 bp, synthetic construct
  misc_feature 1..26: note = Synthetic Construct
  source 1..26: mol_type = other DNA
caacttcatagtagggagggattctg

SEQ ID NO: 6449 - DNA, 25 bp, synthetic construct
  misc_feature 1..25: note = Synthetic Construct
  source 1..25: mol_type = other DNA
aattctacgagacaacaacccatct

SEQ ID NO: 6450 - DNA, 22 bp, synthetic construct
  misc_feature 1..22: note = Synthetic Construct
  source 1..22: mol_type = other DNA
ctgcagcgaaactggtatccaa

SEQ ID NO: 6451 - DNA, 29 bp, synthetic construct
  misc_feature 1..29: note = Synthetic Construct
  source 1..29: mol_type = other DNA
caccatacttacatgtcatatgccattgt

SEQ ID NO: 6452 - DNA, 28 bp, synthetic construct
  misc_feature 1..28: note = Synthetic Construct
  source 1..28: mol_type = other DNA
gcctctgaattaattcctggcataactc

SEQ ID NO: 6453 - DNA, 22 bp, synthetic construct
  misc_feature 1..22: note = Synthetic Construct
  source 1..22: mol_type = other DNA
tggtatgtcactggtggctttt

SEQ ID NO: 6454 - DNA, 25 bp, synthetic construct
  misc_feature 1..25: note = Synthetic Construct
  source 1..25: mol_type = other DNA
gagtgatgacaacttgctgtttacc

SEQ ID NO: 6455 - DNA, 24 bp, synthetic construct
  misc_feature 1..24: note = Synthetic Construct
  source 1..24: mol_type = other DNA
gccagaggactcgttctctttgtt

SEQ ID NO: 6456 - DNA, 20 bp, synthetic construct
  misc_feature 1..20: note = Synthetic Construct
  source 1..20: mol_type = other DNA
tggaaagaggggtgccaaac

SEQ ID NO: 6457 - DNA, 22 bp, synthetic construct
  misc_feature 1..22: note = Synthetic Construct
  source 1..22: mol_type = other DNA
gccaatgagatcctgcagactt

SEQ ID NO: 6458 - DNA, 27 bp, synthetic construct
  misc_feature 1..27: note = Synthetic Construct
  source 1..27: mol_type = other DNA
gcagtcaatagatatcccgctgttagg

SEQ ID NO: 6459 - DNA, 20 bp, synthetic construct
  misc_feature 1..20: note = Synthetic Construct
  source 1..20: mol_type = other DNA
cactccacctgcacctgaag

SEQ ID NO: 6460 - DNA, 25 bp, synthetic construct
  misc_feature 1..25: note = Synthetic Construct
  source 1..25: mol_type = other DNA
cttccaattgtacagaggggaaaca

SEQ ID NO: 6461 - DNA, 20 bp, synthetic construct
  misc_feature 1..20: note = Synthetic Construct
  source 1..20: mol_type = other DNA
cacgggcaggacagatcaaa

SEQ ID NO: 6462 - DNA, 27 bp, synthetic construct
  misc_feature 1..27: note = Synthetic Construct
  source 1..27: mol_type = other DNA
gacttctgctaaacttgacttgactca

SEQ ID NO: 6463 - DNA, 21 bp, synthetic construct
  misc_feature 1..21: note = Synthetic Construct
  source 1..21: mol_type = other DNA
tcctgggccagttcaatgcat

SEQ ID NO: 6464 - DNA, 21 bp, synthetic construct
  misc_feature 1..21: note = Synthetic Construct
  source 1..21: mol_type = other DNA
gctcccaagccatcactatcc

SEQ ID NO: 6465 - DNA, 22 bp, synthetic construct
  misc_feature 1..22: note = Synthetic Construct
  source 1..22: mol_type = other DNA
gtgtgtcaggtaggcattgcat

SEQ ID NO: 6466 - DNA, 26 bp, synthetic construct
  misc_feature 1..26: note = Synthetic Construct
  source 1..26: mol_type = other DNA
ggtgtatcttgcaaaatcgaccatca

SEQ ID NO: 6467 - DNA, 20 bp, synthetic construct
  misc_feature 1..20: note = Synthetic Construct
  source 1..20: mol_type = other DNA
gtggagggcctaggcaaaat

SEQ ID NO: 6468 - DNA, 26 bp, synthetic construct
  misc_feature 1..26: note = Synthetic Construct
  source 1..26: mol_type = other DNA
ctgaggagtcaggcatagatctacac

SEQ ID NO: 6469 - DNA, 29 bp, synthetic construct
  misc_feature 1..29: note = Synthetic Construct
  source 1..29: mol_type = other DNA
ggatgcaatgagaaagaactaatggtttg

SEQ ID NO: 6470 - DNA, 22 bp, synthetic construct
  misc_feature 1..22: note = Synthetic Construct
  source 1..22: mol_type = other DNA
tgcagtagtggttggagtcaac

SEQ ID NO: 6471 - DNA, 23 bp, synthetic construct
  misc_feature 1..23: note = Synthetic Construct
  source 1..23: mol_type = other DNA
caaagatgcctcccttctcaaga

SEQ ID NO: 6472 - DNA, 27 bp, synthetic construct
  misc_feature 1..27: note = Synthetic Construct
  source 1..27: mol_type = other DNA
ggacatattttgagggtggaacaaacc

SEQ ID NO: 6473 - DNA, 22 bp, synthetic construct
  misc_feature 1..22: note = Synthetic Construct
  source 1..22: mol_type = other DNA
tccaaagtgctgtgctcttcct

SEQ ID NO: 6474 - DNA, 22 bp, synthetic construct
  misc_feature 1..22: note = Synthetic Construct
  source 1..22: mol_type = other DNA
cccattcactcccctcttctga

SEQ ID NO: 6475 - DNA, 23 bp, synthetic construct
  misc_feature 1..23: note = Synthetic Construct
  source 1..23: mol_type = other DNA
caacacagagtaggggttcagtt

SEQ ID NO: 6476 - DNA, 22 bp, synthetic construct
  misc_feature 1..22: note = Synthetic Construct
  source 1..22: mol_type = other DNA
acagcttctgcagggaggttta

SEQ ID NO: 6477 - DNA, 27 bp, synthetic construct
  misc_feature 1..27: note = Synthetic Construct
  source 1..27: mol_type = other DNA
gaggagctaacaattctctagttcaca

SEQ ID NO: 6478 - DNA, 20 bp, synthetic construct
  misc_feature 1..20: note = Synthetic Construct
  source 1..20: mol_type = other DNA
tgtcacggctccatcacagt

SEQ ID NO: 6479 - DNA, 28 bp, synthetic construct
  misc_feature 1..28: note = Synthetic Construct
  source 1..28: mol_type = other DNA
cacactctgcaagctaataaatattcct

SEQ ID NO: 6480 - DNA, 20 bp, synthetic construct
  misc_feature 1..20: note = Synthetic Construct
  source 1..20: mol_type = other DNA
agagccctggagcagacaga

SEQ ID NO: 6481 - DNA, 22 bp, synthetic construct
  misc_feature 1..22: note = Synthetic Construct
  source 1..22: mol_type = other DNA
ggtgggcagagagggtcattta

SEQ ID NO: 6482 - DNA, 26 bp, synthetic construct
  misc_feature 1..26: note = Synthetic Construct
  source 1..26: mol_type = other DNA
cagaaacttgcaatgagttgatctgt

SEQ ID NO: 6483 - DNA, 23 bp, synthetic construct
  misc_feature 1..23: note = Synthetic Construct
  source 1..23: mol_type = other DNA
gagatcgtactgagcctgacaaa

SEQ ID NO: 6484 - DNA, 21 bp, synthetic construct
  misc_feature 1..21: note = Synthetic Construct
  source 1..21: mol_type = other DNA
gcctatgacccaggaccatgt

SEQ ID NO: 6485 - DNA, 23 bp, synthetic construct
  misc_feature 1..23: note = Synthetic Construct
  source 1..23: mol_type = other DNA
acagaactgaggcatggtctttt

SEQ ID NO: 6486 - DNA, 20 bp, synthetic construct
  misc_feature 1..20: note = Synthetic Construct
  source 1..20: mol_type = other DNA
tgacaggtggccttcactca

SEQ ID NO: 6487 - DNA, 27 bp, synthetic construct
  misc_feature 1..27: note = Synthetic Construct
  source 1..27: mol_type = other DNA
aaaactcagctatctttgttcccaaaa

SEQ ID NO: 6488 - DNA, 22 bp, synthetic construct
  misc_feature 1..22: note = Synthetic Construct
  source 1..22: mol_type = other DNA
ctgcttccagttgcttccaagt

SEQ ID NO: 6489 - DNA, 23 bp, synthetic construct
  misc_feature 1..23: note = Synthetic Construct
  source 1..23: mol_type = other DNA
caagaggaaagtgcagtcactga

SEQ ID NO: 6490 - DNA, 22 bp, synthetic construct
  misc_feature 1..22: note = Synthetic Construct
  source 1..22: mol_type = other DNA
tggaacagggtagacagttggt

SEQ ID NO: 6491 - DNA, 22 bp, synthetic construct
  misc_feature 1..22: note = Synthetic Construct
  source 1..22: mol_type = other DNA
ggtcaggaaattgggagtggtt

SEQ ID NO: 6492 - DNA, 30 bp, synthetic construct
  misc_feature 1..30: note = Synthetic Construct
  source 1..30: mol_type = other DNA
ggtgtttgcattaatggaagataggaaacc

SEQ ID NO: 6493 - DNA, 24 bp, synthetic construct
  misc_feature 1..24: note = Synthetic Construct
  source 1..24: mol_type = other DNA
tgatggcagcatattcttcctgtt

SEQ ID NO: 6494 - DNA, 23 bp, synthetic construct
  misc_feature 1..23: note = Synthetic Construct
  source 1..23: mol_type = other DNA
acacctcaaattccacaggacaa

SEQ ID NO: 6495 - DNA, 28 bp, synthetic construct
  misc_feature 1..28: note = Synthetic Construct
  source 1..28: mol_type = other DNA
ccactaaatagtcttcgaaaaccagaag

SEQ ID NO: 6496 - DNA, 20 bp, synthetic construct
  misc_feature 1..20: note = Synthetic Construct
  source 1..20: mol_type = other DNA
tcttgtggcagaagcatcgt

SEQ ID NO: 6497 - DNA, 24 bp, synthetic construct
  misc_feature 1..24: note = Synthetic Construct
  source 1..24: mol_type = other DNA
ggtcacaccagactggaattcagt

SEQ ID NO: 6498 - DNA, 21 bp, synthetic construct
  misc_feature 1..21: note = Synthetic Construct
  source 1..21: mol_type = other DNA
aggttttagcctggcctggta

SEQ ID NO: 6499 - DNA, 22 bp, synthetic construct
  misc_feature 1..22: note = Synthetic Construct
  source 1..22: mol_type = other DNA
agcttacctggggaaggatgct

SEQ ID NO: 6500 - DNA, 21 bp, synthetic construct
  misc_feature 1..21: note = Synthetic Construct
  source 1..21: mol_type = other DNA
tgaggaatgggcatggaagtc

SEQ ID NO: 6501 - DNA, 23 bp, synthetic construct
  misc_feature 1..23: note = Synthetic Construct
  source 1..23: mol_type = other DNA
agcagaggagggaagagtgtgtt

SEQ ID NO: 6502 - DNA, 25 bp, synthetic construct
  misc_feature 1..25: note = Synthetic Construct
  source 1..25: mol_type = other DNA
cacacacacctcatagttccatcct

SEQ ID NO: 6503 - DNA, 23 bp, synthetic construct
  misc_feature 1..23: note = Synthetic Construct
  source 1..23: mol_type = other DNA
gaatgctgtgcatctctgtacac

SEQ ID NO: 6504 - DNA, 20 bp, synthetic construct
  misc_feature 1..20: note = Synthetic Construct
  source 1..20: mol_type = other DNA
aacacccaggctgagaagca

SEQ ID NO: 6505 - DNA, 25 bp, synthetic construct
  misc_feature 1..25: note = Synthetic Construct
  source 1..25: mol_type = other DNA
ctaccctctcttagccctagtaagt

SEQ ID NO: 6506 - DNA, 24 bp, synthetic construct
  misc_feature 1..24: note = Synthetic Construct
  source 1..24: mol_type = other DNA
ccccgattcagagagggaacagat

SEQ ID NO: 6507 - DNA, 25 bp, synthetic construct
  misc_feature 1..25: note = Synthetic Construct
  source 1..25: mol_type = other DNA
ggactgttggccttattttctcact

SEQ ID NO: 6508 - DNA, 24 bp, synthetic construct
  misc_feature 1..24: note = Synthetic Construct
  source 1..24: mol_type = other DNA
gccaattagcttcgagcatttcac

SEQ ID NO: 6509 - DNA, 21 bp, synthetic construct
  misc_feature 1..21: note = Synthetic Construct
  source 1..21: mol_type = other DNA
gcagcaggggttcatgactga

SEQ ID NO: 6510 - DNA, 22 bp, synthetic construct
  misc_feature 1..22: note = Synthetic Construct
  source 1..22: mol_type = other DNA
gggatcagccacactgtacaat

SEQ ID NO: 6511 - DNA, 20 bp, synthetic construct
  misc_feature 1..20: note = Synthetic Construct
  source 1..20: mol_type = other DNA
cacaggagctgcccctcttg

SEQ ID NO: 6512 - DNA, 23 bp, synthetic construct
  misc_feature 1..23: note = Synthetic Construct
  source 1..23: mol_type = other DNA
agggaggcagagctacagagatt

SEQ ID NO: 6513 - DNA, 24 bp, synthetic construct
  misc_feature 1..24: note = Synthetic Construct
  source 1..24: mol_type = other DNA
cctctcgactactctcagctttgt

SEQ ID NO: 6514 - DNA, 19 bp, synthetic construct
  misc_feature 1..19: note = Synthetic Construct
  source 1..19: mol_type = other DNA
ctccccaggaacccacaga

SEQ ID NO: 6515 - DNA, 24 bp, synthetic construct
  misc_feature 1..24: note = Synthetic Construct
  source 1..24: mol_type = other DNA
ggcttgtcatcgaagtggaaatgg

SEQ ID NO: 6516 - DNA, 26 bp, synthetic construct
  misc_feature 1..26: note = Synthetic Construct
  source 1..26: mol_type = other DNA
ggaacaactgaggagactacttggat

SEQ ID NO: 6517 - DNA, 23 bp, synthetic construct
  misc_feature 1..23: note = Synthetic Construct
  source 1..23: mol_type = other DNA
cagagtgctacgtctttggaaga

SEQ ID NO: 6518 - DNA, 25 bp, synthetic construct
  misc_feature 1..25: note = Synthetic Construct
  source 1..25: mol_type = other DNA
ccactgaaagatgtcaggctaaact

SEQ ID NO: 6519 - DNA, 24 bp, synthetic construct
  misc_feature 1..24: note = Synthetic Construct
  source 1..24: mol_type = other DNA
tctgcctccatctgttagcttacc

SEQ ID NO: 6520 - DNA, 26 bp, synthetic construct
  misc_feature 1..26: note = Synthetic Construct
  source 1..26: mol_type = other DNA
gcctccgatgagcttatcatagcatt

SEQ ID NO: 6521 - DNA, 21 bp, synthetic construct
  misc_feature 1..21: note = Synthetic Construct
  source 1..21: mol_type = other DNA
tgcacctcctcctgcttcaat

SEQ ID NO: 6522 - DNA, 19 bp, synthetic construct
  misc_feature 1..19: note = Synthetic Construct
  source 1..19: mol_type = other DNA
tcaccacggccacctgtct

SEQ ID NO: 6523 - DNA, 24 bp, synthetic construct
  misc_feature 1..24: note = Synthetic Construct
  source 1..24: mol_type = other DNA
gacatggccctttgatcactcaaa

SEQ ID NO: 6524 - DNA, 21 bp, synthetic construct
  misc_feature 1..21: note = Synthetic Construct
  source 1..21: mol_type = other DNA
tggctgggagcttagaaacag

SEQ ID NO: 6525 - DNA, 24 bp, synthetic construct
  misc_feature 1..24: note = Synthetic Construct
  source 1..24: mol_type = other DNA
ggtgagtctgaggcaaaacttcat

SEQ ID NO: 6526 - DNA, 23 bp, synthetic construct
  misc_feature 1..23: note = Synthetic Construct
  source 1..23: mol_type = other DNA
cactgagtatgtgccttggtcaa

SEQ ID NO: 6527 - DNA, 23 bp, synthetic construct
  misc_feature 1..23: note = Synthetic Construct
  source 1..23: mol_type = other DNA
cccaggtttgtggtagggtagaa

SEQ ID NO: 6528 - DNA, 27 bp, synthetic construct
  misc_feature 1..27: note = Synthetic Construct
  source 1..27: mol_type = other DNA
ggtgagctttagggaggaaagatagag

SEQ ID NO: 6529 - DNA, 23 bp, synthetic construct
  misc_feature 1..23: note = Synthetic Construct
  source 1..23: mol_type = other DNA
tcagatgccaaatgtagcaccat

SEQ ID NO: 6530 - DNA, 20 bp, synthetic construct
  misc_feature 1..20: note = Synthetic Construct
  source 1..20: mol_type = other DNA
gcagccatgccatcgttagg

SEQ ID NO: 6531 - DNA, 22 bp, synthetic construct
  misc_feature 1..22: note = Synthetic Construct
  source 1..22: mol_type = other DNA
gtaacagaccctcctcccagat

SEQ ID NO: 6532 - DNA, 21 bp, synthetic construct
  misc_feature 1..21: note = Synthetic Construct
  source 1..21: mol_type = other DNA
tgtgcattggcccttactgat

SEQ ID NO: 6533 - DNA, 21 bp, synthetic construct
  misc_feature 1..21: note = Synthetic Construct
  source 1..21: mol_type = other DNA
aagcagccctgattcccatga

SEQ ID NO: 6534 - DNA, 22 bp, synthetic construct
  misc_feature 1..22: note = Synthetic Construct
  source 1..22: mol_type = other DNA
gcctctggtaggagaagccaaa

SEQ ID NO: 6535 - DNA, 26 bp, synthetic construct
  misc_feature 1..26: note = Synthetic Construct
  source 1..26: mol_type = other DNA
gggatttctctgtggctaagcttctg

SEQ ID NO: 6536 - DNA, 23 bp, synthetic construct
  misc_feature 1..23: note = Synthetic Construct
  source 1..23: mol_type = other DNA
cttcccaagcaacccgggactat

SEQ ID NO: 6537 - DNA, 22 bp, synthetic construct
  misc_feature 1..22: note = Synthetic Construct
  source 1..22: mol_type = other DNA
atgctctggctactgctattgg

SEQ ID NO: 6538 - DNA, 22 bp, synthetic construct
  misc_feature 1..22: note = Synthetic Construct
  source 1..22: mol_type = other DNA
aggacaggccaggggtagataa

SEQ ID NO: 6539 - DNA, 22 bp, synthetic construct
  misc_feature 1..22: note = Synthetic Construct
  source 1..22: mol_type = other DNA
acagaatgctgctctccatcca

SEQ ID NO: 6540 - DNA, 23 bp, synthetic construct
  misc_feature 1..23: note = Synthetic Construct
  source 1..23: mol_type = other DNA
gttttggttgtgcaagggtagga

SEQ ID NO: 6541 - DNA, 23 bp, synthetic construct
  misc_feature 1..23: note = Synthetic Construct
  source 1..23: mol_type = other DNA
cctagctccaggatacctcaaca

SEQ ID NO: 6542 - DNA, 21 bp, synthetic construct
  misc_feature 1..21: note = Synthetic Construct
  source 1..21: mol_type = other DNA
gctgtctgtgggagagagaga

SEQ ID NO: 6543 - DNA, 23 bp, synthetic construct
  misc_feature 1..23: note = Synthetic Construct
  source 1..23: mol_type = other DNA
caaatgattttggccccacttct

SEQ ID NO: 6544 - DNA, 25 bp, synthetic construct
  misc_feature 1..25: note = Synthetic Construct
  source 1..25: mol_type = other DNA
ggccaatgactaaagtgtgggaaac

SEQ ID NO: 6545 - DNA, 26 bp, synthetic construct
  misc_feature 1..26: note = Synthetic Construct
  source 1..26: mol_type = other DNA
ggagttagagtgagaacaggaagcaa

SEQ ID NO: 6546 - DNA, 25 bp, synthetic construct
  misc_feature 1..25: note = Synthetic Construct
  source 1..25: mol_type = other DNA
gcagtgaggtataatggcaccatta

SEQ ID NO: 6547 - DNA, 22 bp, synthetic construct
  misc_feature 1..22: note = Synthetic Construct
  source 1..22: mol_type = other DNA
tgagccaagacgagaaccaaac

SEQ ID NO: 6548 - DNA, 21 bp, synthetic construct
  misc_feature 1..21: note = Synthetic Construct
  source 1..21: mol_type = other DNA
cctgccccctgagttcctagt

SEQ ID NO: 6549 - DNA, 26 bp, synthetic construct
  misc_feature 1..26: note = Synthetic Construct
  source 1..26: mol_type = other DNA
ggctctgaggaatcgtgactatgttg

SEQ ID NO: 6550 - DNA, 24 bp, synthetic construct
  misc_feature 1..24: note = Synthetic Construct
  source 1..24: mol_type = other DNA
agaaggctgtacctcctactctag

SEQ ID NO: 6551 - DNA, 27 bp, synthetic construct
  misc_feature 1..27: note = Synthetic Construct
  source 1..27: mol_type = other DNA
gggacagttcttccgactcttacattc

SEQ ID NO: 6552 - DNA, 27 bp, synthetic construct
  misc_feature 1..27: note = Synthetic Construct
  source 1..27: mol_type = other DNA
agttaactacaaacactgagcagtttg

SEQ ID NO: 6553 - DNA, 25 bp, synthetic construct
  misc_feature 1..25: note = Synthetic Construct
  source 1..25: mol_type = other DNA
ccaggattactgcatatcccaagtg

SEQ ID NO: 6554 - DNA, 19 bp, synthetic construct
  misc_feature 1..19: note = Synthetic Construct
  source 1..19: mol_type = other DNA
tgctgtcagtccccaaagc

SEQ ID NO: 6555 - DNA, 22 bp, synthetic construct
  misc_feature 1..22: note = Synthetic Construct
  source 1..22: mol_type = other DNA
gaattctgctggggaggagaaa

SEQ ID NO: 6556 - DNA, 25 bp, synthetic construct
  misc_feature 1..25: note = Synthetic Construct
  source 1..25: mol_type = other DNA
gggagagttgtactgtttccaggtt

SEQ ID NO: 6557 - DNA, 21 bp, synthetic construct
  misc_feature 1..21: note = Synthetic Construct
  source 1..21: mol_type = other DNA
tcatggcctcagcacagtgaa

SEQ ID NO: 6558 - DNA, 25 bp, synthetic construct
  misc_feature 1..25: note = Synthetic Construct
  source 1..25: mol_type = other DNA
agagacaagttgacaagttggatca

SEQ ID NO: 6559 - DNA, 24 bp, synthetic construct
  misc_feature 1..24: note = Synthetic Construct
  source 1..24: mol_type = other DNA
tccacaacgtctcagtctgagtct

SEQ ID NO: 6560 - DNA, 20 bp, synthetic construct
  misc_feature 1..20: note = Synthetic Construct
  source 1..20: mol_type = other DNA
gtggccagtttgcaacatgt

SEQ ID NO: 6561 - DNA, 22 bp, synthetic construct
  misc_feature 1..22: note = Synthetic Construct
  source 1..22: mol_type = other DNA
ccatggccatcctctactgaga

SEQ ID NO: 6562 - DNA, 22 bp, synthetic construct
  misc_feature 1..22: note = Synthetic Construct
  source 1..22: mol_type = other DNA
gccacttagtgaagccttttgc

SEQ ID NO: 6563 - DNA, 25 bp, synthetic construct
  misc_feature 1..25: note = Synthetic Construct
  source 1..25: mol_type = other DNA
agtgacttgtctacttgccttttca

SEQ ID NO: 6564 - DNA, 22 bp, synthetic construct
  misc_feature 1..22: note = Synthetic Construct
  source 1..22: mol_type = other DNA
gatggggaaacaagcacagact

SEQ ID NO: 6565 - DNA, 22 bp, synthetic construct
  misc_feature 1..22: note = Synthetic Construct
  source 1..22: mol_type = other DNA
cgtggccttagaggatcacaga

SEQ ID NO: 6566 - DNA, 19 bp, synthetic construct
  misc_feature 1..19: note = Synthetic Construct
  source 1..19: mol_type = other DNA
ccagggtccactcccatct

SEQ ID NO: 6567 - DNA, 24 bp, synthetic construct
  misc_feature 1..24: note = Synthetic Construct
  source 1..24: mol_type = other DNA
gagcaactggcagagtatgacaag

SEQ ID NO: 6568 - DNA, 24 bp, synthetic construct
  misc_feature 1..24: note = Synthetic Construct
  source 1..24: mol_type = other DNA
gcaagatgaaagatgtggcattgt

SEQ ID NO: 6569 - DNA, 24 bp, synthetic construct
  misc_feature 1..24: note = Synthetic Construct
  source 1..24: mol_type = other DNA
gtcctaaagcactgcaagtagttc

SEQ ID NO: 6570 - DNA, 23 bp, synthetic construct
  misc_feature 1..23: note = Synthetic Construct
  source 1..23: mol_type = other DNA
gggatacagtttggggaacagtt

SEQ ID NO: 6571 - DNA, 20 bp, synthetic construct
  misc_feature 1..20: note = Synthetic Construct
  source 1..20: mol_type = other DNA
gcctgaaagaccgagctcaa

SEQ ID NO: 6572 - DNA, 21 bp, synthetic construct
  misc_feature 1..21: note = Synthetic Construct
  source 1..21: mol_type = other DNA
ccggccttgtccccaatttta

SEQ ID NO: 6573 - DNA, 21 bp, synthetic construct
  misc_feature 1..21: note = Synthetic Construct
  source 1..21: mol_type = other DNA
tgcagtcttcagtcccttcgt

SEQ ID NO: 6574 - DNA, 22 bp, synthetic construct
  misc_feature 1..22: note = Synthetic Construct
  source 1..22: mol_type = other DNA
gcacagggtgacaatcacttct

SEQ ID NO: 6575 - DNA, 24 bp, synthetic construct
  misc_feature 1..24: note = Synthetic Construct
  source 1..24: mol_type = other DNA
accttcctcttcccaagtctcgtt

SEQ ID NO: 6576 - DNA, 22 bp, synthetic construct
  misc_feature 1..22: note = Synthetic Construct
  source 1..22: mol_type = other DNA
tttgggggaagttttggtggaa

SEQ ID NO: 6577 - DNA, 22 bp, synthetic construct
  misc_feature 1..22: note = Synthetic Construct
  source 1..22: mol_type = other DNA
gctgagcagggacatcttttga

SEQ ID NO: 6578 - DNA, 22 bp, synthetic construct
  misc_feature 1..22: note = Synthetic Construct
  source 1..22: mol_type = other DNA
gccccctctgaggcttatttcc

SEQ ID NO: 6579 - DNA, 24 bp, synthetic construct
  misc_feature 1..24: note = Synthetic Construct
  source 1..24: mol_type = other DNA
gagggattgtggatctgcttgatg

SEQ ID NO: 6580 - DNA, 21 bp, synthetic construct
  misc_feature 1..21: note = Synthetic Construct
  source 1..21: mol_type = other DNA
cgaggggtgatgaaggattgg

SEQ ID NO: 6581 - DNA, 28 bp, synthetic construct
  misc_feature 1..28: note = Synthetic Construct
  source 1..28: mol_type = other DNA
ccttgtcctacaattagaggcaaaattg

SEQ ID NO: 6582 - DNA, 24 bp, synthetic construct
  misc_feature 1..24: note = Synthetic Construct
  source 1..24: mol_type = other DNA
ggtccttcaacatgaggagctttc

SEQ ID NO: 6583 - DNA, 22 bp, synthetic construct
  misc_feature 1..22: note = Synthetic Construct
  source 1..22: mol_type = other DNA
aaggggtccaggtgacataacg

SEQ ID NO: 6584 - DNA, 21 bp, synthetic construct
  misc_feature 1..21: note = Synthetic Construct
  source 1..21: mol_type = other DNA
tccatctcaggggcagatcca

SEQ ID NO: 6585 - DNA, 20 bp, synthetic construct
  misc_feature 1..20: note = Synthetic Construct
  source 1..20: mol_type = other DNA
tgcccgggagcaaaatcagt

SEQ ID NO: 6586 - DNA, 24 bp, synthetic construct
  misc_feature 1..24: note = Synthetic Construct
  source 1..24: mol_type = other DNA
tcaggggagtatgatggagagcta

SEQ ID NO: 6587 - DNA, 27 bp, synthetic construct
  misc_feature 1..27: note = Synthetic Construct
  source 1..27: mol_type = other DNA
gctaaaaccaataactacggtcaagtc

SEQ ID NO: 6588 - DNA, 21 bp, synthetic construct
  misc_feature 1..21: note = Synthetic Construct
  source 1..21: mol_type = other DNA
agatggggccactgtattgct

SEQ ID NO: 6589 - DNA, 25 bp, synthetic construct
  misc_feature 1..25: note = Synthetic Construct
  source 1..25: mol_type = other DNA
gagtgaatacattgagggccttgac

SEQ ID NO: 6590 - DNA, 24 bp, synthetic construct
  misc_feature 1..24: note = Synthetic Construct
  source 1..24: mol_type = other DNA
cgctaagcatgatgccaggttttg

SEQ ID NO: 6591 - DNA, 20 bp, synthetic construct
  misc_feature 1..20: note = Synthetic Construct
  source 1..20: mol_type = other DNA
catcagacagcctcgtgcat

SEQ ID NO: 6592 - DNA, 25 bp, synthetic construct
  misc_feature 1..25: note = Synthetic Construct
  source 1..25: mol_type = other DNA
ccaagcagcttagctatagcattcc

SEQ ID NO: 6593 - DNA, 25 bp, synthetic construct
  misc_feature 1..25: note = Synthetic Construct
  source 1..25: mol_type = other DNA
gtagcttccatccagttaacctcaa

SEQ ID NO: 6594 - DNA, 27 bp, synthetic construct
  misc_feature 1..27: note = Synthetic Construct
  source 1..27: mol_type = other DNA
gaggaaatacaactggaatctggttga

SEQ ID NO: 6595 - DNA, 24 bp, synthetic construct
  misc_feature 1..24: note = Synthetic Construct
  source 1..24: mol_type = other DNA
aggctccagttttgaggtgacaag

SEQ ID NO: 6596 - DNA, 27 bp, synthetic construct
  misc_feature 1..27: note = Synthetic Construct
  source 1..27: mol_type = other DNA
ggtgagaagagagaagtaatggttcac

SEQ ID NO: 6597 - DNA, 24 bp, synthetic construct
  misc_feature 1..24: note = Synthetic Construct
  source 1..24: mol_type = other DNA
ctgactagggtactgtctcctgat

SEQ ID NO: 6598 - DNA, 24 bp, synthetic construct
  misc_feature 1..24: note = Synthetic Construct
  source 1..24: mol_type = other DNA
accaatcttgacctggggaaactg

SEQ ID NO: 6599 - DNA, 21 bp, synthetic construct
  misc_feature 1..21: note = Synthetic Construct
  source 1..21: mol_type = other DNA
atggccagtaagggggctact

SEQ ID NO: 6600 - DNA, 23 bp, synthetic construct
  misc_feature 1..23: note = Synthetic Construct
  source 1..23: mol_type = other DNA
accttctgcagagtcctggatgt

SEQ ID NO: 6601 - DNA, 24 bp, synthetic construct
  misc_feature 1..24: note = Synthetic Construct
  source 1..24: mol_type = other DNA
agttggggaggtagatgtgtttcc

SEQ ID NO: 6602 - DNA, 24 bp, synthetic construct
  misc_feature 1..24: note = Synthetic Construct
  source 1..24: mol_type = other DNA
ccatttacaccagggatcgagaca

SEQ ID NO: 6603 - DNA, 22 bp, synthetic construct
  misc_feature 1..22: note = Synthetic Construct
  source 1..22: mol_type = other DNA
agtccgtccaggttcaaaagtg

SEQ ID NO: 6604 - DNA, 25 bp, synthetic construct
  misc_feature 1..25: note = Synthetic Construct
  source 1..25: mol_type = other DNA
tctagtccttctgtttggagtttgg

SEQ ID NO: 6605 - DNA, 24 bp, synthetic construct
  misc_feature 1..24: note = Synthetic Construct
  source 1..24: mol_type = other DNA
agacatcagttccttgaagctgaa

SEQ ID NO: 6606 - DNA, 23 bp, synthetic construct
  misc_feature 1..23: note = Synthetic Construct
  source 1..23: mol_type = other DNA
tgcagatgtctaggctccactca

SEQ ID NO: 6607 - DNA, 27 bp, synthetic construct
  misc_feature 1..27: note = Synthetic Construct
  source 1..27: mol_type = other DNA
aaagtattgtagccatggagagatcaa

SEQ ID NO: 6608 - DNA, 20 bp, synthetic construct
  misc_feature 1..20: note = Synthetic Construct
  source 1..20: mol_type = other DNA
atgggttctgggctgacaga

SEQ ID NO: 6609 - DNA, 22 bp, synthetic construct
  misc_feature 1..22: note = Synthetic Construct
  source 1..22: mol_type = other DNA
gccttggcctcaatatgagctt

SEQ ID NO: 6610 - DNA, 21 bp, synthetic construct
  misc_feature 1..21: note = Synthetic Construct
  source 1..21: mol_type = other DNA
agcaggtgaggactgaggatt

SEQ ID NO: 6611 - DNA, 21 bp, synthetic construct
  misc_feature 1..21: note = Synthetic Construct
  source 1..21: mol_type = other DNA
gtggagaaggtaggcctgact

SEQ ID NO: 6612 - DNA, 23 bp, synthetic construct
  misc_feature 1..23: note = Synthetic Construct
  source 1..23: mol_type = other DNA
gccatcccatctgagatgctaga

SEQ ID NO: 6613 - DNA, 29 bp, synthetic construct
  misc_feature 1..29: note = Synthetic Construct
  source 1..29: mol_type = other DNA
cacagtagatactaactggtcttactgtt

SEQ ID NO: 6614 - DNA, 22 bp, synthetic construct
  misc_feature 1..22: note = Synthetic Construct
  source 1..22: mol_type = other DNA
ttctgggacgccagcagaactt

SEQ ID NO: 6615 - DNA, 26 bp, synthetic construct
  misc_feature 1..26: note = Synthetic Construct
  source 1..26: mol_type = other DNA
gaaaaatcaatccctccttccatgag

SEQ ID NO: 6616 - DNA, 26 bp, synthetic construct
  misc_feature 1..26: note = Synthetic Construct
  source 1..26: mol_type = other DNA
cgtcacatcgtttatgctaacagtct

SEQ ID NO: 6617 - DNA, 23 bp, synthetic construct
  misc_feature 1..23: note = Synthetic Construct
  source 1..23: mol_type = other DNA
aacttcgtgggatccctcttctg

SEQ ID NO: 6618 - DNA, 26 bp, synthetic construct
  misc_feature 1..26: note = Synthetic Construct
  source 1..26: mol_type = other DNA
tgacaatttttggcactagagacact

SEQ ID NO: 6619 - DNA, 22 bp, synthetic construct
  misc_feature 1..22: note = Synthetic Construct
  source 1..22: mol_type = other DNA
tcattcctggacccagctttct

SEQ ID NO: 6620 - DNA, 26 bp, synthetic construct
  misc_feature 1..26: note = Synthetic Construct
  source 1..26: mol_type = other DNA
ggtacttcctgaacatcactctgtac

SEQ ID NO: 6621 - DNA, 22 bp, synthetic construct
  misc_feature 1..22: note = Synthetic Construct
  source 1..22: mol_type = other DNA
gtgggctttggtgtgtaattgg

SEQ ID NO: 6622 - DNA, 19 bp, synthetic construct
  misc_feature 1..19: note = Synthetic Construct
  source 1..19: mol_type = other DNA
ccagcgtggctccgagcaa

SEQ ID NO: 6623 - DNA, 24 bp, synthetic construct
  misc_feature 1..24: note = Synthetic Construct
  source 1..24: mol_type = other DNA
ggaaatctcagtagggcattttgc

SEQ ID NO: 6624 - DNA, 22 bp, synthetic construct
  misc_feature 1..22: note = Synthetic Construct
  source 1..22: mol_type = other DNA
acactatgtctcctgcctggaa

SEQ ID NO: 6625 - DNA, 26 bp, synthetic construct
  misc_feature 1..26: note = Synthetic Construct
  source 1..26: mol_type = other DNA
cctacctactacacttctgtgcagtt

SEQ ID NO: 6626 - DNA, 21 bp, synthetic construct
  misc_feature 1..21: note = Synthetic Construct
  source 1..21: mol_type = other DNA
agggacccattggtgaacagt

SEQ ID NO: 6627 - DNA, 22 bp, synthetic construct
  misc_feature 1..22: note = Synthetic Construct
  source 1..22: mol_type = other DNA
tcctgtgcccaaaagacctaga

SEQ ID NO: 6628 - DNA, 22 bp, synthetic construct
  misc_feature 1..22: note = Synthetic Construct
  source 1..22: mol_type = other DNA
ggtcacagccataacacagaca

SEQ ID NO: 6629 - DNA, 24 bp, synthetic construct
  misc_feature 1..24: note = Synthetic Construct
  source 1..24: mol_type = other DNA
aggttcctgggagctgaatataca

SEQ ID NO: 6630 - DNA, 21 bp, synthetic construct
  misc_feature 1..21: note = Synthetic Construct
  source 1..21: mol_type = other DNA
atgggggttatggtggcaaga

SEQ ID NO: 6631 - DNA, 23 bp, synthetic construct
  misc_feature 1..23: note = Synthetic Construct
  source 1..23: mol_type = other DNA
tggatgtgttttgtgtccaccaa

SEQ ID NO: 6632 - DNA, 18 bp, synthetic construct
  misc_feature 1..18: note = Synthetic Construct
  source 1..18: mol_type = other DNA
agcatggaggccgatgtg

SEQ ID NO: 6633 - DNA, 26 bp, synthetic construct
  misc_feature 1..26: note = Synthetic Construct
  source 1..26: mol_type = other DNA
ccttcctgtcagatttacctgattgc

SEQ ID NO: 6634 - DNA, 24 bp, synthetic construct
  misc_feature 1..24: note = Synthetic Construct
  source 1..24: mol_type = other DNA
aaaagcctgccctatagtcagtac

SEQ ID NO: 6635 - DNA, 25 bp, synthetic construct
  misc_feature 1..25: note = Synthetic Construct
  source 1..25: mol_type = other DNA
agatatagactggctgctgtctaga

SEQ ID NO: 6636 - DNA, 24 bp, synthetic construct
  misc_feature 1..24: note = Synthetic Construct
  source 1..24: mol_type = other DNA
gcctccacagcagtgattctcaaa

SEQ ID NO: 6637 - DNA, 26 bp, synthetic construct
  misc_feature 1..26: note = Synthetic Construct
  source 1..26: mol_type = other DNA
cccactacccatctcattgcttaagc

SEQ ID NO: 6638 - DNA, 24 bp, synthetic construct
  misc_feature 1..24: note = Synthetic Construct
  source 1..24: mol_type = other DNA
ggcaacggagtgattcagttctct

SEQ ID NO: 6639 - DNA, 27 bp, synthetic construct
  misc_feature 1..27: note = Synthetic Construct
  source 1..27: mol_type = other DNA
gttttactcttacgtactgctgattgc

SEQ ID NO: 6640 - DNA, 22 bp, synthetic construct
  misc_feature 1..22: note = Synthetic Construct
  source 1..22: mol_type = other DNA
agcagcaccacactgtagtagt

SEQ ID NO: 6641 - DNA, 22 bp, synthetic construct
  misc_feature 1..22: note = Synthetic Construct
  source 1..22: mol_type = other DNA
gagagcctacgacaacattcca

SEQ ID NO: 6642 - DNA, 25 bp, synthetic construct
  misc_feature 1..25: note = Synthetic Construct
  source 1..25: mol_type = other DNA
gctgataaaccggatacagctttcc

SEQ ID NO: 6643 - DNA, 24 bp, synthetic construct
  misc_feature 1..24: note = Synthetic Construct
  source 1..24: mol_type = other DNA
cctggctctcctgtgtagcaaata

SEQ ID NO: 6644 - DNA, 20 bp, synthetic construct
  misc_feature 1..20: note = Synthetic Construct
  source 1..20: mol_type = other DNA
tgccatcactgtggtgcatt

SEQ ID NO: 6645 - DNA, 21 bp, synthetic construct
  misc_feature 1..21: note = Synthetic Construct
  source 1..21: mol_type = other DNA
tccgtgagtcagctaccatgt

SEQ ID NO: 6646 - DNA, 20 bp, synthetic construct
  misc_feature 1..20: note = Synthetic Construct
  source 1..20: mol_type = other DNA
accccacgaccatgagtcaa

SEQ ID NO: 6647 - DNA, 18 bp, synthetic construct
  misc_feature 1..18: note = Synthetic Construct
  source 1..18: mol_type = other DNA
aggggctgcgagcagttg

SEQ ID NO: 6648 - DNA, 22 bp, synthetic construct
  misc_feature 1..22: note = Synthetic Construct
  source 1..22: mol_type = other DNA
tgaccaggtacccttgttcagt

SEQ ID NO: 6649 - DNA, 23 bp, synthetic construct
  misc_feature 1..23: note = Synthetic Construct
  source 1..23: mol_type = other DNA
gacttggtaatcccactcccaaa

SEQ ID NO: 6650 - DNA, 22 bp, synthetic construct
  misc_feature 1..22: note = Synthetic Construct
  source 1..22: mol_type = other DNA
agattggagttgccatcaagca

SEQ ID NO: 6651 - DNA, 24 bp, synthetic construct
  misc_feature 1..24: note = Synthetic Construct
  source 1..24: mol_type = other DNA
tgtgttaccatggaatctcttgca

SEQ ID NO: 6652 - DNA, 28 bp, synthetic construct
  misc_feature 1..28: note = Synthetic Construct
  source 1..28: mol_type = other DNA
gaatgaaacaagaaggtctaggcttttc

SEQ ID NO: 6653 - DNA, 20 bp, synthetic construct
  misc_feature 1..20: note = Synthetic Construct
  source 1..20: mol_type = other DNA
tggccaggtcctcacagcat

SEQ ID NO: 6654 - DNA, 22 bp, synthetic construct
  misc_feature 1..22: note = Synthetic Construct
  source 1..22: mol_type = other DNA
gatggcagctgagattctgtca

SEQ ID NO: 6655 - DNA, 21 bp, synthetic construct
  misc_feature 1..21: note = Synthetic Construct
  source 1..21: mol_type = other DNA
aagtccgcacagagctttgga

SEQ ID NO: 6656 - DNA, 22 bp, synthetic construct
  misc_feature 1..22: note = Synthetic Construct
  source 1..22: mol_type = other DNA
tcagagggcctgatctcaatgt

SEQ ID NO: 6657 - DNA, 24 bp, synthetic construct
  misc_feature 1..24: note = Synthetic Construct
  source 1..24: mol_type = other DNA
gacccacagactgatacacttgtg

SEQ ID NO: 6658 - DNA, 18 bp, synthetic construct
  misc_feature 1..18: note = Synthetic Construct
  source 1..18: mol_type = other DNA
ccaggacctggccatcct

SEQ ID NO: 6659 - DNA, 27 bp, synthetic construct
  misc_feature 1..27: note = Synthetic Construct
  source 1..27: mol_type = other DNA
gggaaaaggaatgcttgatggaagttc

SEQ ID NO: 6660 - DNA, 21 bp, synthetic construct
  misc_feature 1..21: note = Synthetic Construct
  source 1..21: mol_type = other DNA
ttgcgggaccagcatccaaat

SEQ ID NO: 6661 - DNA, 24 bp, synthetic construct
  misc_feature 1..24: note = Synthetic Construct
  source 1..24: mol_type = other DNA
cacctccctggttgttggaaaatc

SEQ ID NO: 6662 - DNA, 20 bp, synthetic construct
  misc_feature 1..20: note = Synthetic Construct
  source 1..20: mol_type = other DNA
tcaccagggtagggcaatgt

SEQ ID NO: 6663 - DNA, 25 bp, synthetic construct
  misc_feature 1..25: note = Synthetic Construct
  source 1..25: mol_type = other DNA
ctgaagagatgacctaaagctcaca

SEQ ID NO: 6664 - DNA, 22 bp, synthetic construct
  misc_feature 1..22: note = Synthetic Construct
  source 1..22: mol_type = other DNA
ggcagaatttagcaccggagta

SEQ ID NO: 6665 - DNA, 24 bp, synthetic construct
  misc_feature 1..24: note = Synthetic Construct
  source 1..24: mol_type = other DNA
gaagaaatttggatggctcagctt

SEQ ID NO: 6666 - DNA, 22 bp, synthetic construct
  misc_feature 1..22: note = Synthetic Construct
  source 1..22: mol_type = other DNA
ttggccgaccagagtatgaatc

SEQ ID NO: 6667 - DNA, 21 bp, synthetic construct
  misc_feature 1..21: note = Synthetic Construct
  source 1..21: mol_type = other DNA
aggtggaggccatctgctttt

SEQ ID NO: 6668 - DNA, 25 bp, synthetic construct
  misc_feature 1..25: note = Synthetic Construct
  source 1..25: mol_type = other DNA
cgttcagattgggagcaagaaagac

SEQ ID NO: 6669 - DNA, 25 bp, synthetic construct
  misc_feature 1..25: note = Synthetic Construct
  source 1..25: mol_type = other DNA
gttgttggttgggttggtttattgg

SEQ ID NO: 6670 - DNA, 21 bp, synthetic construct
  misc_feature 1..21: note = Synthetic Construct
  source 1..21: mol_type = other DNA
cagcctcctcacctttcactt

SEQ ID NO: 6671 - DNA, 28 bp, synthetic construct
  misc_feature 1..28: note = Synthetic Construct
  source 1..28: mol_type = other DNA
gaactcacactgtaacacttttagtcaa

SEQ ID NO: 6672 - DNA, 22 bp, synthetic construct
  misc_feature 1..22: note = Synthetic Construct
  source 1..22: mol_type = other DNA
gatatgggctgcaggaaacctt

SEQ ID NO: 6673 - DNA, 20 bp, synthetic construct
  misc_feature 1..20: note = Synthetic Construct
  source 1..20: mol_type = other DNA
tcccccaacctctccttcca

SEQ ID NO: 6674 - DNA, 22 bp, synthetic construct
  misc_feature 1..22: note = Synthetic Construct
  source 1..22: mol_type = other DNA
ttgggcttgagtgtggatagct

SEQ ID NO: 6675 - DNA, 20 bp, synthetic construct
  misc_feature 1..20: note = Synthetic Construct
  source 1..20: mol_type = other DNA
cctcgctgtggcttatgaca

SEQ ID NO: 6676 - DNA, 22 bp, synthetic construct
  misc_feature 1..22: note = Synthetic Construct
  source 1..22: mol_type = other DNA
gcacaggaaaaaggtggtttcc

SEQ ID NO: 6677 - DNA, 20 bp, synthetic construct
  misc_feature 1..20: note = Synthetic Construct
  source 1..20: mol_type = other DNA
ggggctagggcaaaggaaaa

SEQ ID NO: 6678 - DNA, 19 bp, synthetic construct
  misc_feature 1..19: note = Synthetic Construct
  source 1..19: mol_type = other DNA
gtggcctgaggtcatgctt

SEQ ID NO: 6679 - DNA, 25 bp, synthetic construct
  misc_feature 1..25: note = Synthetic Construct
  source 1..25: mol_type = other DNA
tcactccactttacaggcacatatt

SEQ ID NO: 6680 - DNA, 24 bp, synthetic construct
  misc_feature 1..24: note = Synthetic Construct
  source 1..24: mol_type = other DNA
gacctgtggattggctcaatttcc

SEQ ID NO: 6681 - DNA, 22 bp, synthetic construct
  misc_feature 1..22: note = Synthetic Construct
  source 1..22: mol_type = other DNA
ccattgccacctgattctttgc

SEQ ID NO: 6682 - DNA, 22 bp, synthetic construct
  misc_feature 1..22: note = Synthetic Construct
  source 1..22: mol_type = other DNA
ctcatcctgactgcctttgcta

SEQ ID NO: 6683 - DNA, 19 bp, synthetic construct
  misc_feature 1..19: note = Synthetic Construct
  source 1..19: mol_type = other DNA
agtgctgtggcctcattgc

SEQ ID NO: 6684 - DNA, 26 bp, synthetic construct
  misc_feature 1..26: note = Synthetic Construct
  source 1..26: mol_type = other DNA
catcagttcaaagcctagactctctt

SEQ ID NO: 6685 - DNA, 19 bp, synthetic construct
  misc_feature 1..19: note = Synthetic Construct
  source 1..19: mol_type = other DNA
ccttctggcctggcccaaa

SEQ ID NO: 6686 - DNA, 24 bp, synthetic construct
  misc_feature 1..24: note = Synthetic Construct
  source 1..24: mol_type = other DNA
tgttcccactttctttcccttctg

SEQ ID NO: 6687 - DNA, 24 bp, synthetic construct
  misc_feature 1..24: note = Synthetic Construct
  source 1..24: mol_type = other DNA
ggaaaggagaatagcagtgaagga

SEQ ID NO: 6688 - DNA, 22 bp, synthetic construct
  misc_feature 1..22: note = Synthetic Construct
  source 1..22: mol_type = other DNA
cctggaacaataggcccatgat

SEQ ID NO: 6689 - DNA, 22 bp, synthetic construct
  misc_feature 1..22: note = Synthetic Construct
  source 1..22: mol_type = other DNA
aaggtagctggggcaagagtaa

SEQ ID NO: 6690 - DNA, 21 bp, synthetic construct
  misc_feature 1..21: note = Synthetic Construct
  source 1..21: mol_type = other DNA
cagcaaagccagcagtagtca

SEQ ID NO: 6691 - DNA, 21 bp, synthetic construct
  misc_feature 1..21: note = Synthetic Construct
  source 1..21: mol_type = other DNA
gactgtgtgcccattcactgt

SEQ ID NO: 6692 - DNA, 27 bp, synthetic construct
  misc_feature 1..27: note = Synthetic Construct
  source 1..27: mol_type = other DNA
gttggtagaccttagagatcaatgagt

SEQ ID NO: 6693 - DNA, 26 bp, synthetic construct
  misc_feature 1..26: note = Synthetic Construct
  source 1..26: mol_type = other DNA
ccctatcttccactgcctgttaactc

SEQ ID NO: 6694 - DNA, 22 bp, synthetic construct
  misc_feature 1..22: note = Synthetic Construct
  source 1..22: mol_type = other DNA
gctgcttttgctcccctttgat

SEQ ID NO: 6695 - DNA, 30 bp, synthetic construct
  misc_feature 1..30: note = Synthetic Construct
  source 1..30: mol_type = other DNA
aaatacatgtgttagataggcttctttcag

SEQ ID NO: 6696 - DNA, 21 bp, synthetic construct
  misc_feature 1..21: note = Synthetic Construct
  source 1..21: mol_type = other DNA
gcaactgtgcccaatcatgct

SEQ ID NO: 6697 - DNA, 23 bp, synthetic construct
  misc_feature 1..23: note = Synthetic Construct
  source 1..23: mol_type = other DNA
ggcttccttgtttttccctccaa

SEQ ID NO: 6698 - DNA, 19 bp, synthetic construct
  misc_feature 1..19: note = Synthetic Construct
  source 1..19: mol_type = other DNA
aggccgcaccctcccacat

SEQ ID NO: 6699 - DNA, 24 bp, synthetic construct
  misc_feature 1..24: note = Synthetic Construct
  source 1..24: mol_type = other DNA
ggttgccattgtgtccatttttga

SEQ ID NO: 6700 - DNA, 22 bp, synthetic construct
  misc_feature 1..22: note = Synthetic Construct
  source 1..22: mol_type = other DNA
ctgctcagaagctgcctgattt

SEQ ID NO: 6701 - DNA, 21 bp, synthetic construct
  misc_feature 1..21: note = Synthetic Construct
  source 1..21: mol_type = other DNA
ttgctccacaggacagaacag

SEQ ID NO: 6702 - DNA, 24 bp, synthetic construct
  misc_feature 1..24: note = Synthetic Construct
  source 1..24: mol_type = other DNA
tgtcttctggacaggatggtcttc

SEQ ID NO: 6703 - DNA, 22 bp, synthetic construct
  misc_feature 1..22: note = Synthetic Construct
  source 1..22: mol_type = other DNA
ttcccaggatgaccttgtgtga

SEQ ID NO: 6704 - DNA, 24 bp, synthetic construct
  misc_feature 1..24: note = Synthetic Construct
  source 1..24: mol_type = other DNA
agtcttctttgggtggactttctg

SEQ ID NO: 6705 - DNA, 28 bp, synthetic construct
  misc_feature 1..28: note = Synthetic Construct
  source 1..28: mol_type = other DNA
gtaaaatgattcaaaaggggttctgagt

SEQ ID NO: 6706 - DNA, 22 bp, synthetic construct
  misc_feature 1..22: note = Synthetic Construct
  source 1..22: mol_type = other DNA
ctccagtgggggtgggtgtcat

SEQ ID NO: 6707 - DNA, 26 bp, synthetic construct
  misc_feature 1..26: note = Synthetic Construct
  source 1..26: mol_type = other DNA
ctttagagcaaattccttcccattcc

SEQ ID NO: 6708 - DNA, 24 bp, synthetic construct
  misc_feature 1..24: note = Synthetic Construct
  source 1..24: mol_type = other DNA
gcaggttaaatccctggtctcaag

SEQ ID NO: 6709 - DNA, 20 bp, synthetic construct
  misc_feature 1..20: note = Synthetic Construct
  source 1..20: mol_type = other DNA
agcttgtgctcctcccaact

SEQ ID NO: 6710 - DNA, 22 bp, synthetic construct
  misc_feature 1..22: note = Synthetic Construct
  source 1..22: mol_type = other DNA
gctccattctctctgcagacaa

SEQ ID NO: 6711 - DNA, 27 bp, synthetic construct
  misc_feature 1..27: note = Synthetic Construct
  source 1..27: mol_type = other DNA
gctcttcaaatacgatctcctgtaagc

SEQ ID NO: 6712 - DNA, 24 bp, synthetic construct
  misc_feature 1..24: note = Synthetic Construct
  source 1..24: mol_type = other DNA
acgcagctggagatgagagatagt

SEQ ID NO: 6713 - DNA, 22 bp, synthetic construct
  misc_feature 1..22: note = Synthetic Construct
  source 1..22: mol_type = other DNA
gacttgttccctgtgtgaagca

SEQ ID NO: 6714 - DNA, 22 bp, synthetic construct
  misc_feature 1..22: note = Synthetic Construct
  source 1..22: mol_type = other DNA
aatggcacagttgtccagagaa

SEQ ID NO: 6715 - DNA, 20 bp, synthetic construct
  misc_feature 1..20: note = Synthetic Construct
  source 1..20: mol_type = other DNA
ctgcacctggaggactctga

SEQ ID NO: 6716 - DNA, 22 bp, synthetic construct
  misc_feature 1..22: note = Synthetic Construct
  source 1..22: mol_type = other DNA
gtccacaagttcaagccaacag

SEQ ID NO: 6717 - DNA, 24 bp, synthetic construct
  misc_feature 1..24: note = Synthetic Construct
  source 1..24: mol_type = other DNA
attcacatgacaccttgtgatcct

SEQ ID NO: 6718 - DNA, 20 bp, synthetic construct
  misc_feature 1..20: note = Synthetic Construct
  source 1..20: mol_type = other DNA
aggaacagaggcccagagaa

SEQ ID NO: 6719 - DNA, 24 bp, synthetic construct
  misc_feature 1..24: note = Synthetic Construct
  source 1..24: mol_type = other DNA
ttcaacctggcatagcctcatgag

SEQ ID NO: 6720 - DNA, 22 bp, synthetic construct
  misc_feature 1..22: note = Synthetic Construct
  source 1..22: mol_type = other DNA
aagagccgtcaaagggatgatc

SEQ ID NO: 6721 - DNA, 19 bp, synthetic construct
  misc_feature 1..19: note = Synthetic Construct
  source 1..19: mol_type = other DNA
gctaccacctgcccaaagt

SEQ ID NO: 6722 - DNA, 22 bp, synthetic construct
  misc_feature 1..22: note = Synthetic Construct
  source 1..22: mol_type = other DNA
ccaggtgttgctagcagtactc

SEQ ID NO: 6723 - DNA, 26 bp, synthetic construct
  misc_feature 1..26: note = Synthetic Construct
  source 1..26: mol_type = other DNA
acagtgacagttaagaggtctttgtc

SEQ ID NO: 6724 - DNA, 22 bp, synthetic construct
  misc_feature 1..22: note = Synthetic Construct
  source 1..22: mol_type = other DNA
agggtggggatcaaaggaagtt

SEQ ID NO: 6725 - DNA, 21 bp, synthetic construct
  misc_feature 1..21: note = Synthetic Construct
  source 1..21: mol_type = other DNA
tgggacagggatccacaggta

SEQ ID NO: 6726 - DNA, 20 bp, synthetic construct
  misc_feature 1..20: note = Synthetic Construct
  source 1..20: mol_type = other DNA
ctgtgaaaccctgccacaca

SEQ ID NO: 6727 - DNA, 20 bp, synthetic construct
  misc_feature 1..20: note = Synthetic Construct
  source 1..20: mol_type = other DNA
tggtgtcctgggagccattt

SEQ ID NO: 6728 - DNA, 23 bp, synthetic construct
  misc_feature 1..23: note = Synthetic Construct
  source 1..23: mol_type = other DNA
gagggaccacttgacagtattgt

SEQ ID NO: 6729 - DNA, 28 bp, synthetic construct
  misc_feature 1..28: note = Synthetic Construct
  source 1..28: mol_type = other DNA
tcaataagatttttaagcaacccaccat

SEQ ID NO: 6730 - DNA, 24 bp, synthetic construct
  misc_feature 1..24: note = Synthetic Construct
  source 1..24: mol_type = other DNA
aatgagctgtgatttgctgtgttt

SEQ ID NO: 6731 - DNA, 22 bp, synthetic construct
  misc_feature 1..22: note = Synthetic Construct
  source 1..22: mol_type = other DNA
ccattcgtgaaggtggagttgt

SEQ ID NO: 6732 - DNA, 22 bp, synthetic construct
  misc_feature 1..22: note = Synthetic Construct
  source 1..22: mol_type = other DNA
tgagacgaggtctggttctgtt

SEQ ID NO: 6733 - DNA, 22 bp, synthetic construct
  misc_feature 1..22: note = Synthetic Construct
  source 1..22: mol_type = other DNA
gcctgtccagcaatggcctaga

SEQ ID NO: 6734 - DNA, 26 bp, synthetic construct
  misc_feature 1..26: note = Synthetic Construct
  source 1..26: mol_type = other DNA
ggcctatcagtcaggttgtttaagtg

SEQ ID NO: 6735 - DNA, 21 bp, synthetic construct
  misc_feature 1..21: note = Synthetic Construct
  source 1..21: mol_type = other DNA
ttggccttctgcagcaaggat

SEQ ID NO: 6736 - DNA, 22 bp, synthetic construct
  misc_feature 1..22: note = Synthetic Construct
  source 1..22: mol_type = other DNA
gattttacaggcaccccagctt

SEQ ID NO: 6737 - DNA, 22 bp, synthetic construct
  misc_feature 1..22: note = Synthetic Construct
  source 1..22: mol_type = other DNA
tgaggaggagttgagggaatga

SEQ ID NO: 6738 - DNA, 21 bp, synthetic construct
  misc_feature 1..21: note = Synthetic Construct
  source 1..21: mol_type = other DNA
agcctctgggaccaggacaaa

SEQ ID NO: 6739 - DNA, 21 bp, synthetic construct
  misc_feature 1..21: note = Synthetic Construct
  source 1..21: mol_type = other DNA
agcatggaggctctgggatga

SEQ ID NO: 6740 - DNA, 23 bp, synthetic construct
  misc_feature 1..23: note = Synthetic Construct
  source 1..23: mol_type = other DNA
gcagcttcctcaaacgtaacatg

SEQ ID NO: 6741 - DNA, 21 bp, synthetic construct
  misc_feature 1..21: note = Synthetic Construct
  source 1..21: mol_type = other DNA
agctcacagatctgggtctgt

SEQ ID NO: 6742 - DNA, 23 bp, synthetic construct
  misc_feature 1..23: note = Synthetic Construct
  source 1..23: mol_type = other DNA
cctgtgggaggagaggtcaccat

SEQ ID NO: 6743 - DNA, 22 bp, synthetic construct
  misc_feature 1..22: note = Synthetic Construct
  source 1..22: mol_type = other DNA
ggcagcgtttgtgaatgtacag

SEQ ID NO: 6744 - DNA, 21 bp, synthetic construct
  misc_feature 1..21: note = Synthetic Construct
  source 1..21: mol_type = other DNA
attcacagcttggcacagagt

SEQ ID NO: 6745 - DNA, 24 bp, synthetic construct
  misc_feature 1..24: note = Synthetic Construct
  source 1..24: mol_type = other DNA
ccaaaacaggcagaccatgtcctt

SEQ ID NO: 6746 - DNA, 20 bp, synthetic construct
  misc_feature 1..20: note = Synthetic Construct
  source 1..20: mol_type = other DNA
aagggcaggggaaggaaagg

SEQ ID NO: 6747 - DNA, 24 bp, synthetic construct
  misc_feature 1..24: note = Synthetic Construct
  source 1..24: mol_type = other DNA
tgccaatgggaggatagggatact

SEQ ID NO: 6748 - DNA, 22 bp, synthetic construct
  misc_feature 1..22: note = Synthetic Construct
  source 1..22: mol_type = other DNA
gctgtctccagaattccatggt

SEQ ID NO: 6749 - DNA, 19 bp, synthetic construct
  misc_feature 1..19: note = Synthetic Construct
  source 1..19: mol_type = other DNA
gggaaccccaggcatgtga

SEQ ID NO: 6750 - DNA, 19 bp, synthetic construct
  misc_feature 1..19: note = Synthetic Construct
  source 1..19: mol_type = other DNA
cccatgtgtgcccatttgc

SEQ ID NO: 6751 - DNA, 19 bp, synthetic construct
  misc_feature 1..19: note = Synthetic Construct
  source 1..19: mol_type = other DNA
tgcccctgccatccgtcat

SEQ ID NO: 6752 - DNA, 23 bp, synthetic construct
  misc_feature 1..23: note = Synthetic Construct
  source 1..23: mol_type = other DNA
cccataaagagatggtgccagtt

SEQ ID NO: 6753 - DNA, 22 bp, synthetic construct
  misc_feature 1..22: note = Synthetic Construct
  source 1..22: mol_type = other DNA
cggaggaaaccacaaggtcctt

SEQ ID NO: 6754 - DNA, 23 bp, synthetic construct
  misc_feature 1..23: note = Synthetic Construct
  source 1..23: mol_type = other DNA
gcttcgtgcttttacctgactgt

SEQ ID NO: 6755 - DNA, 21 bp, synthetic construct
  misc_feature 1..21: note = Synthetic Construct
  source 1..21: mol_type = other DNA
attcctgcctcctggtaacgt

SEQ ID NO: 6756 - DNA, 25 bp, synthetic construct
  misc_feature 1..25: note = Synthetic Construct
  source 1..25: mol_type = other DNA
ccagtaaaagcagctctgacttgga

SEQ ID NO: 6757 - DNA, 25 bp, synthetic construct
  misc_feature 1..25: note = Synthetic Construct
  source 1..25: mol_type = other DNA
gccggatacagtgagattcgtaatc

SEQ ID NO: 6758 - DNA, 26 bp, synthetic construct
  misc_feature 1..26: note = Synthetic Construct
  source 1..26: mol_type = other DNA
ctcactgttctctgtcactcactttt

SEQ ID NO: 6759 - DNA, 24 bp, synthetic construct
  misc_feature 1..24: note = Synthetic Construct
  source 1..24: mol_type = other DNA
gcactggaggagtctacataacca

SEQ ID NO: 6760 - DNA, 20 bp, synthetic construct
  misc_feature 1..20: note = Synthetic Construct
  source 1..20: mol_type = other DNA
tccagtggcaatggcagact

SEQ ID NO: 6761 - DNA, 23 bp, synthetic construct
  misc_feature 1..23: note = Synthetic Construct
  source 1..23: mol_type = other DNA
tttctagctggttggttggaact

SEQ ID NO: 6762 - DNA, 24 bp, synthetic construct
  misc_feature 1..24: note = Synthetic Construct
  source 1..24: mol_type = other DNA
tgcatgtcctagaagagggtacag

SEQ ID NO: 6763 - DNA, 26 bp, synthetic construct
  misc_feature 1..26: note = Synthetic Construct
  source 1..26: mol_type = other DNA
cctagtctcctcactgggaaatagga

SEQ ID NO: 6764 - DNA, 22 bp, synthetic construct
  misc_feature 1..22: note = Synthetic Construct
  source 1..22: mol_type = other DNA
actgcccatagctcacaatctc

SEQ ID NO: 6765 - DNA, 30 bp, synthetic construct
  misc_feature 1..30: note = Synthetic Construct
  source 1..30: mol_type = other DNA
ccttgatactgaataagttctgatccactt

SEQ ID NO: 6766 - DNA, 28 bp, synthetic construct
  misc_feature 1..28: note = Synthetic Construct
  source 1..28: mol_type = other DNA
ccaaaatgttacccatagtaaagacgtt

SEQ ID NO: 6767 - DNA, 24 bp, synthetic construct
  misc_feature 1..24: note = Synthetic Construct
  source 1..24: mol_type = other DNA
gtgagtggtccaaagtgacttgat

SEQ ID NO: 6768 - DNA, 21 bp, synthetic construct
  misc_feature 1..21: note = Synthetic Construct
  source 1..21: mol_type = other DNA
aagcaaggctggatcctgtct

SEQ ID NO: 6769 - DNA, 21 bp, synthetic construct
  misc_feature 1..21: note = Synthetic Construct
  source 1..21: mol_type = other DNA
ctcccagggttggcattacag

SEQ ID NO: 6770 - DNA, 20 bp, synthetic construct
  misc_feature 1..20: note = Synthetic Construct
  source 1..20: mol_type = other DNA
tgggtagtggtggtgaggaa

SEQ ID NO: 6771 - DNA, 24 bp, synthetic construct
  misc_feature 1..24: note = Synthetic Construct
  source 1..24: mol_type = other DNA
tgggtagccctagacctttacttc

SEQ ID NO: 6772 - DNA, 24 bp, synthetic construct
  misc_feature 1..24: note = Synthetic Construct
  source 1..24: mol_type = other DNA
aggattgcaatgactcccatatgg

SEQ ID NO: 6773 - DNA, 24 bp, synthetic construct
  misc_feature 1..24: note = Synthetic Construct
  source 1..24: mol_type = other DNA
tggaaacagccagggatggtacat

SEQ ID NO: 6774 - DNA, 19 bp, synthetic construct
  misc_feature 1..19: note = Synthetic Construct
  source 1..19: mol_type = other DNA
tctggcaaggggacagtgt

SEQ ID NO: 6775 - DNA, 22 bp, synthetic construct
  misc_feature 1..22: note = Synthetic Construct
  source 1..22: mol_type = other DNA
tgcctagtgctctgtggtgtct

SEQ ID NO: 6776 - DNA, 24 bp, synthetic construct
  misc_feature 1..24: note = Synthetic Construct
  source 1..24: mol_type = other DNA
agtgctacaagagtcattgttgct

SEQ ID NO: 6777 - DNA, 22 bp, synthetic construct
  misc_feature 1..22: note = Synthetic Construct
  source 1..22: mol_type = other DNA
cttgaaatgaccccccattcct

SEQ ID NO: 6778 - DNA, 18 bp, synthetic construct
  misc_feature 1..18: note = Synthetic Construct
  source 1..18: mol_type = other DNA
ggggttgtggccgtgctt

SEQ ID NO: 6779 - DNA, 25 bp, synthetic construct
  misc_feature 1..25: note = Synthetic Construct
  source 1..25: mol_type = other DNA
cccaaactcctttgcaactaaatgg

SEQ ID NO: 6780 - DNA, 21 bp, synthetic construct
  misc_feature 1..21: note = Synthetic Construct
  source 1..21: mol_type = other DNA
ccatggcaatgacctggaagt

SEQ ID NO: 6781 - DNA, 21 bp, synthetic construct
  misc_feature 1..21: note = Synthetic Construct
  source 1..21: mol_type = other DNA
tggagagcagggggacacaat

SEQ ID NO: 6782 - DNA, 22 bp, synthetic construct
  misc_feature 1..22: note = Synthetic Construct
  source 1..22: mol_type = other DNA
gcaaagggaggcacagttcatt

SEQ ID NO: 6783 - DNA, 26 bp, synthetic construct
  misc_feature 1..26: note = Synthetic Construct
  source 1..26: mol_type = other DNA
gtaccagttttcattaatgggaagca

SEQ ID NO: 6784 - DNA, 25 bp, synthetic construct
  misc_feature 1..25: note = Synthetic Construct
  source 1..25: mol_type = other DNA
gcactgctggattcatcatcaagga

SEQ ID NO: 6785 - DNA, 20 bp, synthetic construct
  misc_feature 1..20: note = Synthetic Construct
  source 1..20: mol_type = other DNA
ggagatgggacctgcttgct

SEQ ID NO: 6786 - DNA, 21 bp, synthetic construct
  misc_feature 1..21: note = Synthetic Construct
  source 1..21: mol_type = other DNA
acacagagagcagaggggttt

SEQ ID NO: 6787 - DNA, 23 bp, synthetic construct
  misc_feature 1..23: note = Synthetic Construct
  source 1..23: mol_type = other DNA
caatagccgccttcttgaaacac

SEQ ID NO: 6788 - DNA, 22 bp, synthetic construct
  misc_feature 1..22: note = Synthetic Construct
  source 1..22: mol_type = other DNA
ttcctatgatgcccccatgtgt

SEQ ID NO: 6789 - DNA, 18 bp, synthetic construct
  misc_feature 1..18: note = Synthetic Construct
  source 1..18: mol_type = other DNA
caactggccagcctgtca

SEQ ID NO: 6790 - DNA, 23 bp, synthetic construct
  misc_feature 1..23: note = Synthetic Construct
  source 1..23: mol_type = other DNA
tggaatttctccctggggtatgc

SEQ ID NO: 6791 - DNA, 18 bp, synthetic construct
  misc_feature 1..18: note = Synthetic Construct
  source 1..18: mol_type = other DNA
gccactgctgctgctaca

SEQ ID NO: 6792 - DNA, 25 bp, synthetic construct
  misc_feature 1..25: note = Synthetic Construct
  source 1..25: mol_type = other DNA
accttttttcctccatgcagctaat

SEQ ID NO: 6793 - DNA, 21 bp, synthetic construct
  misc_feature 1..21: note = Synthetic Construct
  source 1..21: mol_type = other DNA
tctccagtcgaggccaaaact

SEQ ID NO: 6794 - DNA, 24 bp, synthetic construct
  misc_feature 1..24: note = Synthetic Construct
  source 1..24: mol_type = other DNA
gggagctactgttacaggtgttag

SEQ ID NO: 6795 - DNA, 26 bp, synthetic construct
  misc_feature 1..26: note = Synthetic Construct
  source 1..26: mol_type = other DNA
ccacagaaaataccactgctctgaac

SEQ ID NO: 6796 - DNA, 25 bp, synthetic construct
  misc_feature 1..25: note = Synthetic Construct
  source 1..25: mol_type = other DNA
gctggaaaggtaatggtgtcaccta

SEQ ID NO: 6797 - DNA, 25 bp, synthetic construct
  misc_feature 1..25: note = Synthetic Construct
  source 1..25: mol_type = other DNA
cacaaatctccagtatcctgttgct

SEQ ID NO: 6798 - DNA, 25 bp, synthetic construct
  misc_feature 1..25: note = Synthetic Construct
  source 1..25: mol_type = other DNA
gcccaaatgattgacacagctttct

SEQ ID NO: 6799 - DNA, 22 bp, synthetic construct
  misc_feature 1..22: note = Synthetic Construct
  source 1..22: mol_type = other DNA
acccagatcctccttcgagtga

SEQ ID NO: 6800 - DNA, 25 bp, synthetic construct
  misc_feature 1..25: note = Synthetic Construct
  source 1..25: mol_type = other DNA
cagagaacattcactgccttactct

SEQ ID NO: 6801 - DNA, 25 bp, synthetic construct
  misc_feature 1..25: note = Synthetic Construct
  source 1..25: mol_type = other DNA
ccataaccccggttgtaagtaaaca

SEQ ID NO: 6802 - DNA, 21 bp, synthetic construct
  misc_feature 1..21: note = Synthetic Construct
  source 1..21: mol_type = other DNA
atgggtccagtgggtaaaggt

SEQ ID NO: 6803 - DNA, 28 bp, synthetic construct
  misc_feature 1..28: note = Synthetic Construct
  source 1..28: mol_type = other DNA
caagcacaaatcagaaatatgtggtttg

SEQ ID NO: 6804 - DNA, 21 bp, synthetic construct
  misc_feature 1..21: note = Synthetic Construct
  source 1..21: mol_type = other DNA
gtgactgtgggagccttttca

SEQ ID NO: 6805 - DNA, 21 bp, synthetic construct
  misc_feature 1..21: note = Synthetic Construct
  source 1..21: mol_type = other DNA
agggtgaagccagggatcagt

SEQ ID NO: 6806 - DNA, 25 bp, synthetic construct
  misc_feature 1..25: note = Synthetic Construct
  source 1..25: mol_type = other DNA
cgcttcttcccttactgcatttagg

SEQ ID NO: 6807 - DNA, 23 bp, synthetic construct
  misc_feature 1..23: note = Synthetic Construct
  source 1..23: mol_type = other DNA
ggactaaaggggttcctgagaca

SEQ ID NO: 6808 - DNA, 21 bp, synthetic construct
  misc_feature 1..21: note = Synthetic Construct
  source 1..21: mol_type = other DNA
aggtgcctacaggacatttgg

SEQ ID NO: 6809 - DNA, 25 bp, synthetic construct
  misc_feature 1..25: note = Synthetic Construct
  source 1..25: mol_type = other DNA
ccagcagagcataccatacaataga

SEQ ID NO: 6810 - DNA, 22 bp, synthetic construct
  misc_feature 1..22: note = Synthetic Construct
  source 1..22: mol_type = other DNA
tctctctccaccctgtctgttt

SEQ ID NO: 6811 - DNA, 26 bp, synthetic construct
  misc_feature 1..26: note = Synthetic Construct
  source 1..26: mol_type = other DNA
aatccccaaagcctacttagaaactt

SEQ ID NO: 6812 - DNA, 20 bp, synthetic construct
  misc_feature 1..20: note = Synthetic Construct
  source 1..20: mol_type = other DNA
cccccttgtctacccttcca

SEQ ID NO: 6813 - DNA, 25 bp, synthetic construct
  misc_feature 1..25: note = Synthetic Construct
  source 1..25: mol_type = other DNA
gcagagagctctcgggtgtaaatta

SEQ ID NO: 6814 - DNA, 24 bp, synthetic construct
  misc_feature 1..24: note = Synthetic Construct
  source 1..24: mol_type = other DNA
ctttctacccatgactgtgagcat

SEQ ID NO: 6815 - DNA, 22 bp, synthetic construct
  misc_feature 1..22: note = Synthetic Construct
  source 1..22: mol_type = other DNA
tgcagcaggactctcaccttga

SEQ ID NO: 6816 - DNA, 24 bp, synthetic construct
  misc_feature 1..24: note = Synthetic Construct
  source 1..24: mol_type = other DNA
cgttgctacactgacatgcactac

SEQ ID NO: 6817 - DNA, 22 bp, synthetic construct
  misc_feature 1..22: note = Synthetic Construct
  source 1..22: mol_type = other DNA
aagtggcaaatgagcaggaaac

SEQ ID NO: 6818 - DNA, 24 bp, synthetic construct
  misc_feature 1..24: note = Synthetic Construct
  source 1..24: mol_type = other DNA
cagcctggatttctagcagctatc

SEQ ID NO: 6819 - DNA, 23 bp, synthetic construct
  misc_feature 1..23: note = Synthetic Construct
  source 1..23: mol_type = other DNA
ggtggacatttgtgggttttcag

SEQ ID NO: 6820 - DNA, 25 bp, synthetic construct
  misc_feature 1..25: note = Synthetic Construct
  source 1..25: mol_type = other DNA
cccagcctaatacaaagcccatgtt

SEQ ID NO: 6821 - DNA, 20 bp, synthetic construct
  misc_feature 1..20: note = Synthetic Construct
  source 1..20: mol_type = other DNA
gtcagcaccgggaagatgag

SEQ ID NO: 6822 - DNA, 27 bp, synthetic construct
  misc_feature 1..27: note = Synthetic Construct
  source 1..27: mol_type = other DNA
ggttccctgacaatgaaatgagggata

SEQ ID NO: 6823 - DNA, 21 bp, synthetic construct
  misc_feature 1..21: note = Synthetic Construct
  source 1..21: mol_type = other DNA
aactcaggcagtctgggaatg

SEQ ID NO: 6824 - DNA, 22 bp, synthetic construct
  misc_feature 1..22: note = Synthetic Construct
  source 1..22: mol_type = other DNA
ctggaagaatgcacagctttgg

SEQ ID NO: 6825 - DNA, 24 bp, synthetic construct
  misc_feature 1..24: note = Synthetic Construct
  source 1..24: mol_type = other DNA
ggtgggagggtaaatccaaactgt

SEQ ID NO: 6826 - DNA, 24 bp, synthetic construct
  misc_feature 1..24: note = Synthetic Construct
  source 1..24: mol_type = other DNA
ctccagtctcctctgaaacacact

SEQ ID NO: 6827 - DNA, 22 bp, synthetic construct
  misc_feature 1..22: note = Synthetic Construct
  source 1..22: mol_type = other DNA
ctgctactgcaaggggtgataa

SEQ ID NO: 6828 - DNA, 22 bp, synthetic construct
  misc_feature 1..22: note = Synthetic Construct
  source 1..22: mol_type = other DNA
agcagccggtttggattgtact

SEQ ID NO: 6829 - DNA, 22 bp, synthetic construct
  misc_feature 1..22: note = Synthetic Construct
  source 1..22: mol_type = other DNA
aatgaagccagtgttgctacct

SEQ ID NO: 6830 - DNA, 24 bp, synthetic construct
  misc_feature 1..24: note = Synthetic Construct
  source 1..24: mol_type = other DNA
cttcagaaccatttccctctctga

SEQ ID NO: 6831 - DNA, 22 bp, synthetic construct
  misc_feature 1..22: note = Synthetic Construct
  source 1..22: mol_type = other DNA
tcagctatgagtcggcccttct

SEQ ID NO: 6832 - DNA, 23 bp, synthetic construct
  misc_feature 1..23: note = Synthetic Construct
  source 1..23: mol_type = other DNA
gctgagtaggagctttctgtctt

SEQ ID NO: 6833 - DNA, 24 bp, synthetic construct
  misc_feature 1..24: note = Synthetic Construct
  source 1..24: mol_type = other DNA
cactccagaaccctgatgatacag

SEQ ID NO: 6834 - DNA, 23 bp, synthetic construct
  misc_feature 1..23: note = Synthetic Construct
  source 1..23: mol_type = other DNA
accctgactgcatttcccagaag

SEQ ID NO: 6835 - DNA, 26 bp, synthetic construct
  misc_feature 1..26: note = Synthetic Construct
  source 1..26: mol_type = other DNA
actcttaactctgaacgtgatggtaa

SEQ ID NO: 6836 - DNA, 21 bp, synthetic construct
  misc_feature 1..21: note = Synthetic Construct
  source 1..21: mol_type = other DNA
tgctgtcacgccatccttagg

SEQ ID NO: 6837 - DNA, 25 bp, synthetic construct
  misc_feature 1..25: note = Synthetic Construct
  source 1..25: mol_type = other DNA
caggacaggtctagattgcattagg

SEQ ID NO: 6838 - DNA, 22 bp, synthetic construct
  misc_feature 1..22: note = Synthetic Construct
  source 1..22: mol_type = other DNA
acagacatgaccagggacttca

SEQ ID NO: 6839 - DNA, 20 bp, synthetic construct
  misc_feature 1..20: note = Synthetic Construct
  source 1..20: mol_type = other DNA
agccattcagccccttttgt

SEQ ID NO: 6840 - DNA, 22 bp, synthetic construct
  misc_feature 1..22: note = Synthetic Construct
  source 1..22: mol_type = other DNA
tctaggggctcttccaatccat

SEQ ID NO: 6841 - DNA, 21 bp, synthetic construct
  misc_feature 1..21: note = Synthetic Construct
  source 1..21: mol_type = other DNA
gaaatggaggcccagagaaca

SEQ ID NO: 6842 - DNA, 24 bp, synthetic construct
  misc_feature 1..24: note = Synthetic Construct
  source 1..24: mol_type = other DNA
gggaagagagaagcacttggtcaa

SEQ ID NO: 6843 - DNA, 26 bp, synthetic construct
  misc_feature 1..26: note = Synthetic Construct
  source 1..26: mol_type = other DNA
actcactaagttacccctaccaaaga

SEQ ID NO: 6844 - DNA, 26 bp, synthetic construct
  misc_feature 1..26: note = Synthetic Construct
  source 1..26: mol_type = other DNA
gtgtaagagaggatgttggcactatc

SEQ ID NO: 6845 - DNA, 24 bp, synthetic construct
  misc_feature 1..24: note = Synthetic Construct
  source 1..24: mol_type = other DNA
cctcactcctgatctggtgaatgt

SEQ ID NO: 6846 - DNA, 24 bp, synthetic construct
  misc_feature 1..24: note = Synthetic Construct
  source 1..24: mol_type = other DNA
cccccaagttgtagcactctagtt

SEQ ID NO: 6847 - DNA, 22 bp, synthetic construct
  misc_feature 1..22: note = Synthetic Construct
  source 1..22: mol_type = other DNA
gcccaggaaaagaatggcatga

SEQ ID NO: 6848 - DNA, 22 bp, synthetic construct
  misc_feature 1..22: note = Synthetic Construct
  source 1..22: mol_type = other DNA
gggtctgggtggagaaaattca

SEQ ID NO: 6849 - DNA, 22 bp, synthetic construct
  misc_feature 1..22: note = Synthetic Construct
  source 1..22: mol_type = other DNA
acctcccagtagtgcttcagaa

SEQ ID NO: 6850 - DNA, 19 bp, synthetic construct
  misc_feature 1..19: note = Synthetic Construct
  source 1..19: mol_type = other DNA
agcccctgactggtggtta

SEQ ID NO: 6851 - DNA, 21 bp, synthetic construct
  misc_feature 1..21: note = Synthetic Construct
  source 1..21: mol_type = other DNA
ccaacctgctctcctgattcc

SEQ ID NO: 6852 - DNA, 19 bp, synthetic construct
  misc_feature 1..19: note = Synthetic Construct
  source 1..19: mol_type = other DNA
aggctcccgtctctgtcat

SEQ ID NO: 6853 - DNA, 21 bp, synthetic construct
  misc_feature 1..21: note = Synthetic Construct
  source 1..21: mol_type = other DNA
gctggcctgctctcattgact

SEQ ID NO: 6854 - DNA, 24 bp, synthetic construct
  misc_feature 1..24: note = Synthetic Construct
  source 1..24: mol_type = other DNA
agggtctgatttttcccagtatcc

SEQ ID NO: 6855 - DNA, 25 bp, synthetic construct
  misc_feature 1..25: note = Synthetic Construct
  source 1..25: mol_type = other DNA
ctgtaatgggtgtagatgtcagaca

SEQ ID NO: 6856 - DNA, 29 bp, synthetic construct
  misc_feature 1..29: note = Synthetic Construct
  source 1..29: mol_type = other DNA
gcattattttcctagtggcttttgttcct

SEQ ID NO: 6857 - DNA, 22 bp, synthetic construct
  misc_feature 1..22: note = Synthetic Construct
  source 1..22: mol_type = other DNA
gtctttcctagggactgcacaa

SEQ ID NO: 6858 - DNA, 19 bp, synthetic construct
  misc_feature 1..19: note = Synthetic Construct
  source 1..19: mol_type = other DNA
agccctggtggtgcctgta

SEQ ID NO: 6859 - DNA, 27 bp, synthetic construct
  misc_feature 1..27: note = Synthetic Construct
  source 1..27: mol_type = other DNA
tgacctactttacacataacagtccaa

SEQ ID NO: 6860 - DNA, 28 bp, synthetic construct
  misc_feature 1..28: note = Synthetic Construct
  source 1..28: mol_type = other DNA
cactaaaccctccaattagacagacttc

SEQ ID NO: 6861 - DNA, 20 bp, synthetic construct
  misc_feature 1..20: note = Synthetic Construct
  source 1..20: mol_type = other DNA
acagaccacctgctctgagt

SEQ ID NO: 6862 - DNA, 23 bp, synthetic construct
  misc_feature 1..23: note = Synthetic Construct
  source 1..23: mol_type = other DNA
ctccacagactgagagagctagt

SEQ ID NO: 6863 - DNA, 23 bp, synthetic construct
  misc_feature 1..23: note = Synthetic Construct
  source 1..23: mol_type = other DNA
agacgtggtaagtcccaggaagt

SEQ ID NO: 6864 - DNA, 18 bp, synthetic construct
  misc_feature 1..18: note = Synthetic Construct
  source 1..18: mol_type = other DNA
ggggcttcaggggggttt

SEQ ID NO: 6865 - DNA, 22 bp, synthetic construct
  misc_feature 1..22: note = Synthetic Construct
  source 1..22: mol_type = other DNA
acttgggcaaaatgcagtgatc

SEQ ID NO: 6866 - DNA, 27 bp, synthetic construct
  misc_feature 1..27: note = Synthetic Construct
  source 1..27: mol_type = other DNA
ctcattggtcaatctgaaatgggatac

SEQ ID NO: 6867 - DNA, 20 bp, synthetic construct
  misc_feature 1..20: note = Synthetic Construct
  source 1..20: mol_type = other DNA
acacgtgtgtcctgctttgt

SEQ ID NO: 6868 - DNA, 21 bp, synthetic construct
  misc_feature 1..21: note = Synthetic Construct
  source 1..21: mol_type = other DNA
ggcagatcctctccacctaga

SEQ ID NO: 6869 - DNA, 19 bp, synthetic construct
  misc_feature 1..19: note = Synthetic Construct
  source 1..19: mol_type = other DNA
tccctgccaacagcctcat

SEQ ID NO: 6870 - DNA, 24 bp, synthetic construct
  misc_feature 1..24: note = Synthetic Construct
  source 1..24: mol_type = other DNA
actcaaagcatagcctcctcattt

SEQ ID NO: 6871 - DNA, 23 bp, synthetic construct
  misc_feature 1..23: note = Synthetic Construct
  source 1..23: mol_type = other DNA
gaggaaggcaaagttctgttgct

SEQ ID NO: 6872 - DNA, 22 bp, synthetic construct
  misc_feature 1..22: note = Synthetic Construct
  source 1..22: mol_type = other DNA
gctttgtcctccacctcctaag

SEQ ID NO: 6873 - DNA, 24 bp, synthetic construct
  misc_feature 1..24: note = Synthetic Construct
  source 1..24: mol_type = other DNA
cccagatagctctccatcttctga

SEQ ID NO: 6874 - DNA, 21 bp, synthetic construct
  misc_feature 1..21: note = Synthetic Construct
  source 1..21: mol_type = other DNA
agtcgccatcctttcttgctt

SEQ ID NO: 6875 - DNA, 20 bp, synthetic construct
  misc_feature 1..20: note = Synthetic Construct
  source 1..20: mol_type = other DNA
tggctggagtgactgggatt

SEQ ID NO: 6876 - DNA, 22 bp, synthetic construct
  misc_feature 1..22: note = Synthetic Construct
  source 1..22: mol_type = other DNA
agcacatggggatgacatgtct

SEQ ID NO: 6877 - DNA, 24 bp, synthetic construct
  misc_feature 1..24: note = Synthetic Construct
  source 1..24: mol_type = other DNA
tgaatcaaatcttctggcgtagga

SEQ ID NO: 6878 - DNA, 22 bp, synthetic construct
  misc_feature 1..22: note = Synthetic Construct
  source 1..22: mol_type = other DNA
tctttcaccaaggggccaatca

SEQ ID NO: 6879 - DNA, 21 bp, synthetic construct
  misc_feature 1..21: note = Synthetic Construct
  source 1..21: mol_type = other DNA
tgccctgtgcaaaggaaacca

SEQ ID NO: 6880 - DNA, 20 bp, synthetic construct
  misc_feature 1..20: note = Synthetic Construct
  source 1..20: mol_type = other DNA
agggctctgatgcagcaaag

SEQ ID NO: 6881 - DNA, 26 bp, synthetic construct
  misc_feature 1..26: note = Synthetic Construct
  source 1..26: mol_type = other DNA
gccaatcacatgtggggagtattacc

SEQ ID NO: 6882 - DNA, 24 bp, synthetic construct
  misc_feature 1..24: note = Synthetic Construct
  source 1..24: mol_type = other DNA
ccaagttagctctagggcttagga

SEQ ID NO: 6883 - DNA, 22 bp, synthetic construct
  misc_feature 1..22: note = Synthetic Construct
  source 1..22: mol_type = other DNA
caggatgctggcagaaatatgc

SEQ ID NO: 6884 - DNA, 24 bp, synthetic construct
  misc_feature 1..24: note = Synthetic Construct
  source 1..24: mol_type = other DNA
agaagggttcaaggtccataaagg

SEQ ID NO: 6885 - DNA, 19 bp, synthetic construct
  misc_feature 1..19: note = Synthetic Construct
  source 1..19: mol_type = other DNA
gtgcacacccacccataca

SEQ ID NO: 6886 - DNA, 26 bp, synthetic construct
  misc_feature 1..26: note = Synthetic Construct
  source 1..26: mol_type = other DNA
accactgtcctagatcaatgagtttc

SEQ ID NO: 6887 - DNA, 22 bp, synthetic construct
  misc_feature 1..22: note = Synthetic Construct
  source 1..22: mol_type = other DNA
tgtcaaccaaggtgcattctgt

SEQ ID NO: 6888 - DNA, 25 bp, synthetic construct
  misc_feature 1..25: note = Synthetic Construct
  source 1..25: mol_type = other DNA
gcttgtggtttacaacattgtggtt

SEQ ID NO: 6889 - DNA, 26 bp, synthetic construct
  misc_feature 1..26: note = Synthetic Construct
  source 1..26: mol_type = other DNA
gtcaatatgcatgaccaggacctaga

SEQ ID NO: 6890 - DNA, 22 bp, synthetic construct
  misc_feature 1..22: note = Synthetic Construct
  source 1..22: mol_type = other DNA
ctgcaagccaccctctactaag

SEQ ID NO: 6891 - DNA, 21 bp, synthetic construct
  misc_feature 1..21: note = Synthetic Construct
  source 1..21: mol_type = other DNA
ccagccttcccttacctgtct

SEQ ID NO: 6892 - DNA, 24 bp, synthetic construct
  misc_feature 1..24: note = Synthetic Construct
  source 1..24: mol_type = other DNA
caaatacaacccctagagccacat

SEQ ID NO: 6893 - DNA, 24 bp, synthetic construct
  misc_feature 1..24: note = Synthetic Construct
  source 1..24: mol_type = other DNA
gccacgctgagtaattatgccatt

SEQ ID NO: 6894 - DNA, 18 bp, synthetic construct
  misc_feature 1..18: note = Synthetic Construct
  source 1..18: mol_type = other DNA
agcctcgcacgccaacga

SEQ ID NO: 6895 - DNA, 22 bp, synthetic construct
  misc_feature 1..22: note = Synthetic Construct
  source 1..22: mol_type = other DNA
tgagacctggaagacgagaaga

SEQ ID NO: 6896 - DNA, 23 bp, synthetic construct
  misc_feature 1..23: note = Synthetic Construct
  source 1..23: mol_type = other DNA
gcaatttgggaattgggctccat

SEQ ID NO: 6897 - DNA, 27 bp, synthetic construct
  misc_feature 1..27: note = Synthetic Construct
  source 1..27: mol_type = other DNA
acatagtcactcatttgacaagtgttc

SEQ ID NO: 6898 - DNA, 21 bp, synthetic construct
  misc_feature 1..21: note = Synthetic Construct
  source 1..21: mol_type = other DNA
gctgggcaacaggactgtagt

SEQ ID NO: 6899 - DNA, 21 bp, synthetic construct
  misc_feature 1..21: note = Synthetic Construct
  source 1..21: mol_type = other DNA
tgactgctaccaaggctgaga

SEQ ID NO: 6900 - DNA, 24 bp, synthetic construct
  misc_feature 1..24: note = Synthetic Construct
  source 1..24: mol_type = other DNA
tgcaacccttgggtcagaatatcc

SEQ ID NO: 6901 - DNA, 19 bp, synthetic construct
  misc_feature 1..19: note = Synthetic Construct
  source 1..19: mol_type = other DNA
cccctgcttcccactgagt

SEQ ID NO: 6902 - DNA, 24 bp, synthetic construct
  misc_feature 1..24: note = Synthetic Construct
  source 1..24: mol_type = other DNA
gaagttaagagagggggcttcatt

SEQ ID NO: 6903 - DNA, 23 bp, synthetic construct
  misc_feature 1..23: note = Synthetic Construct
  source 1..23: mol_type = other DNA
gatgaaggaagcgatgaggtgtt

SEQ ID NO: 6904 - DNA, 22 bp, synthetic construct
  misc_feature 1..22: note = Synthetic Construct
  source 1..22: mol_type = other DNA
aggacagtggcaagctcagatt

SEQ ID NO: 6905 - DNA, 22 bp, synthetic construct
  misc_feature 1..22: note = Synthetic Construct
  source 1..22: mol_type = other DNA
acggataatggatcgcctgctt

SEQ ID NO: 6906 - DNA, 24 bp, synthetic construct
  misc_feature 1..24: note = Synthetic Construct
  source 1..24: mol_type = other DNA
gggttggttcagcattccattagg

SEQ ID NO: 6907 - DNA, 23 bp, synthetic construct
  misc_feature 1..23: note = Synthetic Construct
  source 1..23: mol_type = other DNA
gccttttgttctgggccaataag

SEQ ID NO: 6908 - DNA, 24 bp, synthetic construct
  misc_feature 1..24: note = Synthetic Construct
  source 1..24: mol_type = other DNA
ggatgtgatagctggatcctgaag

SEQ ID NO: 6909 - DNA, 26 bp, synthetic construct
  misc_feature 1..26: note = Synthetic Construct
  source 1..26: mol_type = other DNA
ctcataaagtaagacacaccgtacca

SEQ ID NO: 6910 - DNA, 20 bp, synthetic construct
  misc_feature 1..20: note = Synthetic Construct
  source 1..20: mol_type = other DNA
accacacttgagcccttgag

SEQ ID NO: 6911 - DNA, 27 bp, synthetic construct
  misc_feature 1..27: note = Synthetic Construct
  source 1..27: mol_type = other DNA
agacctagaagtgatctagtggaatga

SEQ ID NO: 6912 - DNA, 25 bp, synthetic construct
  misc_feature 1..25: note = Synthetic Construct
  source 1..25: mol_type = other DNA
gtgttatgtgtcaagccttctgttc

SEQ ID NO: 6913 - DNA, 23 bp, synthetic construct
  misc_feature 1..23: note = Synthetic Construct
  source 1..23: mol_type = other DNA
ggttgccaaaatgtcagccttaa

SEQ ID NO: 6914 - DNA, 22 bp, synthetic construct
  misc_feature 1..22: note = Synthetic Construct
  source 1..22: mol_type = other DNA
gctgttttgtctgtcgctgaac

SEQ ID NO: 6915 - DNA, 22 bp, synthetic construct
  misc_feature 1..22: note = Synthetic Construct
  source 1..22: mol_type = other DNA
acctctgggaaatgggtcttca

SEQ ID NO: 6916 - DNA, 25 bp, synthetic construct
  misc_feature 1..25: note = Synthetic Construct
  source 1..25: mol_type = other DNA
ctactaagtgctcagaccatttgga

SEQ ID NO: 6917 - DNA, 20 bp, synthetic construct
  misc_feature 1..20: note = Synthetic Construct
  source 1..20: mol_type = other DNA
cctcctccctccggaatcct

SEQ ID NO: 6918 - DNA, 24 bp, synthetic construct
  misc_feature 1..24: note = Synthetic Construct
  source 1..24: mol_type = other DNA
agagaacactctgagagcttgatg

SEQ ID NO: 6919 - DNA, 23 bp, synthetic construct
  misc_feature 1..23: note = Synthetic Construct
  source 1..23: mol_type = other DNA
cagagaacattctgccactctct

SEQ ID NO: 6920 - DNA, 22 bp, synthetic construct
  misc_feature 1..22: note = Synthetic Construct
  source 1..22: mol_type = other DNA
acagtagcctgttcctcttcca

SEQ ID NO: 6921 - DNA, 23 bp, synthetic construct
  misc_feature 1..23: note = Synthetic Construct
  source 1..23: mol_type = other DNA
ggcctgtagttccagcttattgg

SEQ ID NO: 6922 - DNA, 22 bp, synthetic construct
  misc_feature 1..22: note = Synthetic Construct
  source 1..22: mol_type = other DNA
cccctggctgactatttgaact

SEQ ID NO: 6923 - DNA, 24 bp, synthetic construct
  misc_feature 1..24: note = Synthetic Construct
  source 1..24: mol_type = other DNA
gactttatgttgggggaggaagaa

SEQ ID NO: 6924 - DNA, 20 bp, synthetic construct
  misc_feature 1..20: note = Synthetic Construct
  source 1..20: mol_type = other DNA
ttgcccctcctggtgagttt

SEQ ID NO: 6925 - DNA, 26 bp, synthetic construct
  misc_feature 1..26: note = Synthetic Construct
  source 1..26: mol_type = other DNA
agatggaggtctgaaacataaacagt

SEQ ID NO: 6926 - DNA, 25 bp, synthetic construct
  misc_feature 1..25: note = Synthetic Construct
  source 1..25: mol_type = other DNA
gcccatgatttcttccatggggaaa

SEQ ID NO: 6927 - DNA, 22 bp, synthetic construct
  misc_feature 1..22: note = Synthetic Construct
  source 1..22: mol_type = other DNA
tcctgaacacacctggcctgta

SEQ ID NO: 6928 - DNA, 19 bp, synthetic construct
  misc_feature 1..19: note = Synthetic Construct
  source 1..19: mol_type = other DNA
ccagctgccacagaactga

SEQ ID NO: 6929 - DNA, 20 bp, synthetic construct
  misc_feature 1..20: note = Synthetic Construct
  source 1..20: mol_type = other DNA
acgagcctgcctttttcagt

SEQ ID NO: 6930 - DNA, 20 bp, synthetic construct
  misc_feature 1..20: note = Synthetic Construct
  source 1..20: mol_type = other DNA
tgacattgggcaaggcatca

SEQ ID NO: 6931 - DNA, 27 bp, synthetic construct
  misc_feature 1..27: note = Synthetic Construct
  source 1..27: mol_type = other DNA
gctgtataaagttgatctcagcttgtg

SEQ ID NO: 6932 - DNA, 20 bp, synthetic construct
  misc_feature 1..20: note = Synthetic Construct
  source 1..20: mol_type = other DNA
aggtgctgttcctgcttctg

SEQ ID NO: 6933 - DNA, 20 bp, synthetic construct
  misc_feature 1..20: note = Synthetic Construct
  source 1..20: mol_type = other DNA
acctgcccctaaagcctcat

SEQ ID NO: 6934 - DNA, 23 bp, synthetic construct
  misc_feature 1..23: note = Synthetic Construct
  source 1..23: mol_type = other DNA
tgccagaggtggagatacatcca

SEQ ID NO: 6935 - DNA, 25 bp, synthetic construct
  misc_feature 1..25: note = Synthetic Construct
  source 1..25: mol_type = other DNA
caatactgactttctgtcccactgt

SEQ ID NO: 6936 - DNA, 23 bp, synthetic construct
  misc_feature 1..23: note = Synthetic Construct
  source 1..23: mol_type = other DNA
cttcagaggagcaagtcacttgt

SEQ ID NO: 6937 - DNA, 22 bp, synthetic construct
  misc_feature 1..22: note = Synthetic Construct
  source 1..22: mol_type = other DNA
ccacaccaccctgaagtcatct

SEQ ID NO: 6938 - DNA, 22 bp, synthetic construct
  misc_feature 1..22: note = Synthetic Construct
  source 1..22: mol_type = other DNA
cccactctgctccattgacaag

SEQ ID NO: 6939 - DNA, 27 bp, synthetic construct
  misc_feature 1..27: note = Synthetic Construct
  source 1..27: mol_type = other DNA
gctctcactaaagtaccaacaactgat

SEQ ID NO: 6940 - DNA, 26 bp, synthetic construct
  misc_feature 1..26: note = Synthetic Construct
  source 1..26: mol_type = other DNA
agtcaactttacatagctgctagaca

SEQ ID NO: 6941 - DNA, 22 bp, synthetic construct
  misc_feature 1..22: note = Synthetic Construct
  source 1..22: mol_type = other DNA
gcattgacctgatggcagaagt

SEQ ID NO: 6942 - DNA, 24 bp, synthetic construct
  misc_feature 1..24: note = Synthetic Construct
  source 1..24: mol_type = other DNA
tgggggcttgaaagaggtactatc

SEQ ID NO: 6943 - DNA, 27 bp, synthetic construct
  misc_feature 1..27: note = Synthetic Construct
  source 1..27: mol_type = other DNA
ccccttcttagcttgatcatctgcttt

SEQ ID NO: 6944 - DNA, 22 bp, synthetic construct
  misc_feature 1..22: note = Synthetic Construct
  source 1..22: mol_type = other DNA
cctcaggctgtcttgctaggat

SEQ ID NO: 6945 - DNA, 26 bp, synthetic construct
  misc_feature 1..26: note = Synthetic Construct
  source 1..26: mol_type = other DNA
gatagggtttctccaaggattcttga

SEQ ID NO: 6946 - DNA, 22 bp, synthetic construct
  misc_feature 1..22: note = Synthetic Construct
  source 1..22: mol_type = other DNA
tgagaggcattgggagatagca

SEQ ID NO: 6947 - DNA, 25 bp, synthetic construct
  misc_feature 1..25: note = Synthetic Construct
  source 1..25: mol_type = other DNA
caaaagaattcccagcagcaaagaa

SEQ ID NO: 6948 - DNA, 27 bp, synthetic construct
  misc_feature 1..27: note = Synthetic Construct
  source 1..27: mol_type = other DNA
gcgacacaaaatttttcaagtgtgtgt

SEQ ID NO: 6949 - DNA, 28 bp, synthetic construct
  misc_feature 1..28: note = Synthetic Construct
  source 1..28: mol_type = other DNA
gcttgaagtaatgaaatttgtgcttgga

SEQ ID NO: 6950 - DNA, 23 bp, synthetic construct
  misc_feature 1..23: note = Synthetic Construct
  source 1..23: mol_type = other DNA
actcaaccacaactgcctttagt

SEQ ID NO: 6951 - DNA, 20 bp, synthetic construct
  misc_feature 1..20: note = Synthetic Construct
  source 1..20: mol_type = other DNA
ttgccagcccagcatctatg

SEQ ID NO: 6952 - DNA, 24 bp, synthetic construct
  misc_feature 1..24: note = Synthetic Construct
  source 1..24: mol_type = other DNA
ggctggctttgtaatgaccatagt

SEQ ID NO: 6953 - DNA, 25 bp, synthetic construct
  misc_feature 1..25: note = Synthetic Construct
  source 1..25: mol_type = other DNA
aaggcagaggtagagtaaagaactg

SEQ ID NO: 6954 - DNA, 25 bp, synthetic construct
  misc_feature 1..25: note = Synthetic Construct
  source 1..25: mol_type = other DNA
ccactaaactgaggtttggcacaga

SEQ ID NO: 6955 - DNA, 24 bp, synthetic construct
  misc_feature 1..24: note = Synthetic Construct
  source 1..24: mol_type = other DNA
gtgaaatgtagccttttgcccttt

SEQ ID NO: 6956 - DNA, 23 bp, synthetic construct
  misc_feature 1..23: note = Synthetic Construct
  source 1..23: mol_type = other DNA
aatcctacctgcaaaaccaagga

SEQ ID NO: 6957 - DNA, 24 bp, synthetic construct
  misc_feature 1..24: note = Synthetic Construct
  source 1..24: mol_type = other DNA
ccaactaatcagccttttgcacat

SEQ ID NO: 6958 - DNA, 21 bp, synthetic construct
  misc_feature 1..21: note = Synthetic Construct
  source 1..21: mol_type = other DNA
ggtgaggcttagaacgttgga

SEQ ID NO: 6959 - DNA, 22 bp, synthetic construct
  misc_feature 1..22: note = Synthetic Construct
  source 1..22: mol_type = other DNA
catggtcctggtgactctttgg

SEQ ID NO: 6960 - DNA, 23 bp, synthetic construct
  misc_feature 1..23: note = Synthetic Construct
  source 1..23: mol_type = other DNA
aggaatggtgaagtacccaatgg

SEQ ID NO: 6961 - DNA, 25 bp, synthetic construct
  misc_feature 1..25: note = Synthetic Construct
  source 1..25: mol_type = other DNA
ccttcctttcttgggattgcttgtc

SEQ ID NO: 6962 - DNA, 22 bp, synthetic construct
  misc_feature 1..22: note = Synthetic Construct
  source 1..22: mol_type = other DNA
agagtccatccaggcagagaga

SEQ ID NO: 6963 - DNA, 24 bp, synthetic construct
  misc_feature 1..24: note = Synthetic Construct
  source 1..24: mol_type = other DNA
ctcagtgcaagacaactctaaagc

SEQ ID NO: 6964 - DNA, 26 bp, synthetic construct
  misc_feature 1..26: note = Synthetic Construct
  source 1..26: mol_type = other DNA
ccctggatctatttcccacaaaactc

SEQ ID NO: 6965 - DNA, 21 bp, synthetic construct
  misc_feature 1..21: note = Synthetic Construct
  source 1..21: mol_type = other DNA
tgcctcgcccaacaattccaa

SEQ ID NO: 6966 - DNA, 26 bp, synthetic construct
  misc_feature 1..26: note = Synthetic Construct
  source 1..26: mol_type = other DNA
ccgtgtttaggtattcttccttccat

SEQ ID NO: 6967 - DNA, 22 bp, synthetic construct
  misc_feature 1..22: note = Synthetic Construct
  source 1..22: mol_type = other DNA
aagcaaacctggaggaccatac

SEQ ID NO: 6968 - DNA, 22 bp, synthetic construct
  misc_feature 1..22: note = Synthetic Construct
  source 1..22: mol_type = other DNA
ctgctgctgggaattctacaca

SEQ ID NO: 6969 - DNA, 18 bp, synthetic construct
  misc_feature 1..18: note = Synthetic Construct
  source 1..18: mol_type = other DNA
tcctgggcgctctgtgat

SEQ ID NO: 6970 - DNA, 25 bp, synthetic construct
  misc_feature 1..25: note = Synthetic Construct
  source 1..25: mol_type = other DNA
cttttgatctaaactcggcccatac

SEQ ID NO: 6971 - DNA, 29 bp, synthetic construct
  misc_feature 1..29: note = Synthetic Construct
  source 1..29: mol_type = other DNA
cctctgcactaaatcaaatgtgtcttgtc

SEQ ID NO: 6972 - DNA, 23 bp, synthetic construct
  misc_feature 1..23: note = Synthetic Construct
  source 1..23: mol_type = other DNA
agccaggactgtagaaccaggat

SEQ ID NO: 6973 - DNA, 21 bp, synthetic construct
  misc_feature 1..21: note = Synthetic Construct
  source 1..21: mol_type = other DNA
tgctcttctttctgccccaaa

SEQ ID NO: 6974 - DNA, 21 bp, synthetic construct
  misc_feature 1..21: note = Synthetic Construct
  source 1..21: mol_type = other DNA
tgcaggtgccttggatgtctt

SEQ ID NO: 6975 - DNA, 18 bp, synthetic construct
  misc_feature 1..18: note = Synthetic Construct
  source 1..18: mol_type = other DNA
tgccaccctcccaatggt

SEQ ID NO: 6976 - DNA, 23 bp, synthetic construct
  misc_feature 1..23: note = Synthetic Construct
  source 1..23: mol_type = other DNA
agcatctctctcaaggacctgaa

SEQ ID NO: 6977 - DNA, 22 bp, synthetic construct
  misc_feature 1..22: note = Synthetic Construct
  source 1..22: mol_type = other DNA
ggtgtggctgcaactatagaca

SEQ ID NO: 6978 - DNA, 22 bp, synthetic construct
  misc_feature 1..22: note = Synthetic Construct
  source 1..22: mol_type = other DNA
cagaacaaccgacctccatctt

SEQ ID NO: 6979 - DNA, 20 bp, synthetic construct
  misc_feature 1..20: note = Synthetic Construct
  source 1..20: mol_type = other DNA
agccagccaggtgagacaga

SEQ ID NO: 6980 - DNA, 22 bp, synthetic construct
  misc_feature 1..22: note = Synthetic Construct
  source 1..22: mol_type = other DNA
gccagagcttggggtaatcact

SEQ ID NO: 6981 - DNA, 19 bp, synthetic construct
  misc_feature 1..19: note = Synthetic Construct
  source 1..19: mol_type = other DNA
agccagctgcagttccaaa

SEQ ID NO: 6982 - DNA, 23 bp, synthetic construct
  misc_feature 1..23: note = Synthetic Construct
  source 1..23: mol_type = other DNA
ggagacccaaactgttgcaattc

SEQ ID NO: 6983 - DNA, 21 bp, synthetic construct
  misc_feature 1..21: note = Synthetic Construct
  source 1..21: mol_type = other DNA
acagccagtcgaatggaagca

SEQ ID NO: 6984 - DNA, 24 bp, synthetic construct
  misc_feature 1..24: note = Synthetic Construct
  source 1..24: mol_type = other DNA
tgggctttagggactctactctct

SEQ ID NO: 6985 - DNA, 25 bp, synthetic construct
  misc_feature 1..25: note = Synthetic Construct
  source 1..25: mol_type = other DNA
tcctaccccataggatcaagatggt

SEQ ID NO: 6986 - DNA, 23 bp, synthetic construct
  misc_feature 1..23: note = Synthetic Construct
  source 1..23: mol_type = other DNA
ctcactgaacaatgggggagaaa

SEQ ID NO: 6987 - DNA, 22 bp, synthetic construct
  misc_feature 1..22: note = Synthetic Construct
  source 1..22: mol_type = other DNA
tctggagttcagcctagacagt

SEQ ID NO: 6988 - DNA, 22 bp, synthetic construct
  misc_feature 1..22: note = Synthetic Construct
  source 1..22: mol_type = other DNA
tctaacaccggcaggtcactct

SEQ ID NO: 6989 - DNA, 20 bp, synthetic construct
  misc_feature 1..20: note = Synthetic Construct
  source 1..20: mol_type = other DNA
agtggggctgtcaggaaaac

SEQ ID NO: 6990 - DNA, 19 bp, synthetic construct
  misc_feature 1..19: note = Synthetic Construct
  source 1..19: mol_type = other DNA
gccccaggtgtcagaagca

SEQ ID NO: 6991 - DNA, 23 bp, synthetic construct
  misc_feature 1..23: note = Synthetic Construct
  source 1..23: mol_type = other DNA
tctgcagaatatgggcactaagg

SEQ ID NO: 6992 - DNA, 22 bp, synthetic construct
  misc_feature 1..22: note = Synthetic Construct
  source 1..22: mol_type = other DNA
accttgcccaaagccatacatc

SEQ ID NO: 6993 - DNA, 21 bp, synthetic construct
  misc_feature 1..21: note = Synthetic Construct
  source 1..21: mol_type = other DNA
aagcccagaaagccttcttgt

SEQ ID NO: 6994 - DNA, 26 bp, synthetic construct
  misc_feature 1..26: note = Synthetic Construct
  source 1..26: mol_type = other DNA
gacctcaaatagtcttggtcattgtg

SEQ ID NO: 6995 - DNA, 21 bp, synthetic construct
  misc_feature 1..21: note = Synthetic Construct
  source 1..21: mol_type = other DNA
cccctgggagaggtcttgaac

SEQ ID NO: 6996 - DNA, 23 bp, synthetic construct
  misc_feature 1..23: note = Synthetic Construct
  source 1..23: mol_type = other DNA
ctgtcctcactacaacccagttt

SEQ ID NO: 6997 - DNA, 26 bp, synthetic construct
  misc_feature 1..26: note = Synthetic Construct
  source 1..26: mol_type = other DNA
gcctttgcctttgaactgtagccata

SEQ ID NO: 6998 - DNA, 21 bp, synthetic construct
  misc_feature 1..21: note = Synthetic Construct
  source 1..21: mol_type = other DNA
gcctgagaaactcgtgatgca

SEQ ID NO: 6999 - DNA, 25 bp, synthetic construct
  misc_feature 1..25: note = Synthetic Construct
  source 1..25: mol_type = other DNA
ccaagtatgccatagtctgttttgg

SEQ ID NO: 7000 - DNA, 23 bp, synthetic construct
  misc_feature 1..23: note = Synthetic Construct
  source 1..23: mol_type = other DNA
caagggctgcaaaagtaactgtt

SEQ ID NO: 7001 - DNA, 21 bp, synthetic construct
  misc_feature 1..21: note = Synthetic Construct
  source 1..21: mol_type = other DNA
aggcagatgctcagaggcatt

SEQ ID NO: 7002 - DNA, 25 bp, synthetic construct
  misc_feature 1..25: note = Synthetic Construct
  source 1..25: mol_type = other DNA
ctgaatgaaacccaactctgacaca

SEQ ID NO: 7003 - DNA, 25 bp, synthetic construct
  misc_feature 1..25: note = Synthetic Construct
  source 1..25: mol_type = other DNA
gaccacaaagtgctgtgtgttattc

SEQ ID NO: 7004 - DNA, 22 bp, synthetic construct
  misc_feature 1..22: note = Synthetic Construct
  source 1..22: mol_type = other DNA
ttcctgcctttcctccagttgt

SEQ ID NO: 7005 - DNA, 23 bp, synthetic construct
  misc_feature 1..23: note = Synthetic Construct
  source 1..23: mol_type = other DNA
gcaatgaagagactcccgtatga

SEQ ID NO: 7006 - DNA, 26 bp, synthetic construct
  misc_feature 1..26: note = Synthetic Construct
  source 1..26: mol_type = other DNA
gaagtcactgtagctagaaagtgtga

SEQ ID NO: 7007 - DNA, 20 bp, synthetic construct
  misc_feature 1..20: note = Synthetic Construct
  source 1..20: mol_type = other DNA
tgccctccctcctgagacaa

SEQ ID NO: 7008 - DNA, 26 bp, synthetic construct
  misc_feature 1..26: note = Synthetic Construct
  source 1..26: mol_type = other DNA
cattaaaacagttggcttccctgtat

SEQ ID NO: 7009 - DNA, 22 bp, synthetic construct
  misc_feature 1..22: note = Synthetic Construct
  source 1..22: mol_type = other DNA
acttcacaccgctctgcactaa

SEQ ID NO: 7010 - DNA, 22 bp, synthetic construct
  misc_feature 1..22: note = Synthetic Construct
  source 1..22: mol_type = other DNA
tgagagagtggagggagtttgg

SEQ ID NO: 7011 - DNA, 28 bp, synthetic construct
  misc_feature 1..28: note = Synthetic Construct
  source 1..28: mol_type = other DNA
ggtttgtaaatttctgaaggcagtggtt

SEQ ID NO: 7012 - DNA, 22 bp, synthetic construct
  misc_feature 1..22: note = Synthetic Construct
  source 1..22: mol_type = other DNA
agattcctcccttgccatcact

SEQ ID NO: 7013 - DNA, 20 bp, synthetic construct
  misc_feature 1..20: note = Synthetic Construct
  source 1..20: mol_type = other DNA
ggagcaactgatggcagcaa

SEQ ID NO: 7014 - DNA, 21 bp, synthetic construct
  misc_feature 1..21: note = Synthetic Construct
  source 1..21: mol_type = other DNA
agtgctctgtgcccacaacta

SEQ ID NO: 7015 - DNA, 22 bp, synthetic construct
  misc_feature 1..22: note = Synthetic Construct
  source 1..22: mol_type = other DNA
tgccaagtagggaggtgtgaga

SEQ ID NO: 7016 - DNA, 22 bp, synthetic construct
  misc_feature 1..22: note = Synthetic Construct
  source 1..22: mol_type = other DNA
catcctgcctgcgtaactactt

SEQ ID NO: 7017 - DNA, 23 bp, synthetic construct
  misc_feature 1..23: note = Synthetic Construct
  source 1..23: mol_type = other DNA
ctcaactcctcgtggcagtgact

SEQ ID NO: 7018 - DNA, 25 bp, synthetic construct
  misc_feature 1..25: note = Synthetic Construct
  source 1..25: mol_type = other DNA
cccaggaattcatcacaaaactgtt

SEQ ID NO: 7019 - DNA, 18 bp, synthetic construct
  misc_feature 1..18: note = Synthetic Construct
  source 1..18: mol_type = other DNA
tgcttccttgcgcacaca

SEQ ID NO: 7020 - DNA, 24 bp, synthetic construct
  misc_feature 1..24: note = Synthetic Construct
  source 1..24: mol_type = other DNA
ctgtctcttggctgttcgtttcct

SEQ ID NO: 7021 - DNA, 25 bp, synthetic construct
  misc_feature 1..25: note = Synthetic Construct
  source 1..25: mol_type = other DNA
cacggaaaagcaaaagctgataacg

SEQ ID NO: 7022 - DNA, 27 bp, synthetic construct
  misc_feature 1..27: note = Synthetic Construct
  source 1..27: mol_type = other DNA
aaagcaaaactactcctccatttacac

SEQ ID NO: 7023 - DNA, 20 bp, synthetic construct
  misc_feature 1..20: note = Synthetic Construct
  source 1..20: mol_type = other DNA
ttgccttcctcagcccttct

SEQ ID NO: 7024 - DNA, 25 bp, synthetic construct
  misc_feature 1..25: note = Synthetic Construct
  source 1..25: mol_type = other DNA
ggtcctcttagaagtcacctttctg

SEQ ID NO: 7025 - DNA, 21 bp, synthetic construct
  misc_feature 1..21: note = Synthetic Construct
  source 1..21: mol_type = other DNA
actgcagcatggctttccatt

SEQ ID NO: 7026 - DNA, 24 bp, synthetic construct
  misc_feature 1..24: note = Synthetic Construct
  source 1..24: mol_type = other DNA
tgggaacactctggcatacattgc

SEQ ID NO: 7027 - DNA, 23 bp, synthetic construct
  misc_feature 1..23: note = Synthetic Construct
  source 1..23: mol_type = other DNA
tttgaacagggcatagtgcagat

SEQ ID NO: 7028 - DNA, 25 bp, synthetic construct
  misc_feature 1..25: note = Synthetic Construct
  source 1..25: mol_type = other DNA
gctacaagctctactccactcagat

SEQ ID NO: 7029 - DNA, 20 bp, synthetic construct
  misc_feature 1..20: note = Synthetic Construct
  source 1..20: mol_type = other DNA
tgttaccccctggacattgc

SEQ ID NO: 7030 - DNA, 19 bp, synthetic construct
  misc_feature 1..19: note = Synthetic Construct
  source 1..19: mol_type = other DNA
cccagcctccttccacact

SEQ ID NO: 7031 - DNA, 23 bp, synthetic construct
  misc_feature 1..23: note = Synthetic Construct
  source 1..23: mol_type = other DNA
cataccctcttgtcccagcatac

SEQ ID NO: 7032 - DNA, 24 bp, synthetic construct
  misc_feature 1..24: note = Synthetic Construct
  source 1..24: mol_type = other DNA
acctacaggttcttcccctacatg

SEQ ID NO: 7033 - DNA, 22 bp, synthetic construct
  misc_feature 1..22: note = Synthetic Construct
  source 1..22: mol_type = other DNA
agctgggtgggaacttattctg

SEQ ID NO: 7034 - DNA, 21 bp, synthetic construct
  misc_feature 1..21: note = Synthetic Construct
  source 1..21: mol_type = other DNA
cattgccctgcttgcaagtag

SEQ ID NO: 7035 - DNA, 26 bp, synthetic construct
  misc_feature 1..26: note = Synthetic Construct
  source 1..26: mol_type = other DNA
aaggcttcaaagaagaactagaacct

SEQ ID NO: 7036 - DNA, 22 bp, synthetic construct
  misc_feature 1..22: note = Synthetic Construct
  source 1..22: mol_type = other DNA
gcggtagggctgagaaaatcca

SEQ ID NO: 7037 - DNA, 24 bp, synthetic construct
  misc_feature 1..24: note = Synthetic Construct
  source 1..24: mol_type = other DNA
acattacggcatcatagctttcct

SEQ ID NO: 7038 - DNA, 25 bp, synthetic construct
  misc_feature 1..25: note = Synthetic Construct
  source 1..25: mol_type = other DNA
gcatacctcattcccctttttgaag

SEQ ID NO: 7039 - DNA, 22 bp, synthetic construct
  misc_feature 1..22: note = Synthetic Construct
  source 1..22: mol_type = other DNA
atgtctggtctccctcctttct

SEQ ID NO: 7040 - DNA, 20 bp, synthetic construct
  misc_feature 1..20: note = Synthetic Construct
  source 1..20: mol_type = other DNA
tctcctccagccacactgaa

SEQ ID NO: 7041 - DNA, 25 bp, synthetic construct
  misc_feature 1..25: note = Synthetic Construct
  source 1..25: mol_type = other DNA
gagtctcgatccacaaaagctatcc

SEQ ID NO: 7042 - DNA, 27 bp, synthetic construct
  misc_feature 1..27: note = Synthetic Construct
  source 1..27: mol_type = other DNA
ccataataggttttttggtgcctacag

SEQ ID NO: 7043 - DNA, 23 bp, synthetic construct
  misc_feature 1..23: note = Synthetic Construct
  source 1..23: mol_type = other DNA
cgtaggtgacacacattcatcca

SEQ ID NO: 7044 - DNA, 25 bp, synthetic construct
  misc_feature 1..25: note = Synthetic Construct
  source 1..25: mol_type = other DNA
gcacgcctcacactttactaatagg

SEQ ID NO: 7045 - DNA, 25 bp, synthetic construct
  misc_feature 1..25: note = Synthetic Construct
  source 1..25: mol_type = other DNA
agggaagctgtgtcttagacttact

SEQ ID NO: 7046 - DNA, 23 bp, synthetic construct
  misc_feature 1..23: note = Synthetic Construct
  source 1..23: mol_type = other DNA
tcctgatgacctgctgattgaag

SEQ ID NO: 7047 - DNA, 20 bp, synthetic construct
  misc_feature 1..20: note = Synthetic Construct
  source 1..20: mol_type = other DNA
agtggttggcagcaggtaac

SEQ ID NO: 7048 - DNA, 26 bp, synthetic construct
  misc_feature 1..26: note = Synthetic Construct
  source 1..26: mol_type = other DNA
actaccccaggaagattagaatgtgt

SEQ ID NO: 7049 - DNA, 22 bp, synthetic construct
  misc_feature 1..22: note = Synthetic Construct
  source 1..22: mol_type = other DNA
agaaagcggcaatgctgagatg

SEQ ID NO: 7050 - DNA, 21 bp, synthetic construct
  misc_feature 1..21: note = Synthetic Construct
  source 1..21: mol_type = other DNA
gctgcccgagaaaacttagct

SEQ ID NO: 7051 - DNA, 28 bp, synthetic construct
  misc_feature 1..28: note = Synthetic Construct
  source 1..28: mol_type = other DNA
aacacaattctgaaatccatctatgcat

SEQ ID NO: 7052 - DNA, 26 bp, synthetic construct
  misc_feature 1..26: note = Synthetic Construct
  source 1..26: mol_type = other DNA
tcaataaagtccccccttacctaact

SEQ ID NO: 7053 - DNA, 22 bp, synthetic construct
  misc_feature 1..22: note = Synthetic Construct
  source 1..22: mol_type = other DNA
tccctgaacaggctgtgcataa

SEQ ID NO: 7054 - DNA, 22 bp, synthetic construct
  misc_feature 1..22: note = Synthetic Construct
  source 1..22: mol_type = other DNA
gccttccatcactctaccacaa

SEQ ID NO: 7055 - DNA, 25 bp, synthetic construct
  misc_feature 1..25: note = Synthetic Construct
  source 1..25: mol_type = other DNA
aagtcaaggcaattgatgaaacaca

SEQ ID NO: 7056 - DNA, 22 bp, synthetic construct
  misc_feature 1..22: note = Synthetic Construct
  source 1..22: mol_type = other DNA
tgcaacatgcacactcttttgc

SEQ ID NO: 7057 - DNA, 22 bp, synthetic construct
  misc_feature 1..22: note = Synthetic Construct
  source 1..22: mol_type = other DNA
gtaatgagggcctgctttagct

SEQ ID NO: 7058 - DNA, 24 bp, synthetic construct
  misc_feature 1..24: note = Synthetic Construct
  source 1..24: mol_type = other DNA
tggatacaaaactcttggctggaa

SEQ ID NO: 7059 - DNA, 24 bp, synthetic construct
  misc_feature 1..24: note = Synthetic Construct
  source 1..24: mol_type = other DNA
gaagcttaagtgccatccttgtct

SEQ ID NO: 7060 - DNA, 22 bp, synthetic construct
  misc_feature 1..22: note = Synthetic Construct
  source 1..22: mol_type = other DNA
ggggcagaagatggaagacttc

SEQ ID NO: 7061 - DNA, 21 bp, synthetic construct
  misc_feature 1..21: note = Synthetic Construct
  source 1..21: mol_type = other DNA
agcccagtgaagcaggaaatg

SEQ ID NO: 7062 - DNA, 27 bp, synthetic construct
  misc_feature 1..27: note = Synthetic Construct
  source 1..27: mol_type = other DNA
gagtttgacaaataattggaggagctt

SEQ ID NO: 7063 - DNA, 27 bp, synthetic construct
  misc_feature 1..27: note = Synthetic Construct
  source 1..27: mol_type = other DNA
aggcaaaggtttgtaggtatgtagatc

SEQ ID NO: 7064 - DNA, 24 bp, synthetic construct
  misc_feature 1..24: note = Synthetic Construct
  source 1..24: mol_type = other DNA
ggactaaactccacgaagaacaca

SEQ ID NO: 7065 - DNA, 19 bp, synthetic construct
  misc_feature 1..19: note = Synthetic Construct
  source 1..19: mol_type = other DNA
acgggactcccagcacaaa

SEQ ID NO: 7066 - DNA, 24 bp, synthetic construct
  misc_feature 1..24: note = Synthetic Construct
  source 1..24: mol_type = other DNA
ccctagacatccacatgtgtgctt

SEQ ID NO: 7067 - DNA, 25 bp, synthetic construct
  misc_feature 1..25: note = Synthetic Construct
  source 1..25: mol_type = other DNA
gtcccaattctgcaactaactctgt

SEQ ID NO: 7068 - DNA, 24 bp, synthetic construct
  misc_feature 1..24: note = Synthetic Construct
  source 1..24: mol_type = other DNA
cctgtgcaaaactttggtctttgc

SEQ ID NO: 7069 - DNA, 26 bp, synthetic construct
  misc_feature 1..26: note = Synthetic Construct
  source 1..26: mol_type = other DNA
gagactgtctccttcatacacattcc

SEQ ID NO: 7070 - DNA, 22 bp, synthetic construct
  misc_feature 1..22: note = Synthetic Construct
  source 1..22: mol_type = other DNA
tgggcaggagttcctaatgaca

SEQ ID NO: 7071 - DNA, 20 bp, synthetic construct
  misc_feature 1..20: note = Synthetic Construct
  source 1..20: mol_type = other DNA
caggggtcgagtggagatga

SEQ ID NO: 7072 - DNA, 26 bp, synthetic construct
  misc_feature 1..26: note = Synthetic Construct
  source 1..26: mol_type = other DNA
gcatgaatcacgcttgttgtactaac

SEQ ID NO: 7073 - DNA, 25 bp, synthetic construct
  misc_feature 1..25: note = Synthetic Construct
  source 1..25: mol_type = other DNA
ccttgatgtaaccaagtcctgagtt

SEQ ID NO: 7074 - DNA, 18 bp, synthetic construct
  misc_feature 1..18: note = Synthetic Construct
  source 1..18: mol_type = other DNA
agtgccctggtgctagca

SEQ ID NO: 7075 - DNA, 25 bp, synthetic construct
  misc_feature 1..25: note = Synthetic Construct
  source 1..25: mol_type = other DNA
cactgattgagttggactctttgga

SEQ ID NO: 7076 - DNA, 26 bp, synthetic construct
  misc_feature 1..26: note = Synthetic Construct
  source 1..26: mol_type = other DNA
cacctgacaaggaatcgaagatgttc

SEQ ID NO: 7077 - DNA, 21 bp, synthetic construct
  misc_feature 1..21: note = Synthetic Construct
  source 1..21: mol_type = other DNA
tgcccatagaccatgcaagtg

SEQ ID NO: 7078 - DNA, 21 bp, synthetic construct
  misc_feature 1..21: note = Synthetic Construct
  source 1..21: mol_type = other DNA
tggagcttccacgtgatcctt

SEQ ID NO: 7079 - DNA, 23 bp, synthetic construct
  misc_feature 1..23: note = Synthetic Construct
  source 1..23: mol_type = other DNA
tgctgaggacactgaaatatgca

SEQ ID NO: 7080 - DNA, 22 bp, synthetic construct
  misc_feature 1..22: note = Synthetic Construct
  source 1..22: mol_type = other DNA
ggcctcagcgataaacacagaa

SEQ ID NO: 7081 - DNA, 19 bp, synthetic construct
  misc_feature 1..19: note = Synthetic Construct
  source 1..19: mol_type = other DNA
gctgctggctgtgaatgca

SEQ ID NO: 7082 - DNA, 22 bp, synthetic construct
  misc_feature 1..22: note = Synthetic Construct
  source 1..22: mol_type = other DNA
agccccagctgtctaaaatgtc

SEQ ID NO: 7083 - DNA, 20 bp, synthetic construct
  misc_feature 1..20: note = Synthetic Construct
  source 1..20: mol_type = other DNA
aaagcacgagggggaaaggt

SEQ ID NO: 7084 - DNA, 20 bp, synthetic construct
  misc_feature 1..20: note = Synthetic Construct
  source 1..20: mol_type = other DNA
ccagctgcaggtgacatagg

SEQ ID NO: 7085 - DNA, 28 bp, synthetic construct
  misc_feature 1..28: note = Synthetic Construct
  source 1..28: mol_type = other DNA
gccattgtaagaactttggcttttactc

SEQ ID NO: 7086 - DNA, 22 bp, synthetic construct
  misc_feature 1..22: note = Synthetic Construct
  source 1..22: mol_type = other DNA
aggtgtgactacgagaccaaga

SEQ ID NO: 7087 - DNA, 26 bp, synthetic construct
  misc_feature 1..26: note = Synthetic Construct
  source 1..26: mol_type = other DNA
caagttggaccctatcataggaagga

SEQ ID NO: 7088 - DNA, 24 bp, synthetic construct
  misc_feature 1..24: note = Synthetic Construct
  source 1..24: mol_type = other DNA
gggagtctgacacatggaacttct

SEQ ID NO: 7089 - DNA, 23 bp, synthetic construct
  misc_feature 1..23: note = Synthetic Construct
  source 1..23: mol_type = other DNA
gtatgtgccttgggagctttagt

SEQ ID NO: 7090 - DNA, 25 bp, synthetic construct
  misc_feature 1..25: note = Synthetic Construct
  source 1..25: mol_type = other DNA
ggacatgctcggtataccaatctag

SEQ ID NO: 7091 - DNA, 25 bp, synthetic construct
  misc_feature 1..25: note = Synthetic Construct
  source 1..25: mol_type = other DNA
ctgctgttcaccaaattagccatga

SEQ ID NO: 7092 - DNA, 24 bp, synthetic construct
  misc_feature 1..24: note = Synthetic Construct
  source 1..24: mol_type = other DNA
gtgtggtgcttctttgtgtaatgg

SEQ ID NO: 7093 - DNA, 20 bp, synthetic construct
  misc_feature 1..20: note = Synthetic Construct
  source 1..20: mol_type = other DNA
agccactctgacctctgtga

SEQ ID NO: 7094 - DNA, 23 bp, synthetic construct
  misc_feature 1..23: note = Synthetic Construct
  source 1..23: mol_type = other DNA
ggggggatgaaaacaaatttgct

SEQ ID NO: 7095 - DNA, 20 bp, synthetic construct
  misc_feature 1..20: note = Synthetic Construct
  source 1..20: mol_type = other DNA
ccaaggtgggtgtgcatctt

SEQ ID NO: 7096 - DNA, 23 bp, synthetic construct
  misc_feature 1..23: note = Synthetic Construct
  source 1..23: mol_type = other DNA
acggggaatgagctttacaatct

SEQ ID NO: 7097 - DNA, 23 bp, synthetic construct
  misc_feature 1..23: note = Synthetic Construct
  source 1..23: mol_type = other DNA
actgcctcccgattcactattct

SEQ ID NO: 7098 - DNA, 25 bp, synthetic construct
  misc_feature 1..25: note = Synthetic Construct
  source 1..25: mol_type = other DNA
gcaatatagaagggtgcaagtggaa

SEQ ID NO: 7099 - DNA, 22 bp, synthetic construct
  misc_feature 1..22: note = Synthetic Construct
  source 1..22: mol_type = other DNA
ggccccattttatctcctgtgt

SEQ ID NO: 7100 - DNA, 26 bp, synthetic construct
  misc_feature 1..26: note = Synthetic Construct
  source 1..26: mol_type = other DNA
ctctcaaagagattccaagtgagctt

SEQ ID NO: 7101 - DNA, 27 bp, synthetic construct
  misc_feature 1..27: note = Synthetic Construct
  source 1..27: mol_type = other DNA
ccatctgtattggaaagtgtggttcac

SEQ ID NO: 7102 - DNA, 24 bp, synthetic construct
  misc_feature 1..24: note = Synthetic Construct
  source 1..24: mol_type = other DNA
cgcagtttccacagcaatcctttg

SEQ ID NO: 7103 - DNA, 20 bp, synthetic construct
  misc_feature 1..20: note = Synthetic Construct
  source 1..20: mol_type = other DNA
tgatccagggcgctgtcaca

SEQ ID NO: 7104 - DNA, 22 bp, synthetic construct
  misc_feature 1..22: note = Synthetic Construct
  source 1..22: mol_type = other DNA
gggatcagtgctgtgatgtgta

SEQ ID NO: 7105 - DNA, 22 bp, synthetic construct
  misc_feature 1..22: note = Synthetic Construct
  source 1..22: mol_type = other DNA
gcaaactccctctgtgttccaa

SEQ ID NO: 7106 - DNA, 25 bp, synthetic construct
  misc_feature 1..25: note = Synthetic Construct
  source 1..25: mol_type = other DNA
gaatcaatttcatcaaggcctggaa

SEQ ID NO: 7107 - DNA, 24 bp, synthetic construct
  misc_feature 1..24: note = Synthetic Construct
  source 1..24: mol_type = other DNA
caccttttccaagaagtgttgctt

SEQ ID NO: 7108 - DNA, 25 bp, synthetic construct
  misc_feature 1..25: note = Synthetic Construct
  source 1..25: mol_type = other DNA
tgactgcttgttaccacaatatgca

SEQ ID NO: 7109 - DNA, 23 bp, synthetic construct
  misc_feature 1..23: note = Synthetic Construct
  source 1..23: mol_type = other DNA
ggtgttggcacatactgtactca

SEQ ID NO: 7110 - DNA, 25 bp, synthetic construct
  misc_feature 1..25: note = Synthetic Construct
  source 1..25: mol_type = other DNA
gagtctaatttagcgtggggtaact

SEQ ID NO: 7111 - DNA, 24 bp, synthetic construct
  misc_feature 1..24: note = Synthetic Construct
  source 1..24: mol_type = other DNA
ctcattaggcagtcctcccataca

SEQ ID NO: 7112 - DNA, 22 bp, synthetic construct
  misc_feature 1..22: note = Synthetic Construct
  source 1..22: mol_type = other DNA
aaagggggcctctgctctaata

SEQ ID NO: 7113 - DNA, 22 bp, synthetic construct
  misc_feature 1..22: note = Synthetic Construct
  source 1..22: mol_type = other DNA
acaacctggcaaagaaggcatt

SEQ ID NO: 7114 - DNA, 22 bp, synthetic construct
  misc_feature 1..22: note = Synthetic Construct
  source 1..22: mol_type = other DNA
gaggctggaggaaaatgtgagt

SEQ ID NO: 7115 - DNA, 24 bp, synthetic construct
  misc_feature 1..24: note = Synthetic Construct
  source 1..24: mol_type = other DNA
aattgctagccacagtttgcttac

SEQ ID NO: 7116 - DNA, 24 bp, synthetic construct
  misc_feature 1..24: note = Synthetic Construct
  source 1..24: mol_type = other DNA
agactagcctcattcctcccagat

SEQ ID NO: 7117 - DNA, 26 bp, synthetic construct
  misc_feature 1..26: note = Synthetic Construct
  source 1..26: mol_type = other DNA
ggtgaagaagacttaggagtgacatg

SEQ ID NO: 7118 - DNA, 24 bp, synthetic construct
  misc_feature 1..24: note = Synthetic Construct
  source 1..24: mol_type = other DNA
agctcacattctggcaatacatgt

SEQ ID NO: 7119 - DNA, 20 bp, synthetic construct
  misc_feature 1..20: note = Synthetic Construct
  source 1..20: mol_type = other DNA
attgctgctcctggggacaa

SEQ ID NO: 7120 - DNA, 26 bp, synthetic construct
  misc_feature 1..26: note = Synthetic Construct
  source 1..26: mol_type = other DNA
tttattgcccccttcactaaaacatg

SEQ ID NO: 7121 - DNA, 22 bp, synthetic construct
  misc_feature 1..22: note = Synthetic Construct
  source 1..22: mol_type = other DNA
tgctccttcgaggggtctagag

SEQ ID NO: 7122 - DNA, 24 bp, synthetic construct
  misc_feature 1..24: note = Synthetic Construct
  source 1..24: mol_type = other DNA
ctccagggagtgtgaatctgattc

SEQ ID NO: 7123 - DNA, 25 bp, synthetic construct
  misc_feature 1..25: note = Synthetic Construct
  source 1..25: mol_type = other DNA
gctgtagcaagagccactaatatcc

SEQ ID NO: 7124 - DNA, 21 bp, synthetic construct
  misc_feature 1..21: note = Synthetic Construct
  source 1..21: mol_type = other DNA
agggagaaggcactctgagtt

SEQ ID NO: 7125 - DNA, 22 bp, synthetic construct
  misc_feature 1..22: note = Synthetic Construct
  source 1..22: mol_type = other DNA
aggtcctgttttgggagtgcaa

SEQ ID NO: 7126 - DNA, 27 bp, synthetic construct
  misc_feature 1..27: note = Synthetic Construct
  source 1..27: mol_type = other DNA
tgaagtcctaaaattggttttcatgca

SEQ ID NO: 7127 - DNA, 24 bp, synthetic construct
  misc_feature 1..24: note = Synthetic Construct
  source 1..24: mol_type = other DNA
cttcacagtggacccattcattca

SEQ ID NO: 7128 - DNA, 20 bp, synthetic construct
  misc_feature 1..20: note = Synthetic Construct
  source 1..20: mol_type = other DNA
attcagggccaagggctgaa

SEQ ID NO: 7129 - DNA, 23 bp, synthetic construct
  misc_feature 1..23: note = Synthetic Construct
  source 1..23: mol_type = other DNA
gctgtagtgagctgcatgattgt

SEQ ID NO: 7130 - DNA, 24 bp, synthetic construct
  misc_feature 1..24: note = Synthetic Construct
  source 1..24: mol_type = other DNA
tgggggaaattgtcaaacttgtct

SEQ ID NO: 7131 - DNA, 19 bp, synthetic construct
  misc_feature 1..19: note = Synthetic Construct
  source 1..19: mol_type = other DNA
gctgacatgcaggcccaat

SEQ ID NO: 7132 - DNA, 23 bp, synthetic construct
  misc_feature 1..23: note = Synthetic Construct
  source 1..23: mol_type = other DNA
agaaacagaagccagggatcaag

SEQ ID NO: 7133 - DNA, 20 bp, synthetic construct
  misc_feature 1..20: note = Synthetic Construct
  source 1..20: mol_type = other DNA
accaggcagttctccttgtg

SEQ ID NO: 7134 - DNA, 26 bp, synthetic construct
  misc_feature 1..26: note = Synthetic Construct
  source 1..26: mol_type = other DNA
ccaaactcggttatatctcacaaacc

SEQ ID NO: 7135 - DNA, 28 bp, synthetic construct
  misc_feature 1..28: note = Synthetic Construct
  source 1..28: mol_type = other DNA
cctttccaagatcttagcatctctcctt

SEQ ID NO: 7136 - DNA, 22 bp, synthetic construct
  misc_feature 1..22: note = Synthetic Construct
  source 1..22: mol_type = other DNA
tccccagcattgtcgtatcaca

SEQ ID NO: 7137 - DNA, 24 bp, synthetic construct
  misc_feature 1..24: note = Synthetic Construct
  source 1..24: mol_type = other DNA
gctacgataaccaaggcagtctga

SEQ ID NO: 7138 - DNA, 23 bp, synthetic construct
  misc_feature 1..23: note = Synthetic Construct
  source 1..23: mol_type = other DNA
tgggggagagaaggataggagat

SEQ ID NO: 7139 - DNA, 23 bp, synthetic construct
  misc_feature 1..23: note = Synthetic Construct
  source 1..23: mol_type = other DNA
ccagatggaaggaggctaaagga

SEQ ID NO: 7140 - DNA, 24 bp, synthetic construct
  misc_feature 1..24: note = Synthetic Construct
  source 1..24: mol_type = other DNA
ccccgtgtaaacagtccattccaa

SEQ ID NO: 7141 - DNA, 22 bp, synthetic construct
  misc_feature 1..22: note = Synthetic Construct
  source 1..22: mol_type = other DNA
ttgagaaacgtctgtggacaca

SEQ ID NO: 7142 - DNA, 28 bp, synthetic construct
  misc_feature 1..28: note = Synthetic Construct
  source 1..28: mol_type = other DNA
ggacatttgggtttaaccagcctaattc

SEQ ID NO: 7143 - DNA, 21 bp, synthetic construct
  misc_feature 1..21: note = Synthetic Construct
  source 1..21: mol_type = other DNA
tgtacccaggctcccatctca

SEQ ID NO: 7144 - DNA, 25 bp, synthetic construct
  misc_feature 1..25: note = Synthetic Construct
  source 1..25: mol_type = other DNA
cctatgtactgttccttggatccaa

SEQ ID NO: 7145 - DNA, 22 bp, synthetic construct
  misc_feature 1..22: note = Synthetic Construct
  source 1..22: mol_type = other DNA
agcctgcttgagactggatgga

SEQ ID NO: 7146 - DNA, 21 bp, synthetic construct
  misc_feature 1..21: note = Synthetic Construct
  source 1..21: mol_type = other DNA
gggccaggcttttgggaaata

SEQ ID NO: 7147 - DNA, 22 bp, synthetic construct
  misc_feature 1..22: note = Synthetic Construct
  source 1..22: mol_type = other DNA
ccctgtctcttggttgttcctt

SEQ ID NO: 7148 - DNA, 27 bp, synthetic construct
  misc_feature 1..27: note = Synthetic Construct
  source 1..27: mol_type = other DNA
cccctgcttaactaactttgagtcaac

SEQ ID NO: 7149 - DNA, 26 bp, synthetic construct
  misc_feature 1..26: note = Synthetic Construct
  source 1..26: mol_type = other DNA
tgactgtagtgaatggaatgagcatt

SEQ ID NO: 7150 - DNA, 19 bp, synthetic construct
  misc_feature 1..19: note = Synthetic Construct
  source 1..19: mol_type = other DNA
aggggcgtctacgatcact

SEQ ID NO: 7151 - DNA, 18 bp, synthetic construct
  misc_feature 1..18: note = Synthetic Construct
  source 1..18: mol_type = other DNA
gtgcacagccgggatgga

SEQ ID NO: 7152 - DNA, 25 bp, synthetic construct
  misc_feature 1..25: note = Synthetic Construct
  source 1..25: mol_type = other DNA
cagagctctgattggccaagattgg

SEQ ID NO: 7153 - DNA, 22 bp, synthetic construct
  misc_feature 1..22: note = Synthetic Construct
  source 1..22: mol_type = other DNA
catgcccagccactggttatta

SEQ ID NO: 7154 - DNA, 22 bp, synthetic construct
  misc_feature 1..22: note = Synthetic Construct
  source 1..22: mol_type = other DNA
caagactccttcagcagtgaca

SEQ ID NO: 7155 - DNA, 27 bp, synthetic construct
  misc_feature 1..27: note = Synthetic Construct
  source 1..27: mol_type = other DNA
gactcacctccttaagctaatcttacc

SEQ ID NO: 7156 - DNA, 20 bp, synthetic construct
  misc_feature 1..20: note = Synthetic Construct
  source 1..20: mol_type = other DNA
tgccctggcactctctgctt

SEQ ID NO: 7157 - DNA, 24 bp, synthetic construct
  misc_feature 1..24: note = Synthetic Construct
  source 1..24: mol_type = other DNA
tgagaagtagacccagcctgtaac

SEQ ID NO: 7158 - DNA, 24 bp, synthetic construct
  misc_feature 1..24: note = Synthetic Construct
  source 1..24: mol_type = other DNA
cagtgggcaatagattcagcagat

SEQ ID NO: 7159 - DNA, 22 bp, synthetic construct
  misc_feature 1..22: note = Synthetic Construct
  source 1..22: mol_type = other DNA
gtcaccacccattggattgttg

SEQ ID NO: 7160 - DNA, 26 bp, synthetic construct
  misc_feature 1..26: note = Synthetic Construct
  source 1..26: mol_type = other DNA
ctgtaacatgctcttgggatgaagag

SEQ ID NO: 7161 - DNA, 25 bp, synthetic construct
  misc_feature 1..25: note = Synthetic Construct
  source 1..25: mol_type = other DNA
ggtttggctacataacttgctttgg

SEQ ID NO: 7162 - DNA, 23 bp, synthetic construct
  misc_feature 1..23: note = Synthetic Construct
  source 1..23: mol_type = other DNA
agcaagtctcatttcccctttgg

SEQ ID NO: 7163 - DNA, 23 bp, synthetic construct
  misc_feature 1..23: note = Synthetic Construct
  source 1..23: mol_type = other DNA
tcactggacacctgttcatttgg

SEQ ID NO: 7164 - DNA, 24 bp, synthetic construct
  misc_feature 1..24: note = Synthetic Construct
  source 1..24: mol_type = other DNA
aagttttggcagtcaccactttac

SEQ ID NO: 7165 - DNA, 23 bp, synthetic construct
  misc_feature 1..23: note = Synthetic Construct
  source 1..23: mol_type = other DNA
gagactcctgggtcagagatgaa

SEQ ID NO: 7166 - DNA, 22 bp, synthetic construct
  misc_feature 1..22: note = Synthetic Construct
  source 1..22: mol_type = other DNA
ctgaattcacgagcctgtgtca

SEQ ID NO: 7167 - DNA, 24 bp, synthetic construct
  misc_feature 1..24: note = Synthetic Construct
  source 1..24: mol_type = other DNA
atgctacggagggaggtgtataca

SEQ ID NO: 7168 - DNA, 20 bp, synthetic construct
  misc_feature 1..20: note = Synthetic Construct
  source 1..20: mol_type = other DNA
acccatggggcacacattca

SEQ ID NO: 7169 - DNA, 26 bp, synthetic construct
  misc_feature 1..26: note = Synthetic Construct
  source 1..26: mol_type = other DNA
gtgacaatagagaaagcaccatcatc

SEQ ID NO: 7170 - DNA, 24 bp, synthetic construct
  misc_feature 1..24: note = Synthetic Construct
  source 1..24: mol_type = other DNA
cctgaggctgtttcttccagacaa

SEQ ID NO: 7171 - DNA, 25 bp, synthetic construct
  misc_feature 1..25: note = Synthetic Construct
  source 1..25: mol_type = other DNA
ggcttgcttcaataggtgagctact

SEQ ID NO: 7172 - DNA, 29 bp, synthetic construct
  misc_feature 1..29: note = Synthetic Construct
  source 1..29: mol_type = other DNA
gcaaaaccacaatgacaaaaatcaggtat

SEQ ID NO: 7173 - DNA, 22 bp, synthetic construct
  misc_feature 1..22: note = Synthetic Construct
  source 1..22: mol_type = other DNA
gcaagggggagctgtaattgtt

SEQ ID NO: 7174 - DNA, 25 bp, synthetic construct
  misc_feature 1..25: note = Synthetic Construct
  source 1..25: mol_type = other DNA
gttcaaattcaacccccatctgaga

SEQ ID NO: 7175 - DNA, 30 bp, synthetic construct
  misc_feature 1..30: note = Synthetic Construct
  source 1..30: mol_type = other DNA
ggggccaatatttaccagaattatgatggt

SEQ ID NO: 7176 - DNA, 22 bp, synthetic construct
  misc_feature 1..22: note = Synthetic Construct
  source 1..22: mol_type = other DNA
gaggtgaggcagtgaaaccaat

SEQ ID NO: 7177 - DNA, 23 bp, synthetic construct
  misc_feature 1..23: note = Synthetic Construct
  source 1..23: mol_type = other DNA
tcagtctggaacactccttgact

SEQ ID NO: 7178 - DNA, 20 bp, synthetic construct
  misc_feature 1..20: note = Synthetic Construct
  source 1..20: mol_type = other DNA
ggtctggggctagcaattgc

SEQ ID NO: 7179 - DNA, 23 bp, synthetic construct
  misc_feature 1..23: note = Synthetic Construct
  source 1..23: mol_type = other DNA
accctctatcctgggctgaatcc

SEQ ID NO: 7180 - DNA, 27 bp, synthetic construct
  misc_feature 1..27: note = Synthetic Construct
  source 1..27: mol_type = other DNA
aattgagatcagtgttctcttcattcg

SEQ ID NO: 7181 - DNA, 20 bp, synthetic construct
  misc_feature 1..20: note = Synthetic Construct
  source 1..20: mol_type = other DNA
ggagcgtccaggtcacagat

SEQ ID NO: 7182 - DNA, 22 bp, synthetic construct
  misc_feature 1..22: note = Synthetic Construct
  source 1..22: mol_type = other DNA
agggtgacatgtcccaattgca

SEQ ID NO: 7183 - DNA, 25 bp, synthetic construct
  misc_feature 1..25: note = Synthetic Construct
  source 1..25: mol_type = other DNA
gaataccaaccagacaacagacaca

SEQ ID NO: 7184 - DNA, 22 bp, synthetic construct
  misc_feature 1..22: note = Synthetic Construct
  source 1..22: mol_type = other DNA
gaacatgcagcagtttggtgat

SEQ ID NO: 7185 - DNA, 28 bp, synthetic construct
  misc_feature 1..28: note = Synthetic Construct
  source 1..28: mol_type = other DNA
ggtcattttttttccagtggaggatgtg

SEQ ID NO: 7186 - DNA, 24 bp, synthetic construct
  misc_feature 1..24: note = Synthetic Construct
  source 1..24: mol_type = other DNA
ggtgcaccagtacttgatcatagg

SEQ ID NO: 7187 - DNA, 26 bp, synthetic construct
  misc_feature 1..26: note = Synthetic Construct
  source 1..26: mol_type = other DNA
caaggccaatgtctagttaagaagca

SEQ ID NO: 7188 - DNA, 24 bp, synthetic construct
  misc_feature 1..24: note = Synthetic Construct
  source 1..24: mol_type = other DNA
cagcctcattcaccctcatactct

SEQ ID NO: 7189 - DNA, 25 bp, synthetic construct
  misc_feature 1..25: note = Synthetic Construct
  source 1..25: mol_type = other DNA
gtcgtttgcttgctgttttaactgt

SEQ ID NO: 7190 - DNA, 28 bp, synthetic construct
  misc_feature 1..28: note = Synthetic Construct
  source 1..28: mol_type = other DNA
ggctaagctaacgatattccatctctca

SEQ ID NO: 7191 - DNA, 26 bp, synthetic construct
  misc_feature 1..26: note = Synthetic Construct
  source 1..26: mol_type = other DNA
gctatcgatgttgtgaaaggttctgt

SEQ ID NO: 7192 - DNA, 24 bp, synthetic construct
  misc_feature 1..24: note = Synthetic Construct
  source 1..24: mol_type = other DNA
gagggagacttggtaaacaatcca

SEQ ID NO: 7193 - DNA, 26 bp, synthetic construct
  misc_feature 1..26: note = Synthetic Construct
  source 1..26: mol_type = other DNA
gagtctgggaaatgcacaattatggt

SEQ ID NO: 7194 - DNA, 22 bp, synthetic construct
  misc_feature 1..22: note = Synthetic Construct
  source 1..22: mol_type = other DNA
aggctcaggtctcaaccacagt

SEQ ID NO: 7195 - DNA, 26 bp, synthetic construct
  misc_feature 1..26: note = Synthetic Construct
  source 1..26: mol_type = other DNA
ccacatggcacttgatttttgacagt

SEQ ID NO: 7196 - DNA, 20 bp, synthetic construct
  misc_feature 1..20: note = Synthetic Construct
  source 1..20: mol_type = other DNA
gcttcatgctgcacttgctt

SEQ ID NO: 7197 - DNA, 25 bp, synthetic construct
  misc_feature 1..25: note = Synthetic Construct
  source 1..25: mol_type = other DNA
tggttcaacactatagcagaactgt

SEQ ID NO: 7198 - DNA, 23 bp, synthetic construct
  misc_feature 1..23: note = Synthetic Construct
  source 1..23: mol_type = other DNA
gctcaataaccaagcagcacaga

SEQ ID NO: 7199 - DNA, 23 bp, synthetic construct
  misc_feature 1..23: note = Synthetic Construct
  source 1..23: mol_type = other DNA
cattggcaaattggctcactttg

SEQ ID NO: 7200 - DNA, 22 bp, synthetic construct
  misc_feature 1..22: note = Synthetic Construct
  source 1..22: mol_type = other DNA
ggaaggactcccagggaaaaca

SEQ ID NO: 7201 - DNA, 19 bp, synthetic construct
  misc_feature 1..19: note = Synthetic Construct
  source 1..19: mol_type = other DNA
agacgtgtgagggctgtgt

SEQ ID NO: 7202 - DNA, 23 bp, synthetic construct
  misc_feature 1..23: note = Synthetic Construct
  source 1..23: mol_type = other DNA
tcttgttgctcttgaaggcattg

SEQ ID NO: 7203 - DNA, 23 bp, synthetic construct
  misc_feature 1..23: note = Synthetic Construct
  source 1..23: mol_type = other DNA
cagagaggcctgaattcaaacct

SEQ ID NO: 7204 - DNA, 19 bp, synthetic construct
  misc_feature 1..19: note = Synthetic Construct
  source 1..19: mol_type = other DNA
ggcctcactgctggtttca

SEQ ID NO: 7205 - DNA, 21 bp, synthetic construct
  misc_feature 1..21: note = Synthetic Construct
  source 1..21: mol_type = other DNA
tcagtccacagcactcaccat

SEQ ID NO: 7206 - DNA, 23 bp, synthetic construct
  misc_feature 1..23: note = Synthetic Construct
  source 1..23: mol_type = other DNA
ggggagtaatgtgctcttacgtt

SEQ ID NO: 7207 - DNA, 25 bp, synthetic construct
  misc_feature 1..25: note = Synthetic Construct
  source 1..25: mol_type = other DNA
ggagttggttcattctctcgaatgg

SEQ ID NO: 7208 - DNA, 22 bp, synthetic construct
  misc_feature 1..22: note = Synthetic Construct
  source 1..22: mol_type = other DNA
caagatggctgaactgcaaacg

SEQ ID NO: 7209 - DNA, 22 bp, synthetic construct
  misc_feature 1..22: note = Synthetic Construct
  source 1..22: mol_type = other DNA
gcccaaccttgtctgtatcact

SEQ ID NO: 7210 - DNA, 28 bp, synthetic construct
  misc_feature 1..28: note = Synthetic Construct
  source 1..28: mol_type = other DNA
caaacaacttgatttctccaatccaaca

SEQ ID NO: 7211 - DNA, 25 bp, synthetic construct
  misc_feature 1..25: note = Synthetic Construct
  source 1..25: mol_type = other DNA
gcctgaaagtgtacatgcctcttct

SEQ ID NO: 7212 - DNA, 21 bp, synthetic construct
  misc_feature 1..21: note = Synthetic Construct
  source 1..21: mol_type = other DNA
cccacttggccttttctgaca

SEQ ID NO: 7213 - DNA, 24 bp, synthetic construct
  misc_feature 1..24: note = Synthetic Construct
  source 1..24: mol_type = other DNA
cctataggaaacacatggcaagga

SEQ ID NO: 7214 - DNA, 22 bp, synthetic construct
  misc_feature 1..22: note = Synthetic Construct
  source 1..22: mol_type = other DNA
aagtcacagtgcttgacaacct

SEQ ID NO: 7215 - DNA, 21 bp, synthetic construct
  misc_feature 1..21: note = Synthetic Construct
  source 1..21: mol_type = other DNA
tgtggaaagctgccttttggt

SEQ ID NO: 7216 - DNA, 27 bp, synthetic construct
  misc_feature 1..27: note = Synthetic Construct
  source 1..27: mol_type = other DNA
gctgtaatagtaagaggcaccttcttg

SEQ ID NO: 7217 - DNA, 25 bp, synthetic construct
  misc_feature 1..25: note = Synthetic Construct
  source 1..25: mol_type = other DNA
gactgtcagaatgaataggctcctt

SEQ ID NO: 7218 - DNA, 24 bp, synthetic construct
  misc_feature 1..24: note = Synthetic Construct
  source 1..24: mol_type = other DNA
gagagtgacctagggaaactgcta

SEQ ID NO: 7219 - DNA, 24 bp, synthetic construct
  misc_feature 1..24: note = Synthetic Construct
  source 1..24: mol_type = other DNA
gggtaagctgaggcaagtttagga

SEQ ID NO: 7220 - DNA, 22 bp, synthetic construct
  misc_feature 1..22: note = Synthetic Construct
  source 1..22: mol_type = other DNA
tgttcattccccccgtgtacta

SEQ ID NO: 7221 - DNA, 26 bp, synthetic construct
  misc_feature 1..26: note = Synthetic Construct
  source 1..26: mol_type = other DNA
ggatcacaattgtaactcacctttgg

SEQ ID NO: 7222 - DNA, 20 bp, synthetic construct
  misc_feature 1..20: note = Synthetic Construct
  source 1..20: mol_type = other DNA
gcagggagtagcagcaagtt

SEQ ID NO: 7223 - DNA, 24 bp, synthetic construct
  misc_feature 1..24: note = Synthetic Construct
  source 1..24: mol_type = other DNA
gggatgctttagaactgtgcagat

SEQ ID NO: 7224 - DNA, 25 bp, synthetic construct
  misc_feature 1..25: note = Synthetic Construct
  source 1..25: mol_type = other DNA
ggatggagagaagaaatgacccttt

SEQ ID NO: 7225 - DNA, 23 bp, synthetic construct
  misc_feature 1..23: note = Synthetic Construct
  source 1..23: mol_type = other DNA
gcctggaagatgtgtgaattgca

SEQ ID NO: 7226 - DNA, 25 bp, synthetic construct
  misc_feature 1..25: note = Synthetic Construct
  source 1..25: mol_type = other DNA
caccccactagtcactgatacaaag

SEQ ID NO: 7227 - DNA, 22 bp, synthetic construct
  misc_feature 1..22: note = Synthetic Construct
  source 1..22: mol_type = other DNA
accctggagactacacatgtct

SEQ ID NO: 7228 - DNA, 18 bp, synthetic construct
  misc_feature 1..18: note = Synthetic Construct
  source 1..18: mol_type = other DNA
gccttcccgctgcacatg

SEQ ID NO: 7229 - DNA, 18 bp, synthetic construct
  misc_feature 1..18: note = Synthetic Construct
  source 1..18: mol_type = other DNA
caagccacgggggacatg

SEQ ID NO: 7230 - DNA, 22 bp, synthetic construct
  misc_feature 1..22: note = Synthetic Construct
  source 1..22: mol_type = other DNA
accccttccatccgagaatcct

SEQ ID NO: 7231 - DNA, 27 bp, synthetic construct
  misc_feature 1..27: note = Synthetic Construct
  source 1..27: mol_type = other DNA
attataccctgtttgaggtcaaatcct

SEQ ID NO: 7232 - DNA, 22 bp, synthetic construct
  misc_feature 1..22: note = Synthetic Construct
  source 1..22: mol_type = other DNA
gtggaacttgggcagataccaa

SEQ ID NO: 7233 - DNA, 21 bp, synthetic construct
  misc_feature 1..21: note = Synthetic Construct
  source 1..21: mol_type = other DNA
ctcttcctcgttcagccactt

SEQ ID NO: 7234 - DNA, 22 bp, synthetic construct
  misc_feature 1..22: note = Synthetic Construct
  source 1..22: mol_type = other DNA
gggcctagaaacaacagcaatg

SEQ ID NO: 7235 - DNA, 26 bp, synthetic construct
  misc_feature 1..26: note = Synthetic Construct
  source 1..26: mol_type = other DNA
cagaacctattttccaaatgggcatt

SEQ ID NO: 7236 - DNA, 23 bp, synthetic construct
  misc_feature 1..23: note = Synthetic Construct
  source 1..23: mol_type = other DNA
ccacagtctaaggcaagacatgt

SEQ ID NO: 7237 - DNA, 27 bp, synthetic construct
  misc_feature 1..27: note = Synthetic Construct
  source 1..27: mol_type = other DNA
gcaaaggtatggttagaaaagctacgt

SEQ ID NO: 7238 - DNA, 24 bp, synthetic construct
  misc_feature 1..24: note = Synthetic Construct
  source 1..24: mol_type = other DNA
ggaggtgtcaattgggtgctaaga

SEQ ID NO: 7239 - DNA, 27 bp, synthetic construct
  misc_feature 1..27: note = Synthetic Construct
  source 1..27: mol_type = other DNA
acatgtagaatgatcatccaggaccta

SEQ ID NO: 7240 - DNA, 26 bp, synthetic construct
  misc_feature 1..26: note = Synthetic Construct
  source 1..26: mol_type = other DNA
cctttgtataccagttccttctgcat

SEQ ID NO: 7241 - DNA, 22 bp, synthetic construct
  misc_feature 1..22: note = Synthetic Construct
  source 1..22: mol_type = other DNA
gcaaccatccaaggactctgat

SEQ ID NO: 7242 - DNA, 22 bp, synthetic construct
  misc_feature 1..22: note = Synthetic Construct
  source 1..22: mol_type = other DNA
tccaccctgagctcttcctgtt

SEQ ID NO: 7243 - DNA, 24 bp, synthetic construct
  misc_feature 1..24: note = Synthetic Construct
  source 1..24: mol_type = other DNA
gcatggccaagtcactccagaaaa

SEQ ID NO: 7244 - DNA, 24 bp, synthetic construct
  misc_feature 1..24: note = Synthetic Construct
  source 1..24: mol_type = other DNA
tgttgccaaaagttgctcagtaag

SEQ ID NO: 7245 - DNA, 21 bp, synthetic construct
  misc_feature 1..21: note = Synthetic Construct
  source 1..21: mol_type = other DNA
tcgtcctcctgagctcaagga

SEQ ID NO: 7246 - DNA, 26 bp, synthetic construct
  misc_feature 1..26: note = Synthetic Construct
  source 1..26: mol_type = other DNA
agggatacacaacaccatttaaacct

SEQ ID NO: 7247 - DNA, 22 bp, synthetic construct
  misc_feature 1..22: note = Synthetic Construct
  source 1..22: mol_type = other DNA
agcttccccaagggcatctgaa

SEQ ID NO: 7248 - DNA, 23 bp, synthetic construct
  misc_feature 1..23: note = Synthetic Construct
  source 1..23: mol_type = other DNA
ccaaggccaagagcaacttatgg

SEQ ID NO: 7249 - DNA, 20 bp, synthetic construct
  misc_feature 1..20: note = Synthetic Construct
  source 1..20: mol_type = other DNA
accagccttggggaaatgga

SEQ ID NO: 7250 - DNA, 22 bp, synthetic construct
  misc_feature 1..22: note = Synthetic Construct
  source 1..22: mol_type = other DNA
ggtttccccaatacccagttca

SEQ ID NO: 7251 - DNA, 22 bp, synthetic construct
  misc_feature 1..22: note = Synthetic Construct
  source 1..22: mol_type = other DNA
agaacctggccatctcttccat

SEQ ID NO: 7252 - DNA, 21 bp, synthetic construct
  misc_feature 1..21: note = Synthetic Construct
  source 1..21: mol_type = other DNA
ccaggggttggcaaacttgtt

SEQ ID NO: 7253 - DNA, 25 bp, synthetic construct
  misc_feature 1..25: note = Synthetic Construct
  source 1..25: mol_type = other DNA
ggaggtaaacaccatccctgattag

SEQ ID NO: 7254 - DNA, 25 bp, synthetic construct
  misc_feature 1..25: note = Synthetic Construct
  source 1..25: mol_type = other DNA
ggtaaaagctcctctctctcgtaga

SEQ ID NO: 7255 - DNA, 19 bp, synthetic construct
  misc_feature 1..19: note = Synthetic Construct
  source 1..19: mol_type = other DNA
agcctgggatgctccacta

SEQ ID NO: 7256 - DNA, 21 bp, synthetic construct
  misc_feature 1..21: note = Synthetic Construct
  source 1..21: mol_type = other DNA
tgggaggtgcaaaggctttgt

SEQ ID NO: 7257 - DNA, 22 bp, synthetic construct
  misc_feature 1..22: note = Synthetic Construct
  source 1..22: mol_type = other DNA
cgaatgccacacatgtcatggt

SEQ ID NO: 7258 - DNA, 21 bp, synthetic construct
  misc_feature 1..21: note = Synthetic Construct
  source 1..21: mol_type = other DNA
actccatgccatccagactct

SEQ ID NO: 7259 - DNA, 22 bp, synthetic construct
  misc_feature 1..22: note = Synthetic Construct
  source 1..22: mol_type = other DNA
tgagaaaggctggcatgactct

SEQ ID NO: 7260 - DNA, 26 bp, synthetic construct
  misc_feature 1..26: note = Synthetic Construct
  source 1..26: mol_type = other DNA
cagcaactcaatttttattggccaaa

SEQ ID NO: 7261 - DNA, 26 bp, synthetic construct
  misc_feature 1..26: note = Synthetic Construct
  source 1..26: mol_type = other DNA
gattggcctactgcataattccctat

SEQ ID NO: 7262 - DNA, 24 bp, synthetic construct
  misc_feature 1..24: note = Synthetic Construct
  source 1..24: mol_type = other DNA
ggaactagccaggctggaatatca

SEQ ID NO: 7263 - DNA, 22 bp, synthetic construct
  misc_feature 1..22: note = Synthetic Construct
  source 1..22: mol_type = other DNA
ggaatggggcttctcgttcatt

SEQ ID NO: 7264 - DNA, 25 bp, synthetic construct
  misc_feature 1..25: note = Synthetic Construct
  source 1..25: mol_type = other DNA
ctaattcaccccaatgtcagaggaa

SEQ ID NO: 7265 - DNA, 22 bp, synthetic construct
  misc_feature 1..22: note = Synthetic Construct
  source 1..22: mol_type = other DNA
cggctaacacattgcaggaatg

SEQ ID NO: 7266 - DNA, 22 bp, synthetic construct
  misc_feature 1..22: note = Synthetic Construct
  source 1..22: mol_type = other DNA
gcagcaaccatcttcacaaggt

SEQ ID NO: 7267 - DNA, 21 bp, synthetic construct
  misc_feature 1..21: note = Synthetic Construct
  source 1..21: mol_type = other DNA
ggaggagcaagggtggaagta

SEQ ID NO: 7268 - DNA, 24 bp, synthetic construct
  misc_feature 1..24: note = Synthetic Construct
  source 1..24: mol_type = other DNA
tgtggcagaaatagatcccatgtc

SEQ ID NO: 7269 - DNA, 26 bp, synthetic construct
  misc_feature 1..26: note = Synthetic Construct
  source 1..26: mol_type = other DNA
ccatctgcttatgtgacagagaccaa

SEQ ID NO: 7270 - DNA, 21 bp, synthetic construct
  misc_feature 1..21: note = Synthetic Construct
  source 1..21: mol_type = other DNA
cccattgcctacaacggtcat

SEQ ID NO: 7271 - DNA, 26 bp, synthetic construct
  misc_feature 1..26: note = Synthetic Construct
  source 1..26: mol_type = other DNA
cgctagtccagattttagtgtaatgc

SEQ ID NO: 7272 - DNA, 22 bp, synthetic construct
  misc_feature 1..22: note = Synthetic Construct
  source 1..22: mol_type = other DNA
tgaaaaaccctggttgccagtt

SEQ ID NO: 7273 - DNA, 20 bp, synthetic construct
  misc_feature 1..20: note = Synthetic Construct
  source 1..20: mol_type = other DNA
gcctcacagggctgacatgt

SEQ ID NO: 7274 - DNA, 25 bp, synthetic construct
  misc_feature 1..25: note = Synthetic Construct
  source 1..25: mol_type = other DNA
tgatggtttaaaacgtggaggaaac

SEQ ID NO: 7275 - DNA, 23 bp, synthetic construct
  misc_feature 1..23: note = Synthetic Construct
  source 1..23: mol_type = other DNA
gcaggctgtcgctacgttttctt

SEQ ID NO: 7276 - DNA, 24 bp, synthetic construct
  misc_feature 1..24: note = Synthetic Construct
  source 1..24: mol_type = other DNA
ggggtaaaaggaggttatcaagca

SEQ ID NO: 7277 - DNA, 22 bp, synthetic construct
  misc_feature 1..22: note = Synthetic Construct
  source 1..22: mol_type = other DNA
gcctgcctggaaatctcagtct

SEQ ID NO: 7278 - DNA, 25 bp, synthetic construct
  misc_feature 1..25: note = Synthetic Construct
  source 1..25: mol_type = other DNA
gtgatgagcacaggttattctgaca

SEQ ID NO: 7279 - DNA, 22 bp, synthetic construct
  misc_feature 1..22: note = Synthetic Construct
  source 1..22: mol_type = other DNA
gccatgctttcattggcaaagg

SEQ ID NO: 7280 - DNA, 25 bp, synthetic construct
  misc_feature 1..25: note = Synthetic Construct
  source 1..25: mol_type = other DNA
gatgactaagttgccttgtgagtct

SEQ ID NO: 7281 - DNA, 24 bp, synthetic construct
  misc_feature 1..24: note = Synthetic Construct
  source 1..24: mol_type = other DNA
ctgtgagcaagtggagaggtatca

SEQ ID NO: 7282 - DNA, 21 bp, synthetic construct
  misc_feature 1..21: note = Synthetic Construct
  source 1..21: mol_type = other DNA
tggcagcttttcgctctggtt

SEQ ID NO: 7283 - DNA, 20 bp, synthetic construct
  misc_feature 1..20: note = Synthetic Construct
  source 1..20: mol_type = other DNA
cccgcctgtgtgactcaaac

SEQ ID NO: 7284 - DNA, 24 bp, synthetic construct
  misc_feature 1..24: note = Synthetic Construct
  source 1..24: mol_type = other DNA
ccgtaggtgggagttcatgtctta

SEQ ID NO: 7285 - DNA, 20 bp, synthetic construct
  misc_feature 1..20: note = Synthetic Construct
  source 1..20: mol_type = other DNA
ccccatggcaccaacttaca

SEQ ID NO: 7286 - DNA, 21 bp, synthetic construct
  misc_feature 1..21: note = Synthetic Construct
  source 1..21: mol_type = other DNA
aggtggcacataggagctgaa

SEQ ID NO: 7287 - DNA, 25 bp, synthetic construct
  misc_feature 1..25: note = Synthetic Construct
  source 1..25: mol_type = other DNA
caaaaggagaggtaaaccctgttct

SEQ ID NO: 7288 - DNA, 20 bp, synthetic construct
  misc_feature 1..20: note = Synthetic Construct
  source 1..20: mol_type = other DNA
aggttctgatggcccagaga

SEQ ID NO: 7289 - DNA, 24 bp, synthetic construct
  misc_feature 1..24: note = Synthetic Construct
  source 1..24: mol_type = other DNA
gggtaagtggcttatccaagttca

SEQ ID NO: 7290 - DNA, 24 bp, synthetic construct
  misc_feature 1..24: note = Synthetic Construct
  source 1..24: mol_type = other DNA
cctgatccatcttgctcccttttc

SEQ ID NO: 7291 - DNA, 21 bp, synthetic construct
  misc_feature 1..21: note = Synthetic Construct
  source 1..21: mol_type = other DNA
ttcacccccatgacccagaca

SEQ ID NO: 7292 - DNA, 24 bp, synthetic construct
  misc_feature 1..24: note = Synthetic Construct
  source 1..24: mol_type = other DNA
tccaagggtcctgagtgtatccta

SEQ ID NO: 7293 - DNA, 28 bp, synthetic construct
  misc_feature 1..28: note = Synthetic Construct
  source 1..28: mol_type = other DNA
gtgaaacaattcaagggtcattgatctg

SEQ ID NO: 7294 - DNA, 23 bp, synthetic construct
  misc_feature 1..23: note = Synthetic Construct
  source 1..23: mol_type = other DNA
ctgagttgccctggacaacagtt

SEQ ID NO: 7295 - DNA, 26 bp, synthetic construct
  misc_feature 1..26: note = Synthetic Construct
  source 1..26: mol_type = other DNA
caaggttcttcagctgacacttaaag

SEQ ID NO: 7296 - DNA, 18 bp, synthetic construct
  misc_feature 1..18: note = Synthetic Construct
  source 1..18: mol_type = other DNA
ctggagcccaccctctgt

SEQ ID NO: 7297 - DNA, 22 bp, synthetic construct
  misc_feature 1..22: note = Synthetic Construct
  source 1..22: mol_type = other DNA
gtgggggtgttatttggtgtca

SEQ ID NO: 7298 - DNA, 23 bp, synthetic construct
  misc_feature 1..23: note = Synthetic Construct
  source 1..23: mol_type = other DNA
tggacacagaatcagcattccat

SEQ ID NO: 7299 - DNA, 26 bp, synthetic construct
  misc_feature 1..26: note = Synthetic Construct
  source 1..26: mol_type = other DNA
tttactggtggtagattagccaagag

SEQ ID NO: 7300 - DNA, 23 bp, synthetic construct
  misc_feature 1..23: note = Synthetic Construct
  source 1..23: mol_type = other DNA
ccacctgcatttctttgctgtgt

SEQ ID NO: 7301 - DNA, 21 bp, synthetic construct
  misc_feature 1..21: note = Synthetic Construct
  source 1..21: mol_type = other DNA
agctgtgggaaaagggtcctt

SEQ ID NO: 7302 - DNA, 19 bp, synthetic construct
  misc_feature 1..19: note = Synthetic Construct
  source 1..19: mol_type = other DNA
atgcccggcttgttgttgt

SEQ ID NO: 7303 - DNA, 22 bp, synthetic construct
  misc_feature 1..22: note = Synthetic Construct
  source 1..22: mol_type = other DNA
ctcttccgtcctttggagttga

SEQ ID NO: 7304 - DNA, 22 bp, synthetic construct
  misc_feature 1..22: note = Synthetic Construct
  source 1..22: mol_type = other DNA
gctgcccggtgtcaagataata

SEQ ID NO: 7305 - DNA, 26 bp, synthetic construct
  misc_feature 1..26: note = Synthetic Construct
  source 1..26: mol_type = other DNA
agtcttggttatcaggtccttaggat

SEQ ID NO: 7306 - DNA, 22 bp, synthetic construct
  misc_feature 1..22: note = Synthetic Construct
  source 1..22: mol_type = other DNA
atgcaaagaactctgggaagct

SEQ ID NO: 7307 - DNA, 25 bp, synthetic construct
  misc_feature 1..25: note = Synthetic Construct
  source 1..25: mol_type = other DNA
ctgaaggatgattgggaaaggttga

SEQ ID NO: 7308 - DNA, 23 bp, synthetic construct
  misc_feature 1..23: note = Synthetic Construct
  source 1..23: mol_type = other DNA
cgattttgccaagggaaattgct

SEQ ID NO: 7309 - DNA, 26 bp, synthetic construct
  misc_feature 1..26: note = Synthetic Construct
  source 1..26: mol_type = other DNA
gctttgtgtatgcaagagtggtacca

SEQ ID NO: 7310 - DNA, 25 bp, synthetic construct
  misc_feature 1..25: note = Synthetic Construct
  source 1..25: mol_type = other DNA
tctcacatagtgttgtgcctttact

SEQ ID NO: 7311 - DNA, 26 bp, synthetic construct
  misc_feature 1..26: note = Synthetic Construct
  source 1..26: mol_type = other DNA
gagtaagtggagcaggttttaaatgg

SEQ ID NO: 7312 - DNA, 22 bp, synthetic construct
  misc_feature 1..22: note = Synthetic Construct
  source 1..22: mol_type = other DNA
cacacattggcacatggtcaca

SEQ ID NO: 7313 - DNA, 22 bp, synthetic construct
  misc_feature 1..22: note = Synthetic Construct
  source 1..22: mol_type = other DNA
atagcctcctcacctcatctgt

SEQ ID NO: 7314 - DNA, 25 bp, synthetic construct
  misc_feature 1..25: note = Synthetic Construct
  source 1..25: mol_type = other DNA
gggtacacagcaaacttctcttgtc

SEQ ID NO: 7315 - DNA, 22 bp, synthetic construct
  misc_feature 1..22: note = Synthetic Construct
  source 1..22: mol_type = other DNA
agcgtggagaggatctgtaagt

SEQ ID NO: 7316 - DNA, 27 bp, synthetic construct
  misc_feature 1..27: note = Synthetic Construct
  source 1..27: mol_type = other DNA
actggttgctgagtatatccactatac

SEQ ID NO: 7317 - DNA, 24 bp, synthetic construct
  misc_feature 1..24: note = Synthetic Construct
  source 1..24: mol_type = other DNA
acgtacactaaggatgggatagct

SEQ ID NO: 7318 - DNA, 24 bp, synthetic construct
  misc_feature 1..24: note = Synthetic Construct
  source 1..24: mol_type = other DNA
gatccatacctgtgagggaggtaa

SEQ ID NO: 7319 - DNA, 24 bp, synthetic construct
  misc_feature 1..24: note = Synthetic Construct
  source 1..24: mol_type = other DNA
tctactcttgccactgaaattgct

SEQ ID NO: 7320 - DNA, 21 bp, synthetic construct
  misc_feature 1..21: note = Synthetic Construct
  source 1..21: mol_type = other DNA
gggggaggaaatgagcttcaa

SEQ ID NO: 7321 - DNA, 19 bp, synthetic construct
  misc_feature 1..19: note = Synthetic Construct
  source 1..19: mol_type = other DNA
accccctgcccatatcaca

SEQ ID NO: 7322 - DNA, 23 bp, synthetic construct
  misc_feature 1..23: note = Synthetic Construct
  source 1..23: mol_type = other DNA
cctgccctattctgtaactgcaa

SEQ ID NO: 7323 - DNA, 26 bp, synthetic construct
  misc_feature 1..26: note = Synthetic Construct
  source 1..26: mol_type = other DNA
gctttcagacaacagttctagacaca

SEQ ID NO: 7324 - DNA, 22 bp, synthetic construct
  misc_feature 1..22: note = Synthetic Construct
  source 1..22: mol_type = other DNA
cataatgcttgcatggctgtca

SEQ ID NO: 7325 - DNA, 27 bp, synthetic construct
  misc_feature 1..27: note = Synthetic Construct
  source 1..27: mol_type = other DNA
ggctagtcaaaagaaaggtaggaatgg

SEQ ID NO: 7326 - DNA, 22 bp, synthetic construct
  misc_feature 1..22: note = Synthetic Construct
  source 1..22: mol_type = other DNA
aagcatcgcagaagaggcatct

SEQ ID NO: 7327 - DNA, 24 bp, synthetic construct
  misc_feature 1..24: note = Synthetic Construct
  source 1..24: mol_type = other DNA
gcttggaaaggaggggttggaaaa

SEQ ID NO: 7328 - DNA, 26 bp, synthetic construct
  misc_feature 1..26: note = Synthetic Construct
  source 1..26: mol_type = other DNA
tggagagcttattcaatctccactac

SEQ ID NO: 7329 - DNA, 23 bp, synthetic construct
  misc_feature 1..23: note = Synthetic Construct
  source 1..23: mol_type = other DNA
agaagcatcagaacaggttcaca

SEQ ID NO: 7330 - DNA, 19 bp, synthetic construct
  misc_feature 1..19: note = Synthetic Construct
  source 1..19: mol_type = other DNA
ccccggcttgagaactgtt

SEQ ID NO: 7331 - DNA, 21 bp, synthetic construct
  misc_feature 1..21: note = Synthetic Construct
  source 1..21: mol_type = other DNA
agctgagagaatggggacagt

SEQ ID NO: 7332 - DNA, 29 bp, synthetic construct
  misc_feature 1..29: note = Synthetic Construct
  source 1..29: mol_type = other DNA
tcacggtaatcagtcatttacatttctct

SEQ ID NO: 7333 - DNA, 25 bp, synthetic construct
  misc_feature 1..25: note = Synthetic Construct
  source 1..25: mol_type = other DNA
cacatacaacaggctgttagaggaa

SEQ ID NO: 7334 - DNA, 21 bp, synthetic construct
  misc_feature 1..21: note = Synthetic Construct
  source 1..21: mol_type = other DNA
tggacttctggacccagcttt

SEQ ID NO: 7335 - DNA, 25 bp, synthetic construct
  misc_feature 1..25: note = Synthetic Construct
  source 1..25: mol_type = other DNA
tcaaggtcataatgcacacttttgc

SEQ ID NO: 7336 - DNA, 26 bp, synthetic construct
  misc_feature 1..26: note = Synthetic Construct
  source 1..26: mol_type = other DNA
gagatttcatgacaatggtcctcagt

SEQ ID NO: 7337 - DNA, 26 bp, synthetic construct
  misc_feature 1..26: note = Synthetic Construct
  source 1..26: mol_type = other DNA
attacattgatggggattgttttgca

SEQ ID NO: 7338 - DNA, 24 bp, synthetic construct
  misc_feature 1..24: note = Synthetic Construct
  source 1..24: mol_type = other DNA
aggacccaaactaggtctctttct

SEQ ID NO: 7339 - DNA, 23 bp, synthetic construct
  misc_feature 1..23: note = Synthetic Construct
  source 1..23: mol_type = other DNA
cattggtccttcaaccttgcttt

SEQ ID NO: 7340 - DNA, 25 bp, synthetic construct
  misc_feature 1..25: note = Synthetic Construct
  source 1..25: mol_type = other DNA
gacagacaaaagtctatggcatcca

SEQ ID NO: 7341 - DNA, 22 bp, synthetic construct
  misc_feature 1..22: note = Synthetic Construct
  source 1..22: mol_type = other DNA
caggtgtgcatggagatgtttg

SEQ ID NO: 7342 - DNA, 23 bp, synthetic construct
  misc_feature 1..23: note = Synthetic Construct
  source 1..23: mol_type = other DNA
ttggagctagggaagtggaggat

SEQ ID NO: 7343 - DNA, 24 bp, synthetic construct
  misc_feature 1..24: note = Synthetic Construct
  source 1..24: mol_type = other DNA
ggggatacaagaaggcacaaagct

SEQ ID NO: 7344 - DNA, 19 bp, synthetic construct
  misc_feature 1..19: note = Synthetic Construct
  source 1..19: mol_type = other DNA
tgcacagcctcagcatcct

SEQ ID NO: 7345 - DNA, 24 bp, synthetic construct
  misc_feature 1..24: note = Synthetic Construct
  source 1..24: mol_type = other DNA
gcaaggaagtttgtccagtatgca

SEQ ID NO: 7346 - DNA, 21 bp, synthetic construct
  misc_feature 1..21: note = Synthetic Construct
  source 1..21: mol_type = other DNA
aaggccaaaggtgggagcaat

SEQ ID NO: 7347 - DNA, 25 bp, synthetic construct
  misc_feature 1..25: note = Synthetic Construct
  source 1..25: mol_type = other DNA
gtctgagagaggagcagtctatact

SEQ ID NO: 7348 - DNA, 24 bp, synthetic construct
  misc_feature 1..24: note = Synthetic Construct
  source 1..24: mol_type = other DNA
gctccaccccaagatgttgttgaa

SEQ ID NO: 7349 - DNA, 23 bp, synthetic construct
  misc_feature 1..23: note = Synthetic Construct
  source 1..23: mol_type = other DNA
cccatgagtgacattctgcagta

SEQ ID NO: 7350 - DNA, 21 bp, synthetic construct
  misc_feature 1..21: note = Synthetic Construct
  source 1..21: mol_type = other DNA
accagtgggtatgctcagtct

SEQ ID NO: 7351 - DNA, 25 bp, synthetic construct
  misc_feature 1..25: note = Synthetic Construct
  source 1..25: mol_type = other DNA
cagttagagaaaagtgtggcttcct

SEQ ID NO: 7352 - DNA, 21 bp, synthetic construct
  misc_feature 1..21: note = Synthetic Construct
  source 1..21: mol_type = other DNA
aacccacactgccacgtttct

SEQ ID NO: 7353 - DNA, 25 bp, synthetic construct
  misc_feature 1..25: note = Synthetic Construct
  source 1..25: mol_type = other DNA
gagagtgacaggaagtgaagtctga

SEQ ID NO: 7354 - DNA, 22 bp, synthetic construct
  misc_feature 1..22: note = Synthetic Construct
  source 1..22: mol_type = other DNA
accaaggcctactggtttttcc

SEQ ID NO: 7355 - DNA, 24 bp, synthetic construct
  misc_feature 1..24: note = Synthetic Construct
  source 1..24: mol_type = other DNA
ggttttaagcactggcaggaccat

SEQ ID NO: 7356 - DNA, 24 bp, synthetic construct
  misc_feature 1..24: note = Synthetic Construct
  source 1..24: mol_type = other DNA
catgtctgtttgcctagtcaccaa

SEQ ID NO: 7357 - DNA, 23 bp, synthetic construct
  misc_feature 1..23: note = Synthetic Construct
  source 1..23: mol_type = other DNA
gcactagaacatcaacgcatctg

SEQ ID NO: 7358 - DNA, 24 bp, synthetic construct
  misc_feature 1..24: note = Synthetic Construct
  source 1..24: mol_type = other DNA
ggcctagagttgcaaccttacgaa

SEQ ID NO: 7359 - DNA, 22 bp, synthetic construct
  misc_feature 1..22: note = Synthetic Construct
  source 1..22: mol_type = other DNA
agttccctctctgctcttttgc

SEQ ID NO: 7360 - DNA, 25 bp, synthetic construct
  misc_feature 1..25: note = Synthetic Construct
  source 1..25: mol_type = other DNA
gggacatatgttgcaggtagagcta

SEQ ID NO: 7361 - DNA, 21 bp, synthetic construct
  misc_feature 1..21: note = Synthetic Construct
  source 1..21: mol_type = other DNA
tcagcctaccacactcacact

SEQ ID NO: 7362 - DNA, 22 bp, synthetic construct
  misc_feature 1..22: note = Synthetic Construct
  source 1..22: mol_type = other DNA
ccacaccagtttttgcggcaaa

SEQ ID NO: 7363 - DNA, 24 bp, synthetic construct
  misc_feature 1..24: note = Synthetic Construct
  source 1..24: mol_type = other DNA
agactagggggagacagaaaagtc

SEQ ID NO: 7364 - DNA, 24 bp, synthetic construct
  misc_feature 1..24: note = Synthetic Construct
  source 1..24: mol_type = other DNA
caaggagaatgtgccccttctaaa

SEQ ID NO: 7365 - DNA, 23 bp, synthetic construct
  misc_feature 1..23: note = Synthetic Construct
  source 1..23: mol_type = other DNA
gaggtgtgttgattgtgctacct

SEQ ID NO: 7366 - DNA, 22 bp, synthetic construct
  misc_feature 1..22: note = Synthetic Construct
  source 1..22: mol_type = other DNA
cgtggcaagtacctcacaactt

SEQ ID NO: 7367 - DNA, 27 bp, synthetic construct
  misc_feature 1..27: note = Synthetic Construct
  source 1..27: mol_type = other DNA
cgcttttatctggaatcaggaatgttg

SEQ ID NO: 7368 - DNA, 22 bp, synthetic construct
  misc_feature 1..22: note = Synthetic Construct
  source 1..22: mol_type = other DNA
cagcgcttaaccagacctaagt

SEQ ID NO: 7369 - DNA, 23 bp, synthetic construct
  misc_feature 1..23: note = Synthetic Construct
  source 1..23: mol_type = other DNA
gggccttatcaaagcctttcaca

SEQ ID NO: 7370 - DNA, 24 bp, synthetic construct
  misc_feature 1..24: note = Synthetic Construct
  source 1..24: mol_type = other DNA
gctctttgagaagacagcctccat

SEQ ID NO: 7371 - DNA, 24 bp, synthetic construct
  misc_feature 1..24: note = Synthetic Construct
  source 1..24: mol_type = other DNA
agctggagcacttgagtcatatcc

SEQ ID NO: 7372 - DNA, 25 bp, synthetic construct
  misc_feature 1..25: note = Synthetic Construct
  source 1..25: mol_type = other DNA
caacagtgcctatttcaaggtgttg

SEQ ID NO: 7373 - DNA, 25 bp, synthetic construct
  misc_feature 1..25: note = Synthetic Construct
  source 1..25: mol_type = other DNA
gatgaagccaacattattgctagct

SEQ ID NO: 7374 - DNA, 24 bp, synthetic construct
  misc_feature 1..24: note = Synthetic Construct
  source 1..24: mol_type = other DNA
ggacattggggggattggaaaaag

SEQ ID NO: 7375 - DNA, 20 bp, synthetic construct
  misc_feature 1..20: note = Synthetic Construct
  source 1..20: mol_type = other DNA
gggctctgatggcattgtga

SEQ ID NO: 7376 - DNA, 22 bp, synthetic construct
  misc_feature 1..22: note = Synthetic Construct
  source 1..22: mol_type = other DNA
cctgtgacaaagaggcaatgct

SEQ ID NO: 7377 - DNA, 22 bp, synthetic construct
  misc_feature 1..22: note = Synthetic Construct
  source 1..22: mol_type = other DNA
ccacaagcagtttgagctacct

SEQ ID NO: 7378 - DNA, 26 bp, synthetic construct
  misc_feature 1..26: note = Synthetic Construct
  source 1..26: mol_type = other DNA
ccaagtccttacaacattgcctctca

SEQ ID NO: 7379 - DNA, 20 bp, synthetic construct
  misc_feature 1..20: note = Synthetic Construct
  source 1..20: mol_type = other DNA
gtcacactcaaccccttgca

SEQ ID NO: 7380 - DNA, 25 bp, synthetic construct
  misc_feature 1..25: note = Synthetic Construct
  source 1..25: mol_type = other DNA
ccatatcatccatggtgcagaagac

SEQ ID NO: 7381 - DNA, 23 bp, synthetic construct
  misc_feature 1..23: note = Synthetic Construct
  source 1..23: mol_type = other DNA
ttcaaacgcacagcttgggactt

SEQ ID NO: 7382 - DNA, 21 bp, synthetic construct
  misc_feature 1..21: note = Synthetic Construct
  source 1..21: mol_type = other DNA
tccctgagagctggtgatgag

SEQ ID NO: 7383 - DNA, 21 bp, synthetic construct
  misc_feature 1..21: note = Synthetic Construct
  source 1..21: mol_type = other DNA
ttcccagtctgagctcttgca

SEQ ID NO: 7384 - DNA, 22 bp, synthetic construct
  misc_feature 1..22: note = Synthetic Construct
  source 1..22: mol_type = other DNA
ggccttttcccactgtgattgt

SEQ ID NO: 7385 - DNA, 25 bp, synthetic construct
  misc_feature 1..25: note = Synthetic Construct
  source 1..25: mol_type = other DNA
gttggtgactgattcgattgaggta

SEQ ID NO: 7386 - DNA, 21 bp, synthetic construct
  misc_feature 1..21: note = Synthetic Construct
  source 1..21: mol_type = other DNA
tctcgccagcattgtcctctt

SEQ ID NO: 7387 - DNA, 27 bp, synthetic construct
  misc_feature 1..27: note = Synthetic Construct
  source 1..27: mol_type = other DNA
ggagataatgtgtttacaggagtgtct

SEQ ID NO: 7388 - DNA, 27 bp, synthetic construct
  misc_feature 1..27: note = Synthetic Construct
  source 1..27: mol_type = other DNA
gcacacaaacttctgctcatttttagc

SEQ ID NO: 7389 - DNA, 23 bp, synthetic construct
  misc_feature 1..23: note = Synthetic Construct
  source 1..23: mol_type = other DNA
ctgacaggcacatctaagaagct

SEQ ID NO: 7390 - DNA, 19 bp, synthetic construct
  misc_feature 1..19: note = Synthetic Construct
  source 1..19: mol_type = other DNA
gctccgagggaaaggcatt

SEQ ID NO: 7391 - DNA, 20 bp, synthetic construct
  misc_feature 1..20: note = Synthetic Construct
  source 1..20: mol_type = other DNA
agcagatgggcctgttccaa

SEQ ID NO: 7392 - DNA, 22 bp, synthetic construct
  misc_feature 1..22: note = Synthetic Construct
  source 1..22: mol_type = other DNA
ctagacagtgtggctggaacat

SEQ ID NO: 7393 - DNA, 22 bp, synthetic construct
  misc_feature 1..22: note = Synthetic Construct
  source 1..22: mol_type = other DNA
cctgtgagctgggccatttttt

SEQ ID NO: 7394 - DNA, 22 bp, synthetic construct
  misc_feature 1..22: note = Synthetic Construct
  source 1..22: mol_type = other DNA
ggtggcatgctgaaatcagaag

SEQ ID NO: 7395 - DNA, 27 bp, synthetic construct
  misc_feature 1..27: note = Synthetic Construct
  source 1..27: mol_type = other DNA
cccaaaaaagatggaacagcctttgtc

SEQ ID NO: 7396 - DNA, 21 bp, synthetic construct
  misc_feature 1..21: note = Synthetic Construct
  source 1..21: mol_type = other DNA
tcttgaacagtgtgccatgct

SEQ ID NO: 7397 - DNA, 22 bp, synthetic construct
  misc_feature 1..22: note = Synthetic Construct
  source 1..22: mol_type = other DNA
tgaacatcttggtggggagaca

SEQ ID NO: 7398 - DNA, 25 bp, synthetic construct
  misc_feature 1..25: note = Synthetic Construct
  source 1..25: mol_type = other DNA
gttcaggaaacacttgctagaggaa

SEQ ID NO: 7399 - DNA, 23 bp, synthetic construct
  misc_feature 1..23: note = Synthetic Construct
  source 1..23: mol_type = other DNA
cagaaagttcatgcactgccttt

SEQ ID NO: 7400 - DNA, 20 bp, synthetic construct
  misc_feature 1..20: note = Synthetic Construct
  source 1..20: mol_type = other DNA
agaaggctgagtggggagtt

SEQ ID NO: 7401 - DNA, 22 bp, synthetic construct
  misc_feature 1..22: note = Synthetic Construct
  source 1..22: mol_type = other DNA
gccaacagcacttgtcatacca

SEQ ID NO: 7402 - DNA, 24 bp, synthetic construct
  misc_feature 1..24: note = Synthetic Construct
  source 1..24: mol_type = other DNA
ggccgggtagaatatgatcagaca

SEQ ID NO: 7403 - DNA, 22 bp, synthetic construct
  misc_feature 1..22: note = Synthetic Construct
  source 1..22: mol_type = other DNA
tgggcttgcaacagttggaact

SEQ ID NO: 7404 - DNA, 23 bp, synthetic construct
  misc_feature 1..23: note = Synthetic Construct
  source 1..23: mol_type = other DNA
tgggaggaacttgctggttttgg

SEQ ID NO: 7405 - DNA, 21 bp, synthetic construct
  misc_feature 1..21: note = Synthetic Construct
  source 1..21: mol_type = other DNA
tggctggaggttgtgatttgg

SEQ ID NO: 7406 - DNA, 21 bp, synthetic construct
  misc_feature 1..21: note = Synthetic Construct
  source 1..21: mol_type = other DNA
tgtgggggctaatggtttcct

SEQ ID NO: 7407 - DNA, 29 bp, synthetic construct
  misc_feature 1..29: note = Synthetic Construct
  source 1..29: mol_type = other DNA
ggaaggaatcactagtacttctagcctat

SEQ ID NO: 7408 - DNA, 22 bp, synthetic construct
  misc_feature 1..22: note = Synthetic Construct
  source 1..22: mol_type = other DNA
agcatacaagcaaccaggtgaa

SEQ ID NO: 7409 - DNA, 27 bp, synthetic construct
  misc_feature 1..27: note = Synthetic Construct
  source 1..27: mol_type = other DNA
tggatagaccgttctatgccatatcta

SEQ ID NO: 7410 - DNA, 23 bp, synthetic construct
  misc_feature 1..23: note = Synthetic Construct
  source 1..23: mol_type = other DNA
ggataacaaggggccagatagtg

SEQ ID NO: 7411 - DNA, 18 bp, synthetic construct
  misc_feature 1..18: note = Synthetic Construct
  source 1..18: mol_type = other DNA
gcggggggtctactcaga

SEQ ID NO: 7412 - DNA, 30 bp, synthetic construct
  misc_feature 1..30: note = Synthetic Construct
  source 1..30: mol_type = other DNA
catgagaaataataagtcattgctgcttca

SEQ ID NO: 7413 - DNA, 24 bp, synthetic construct
  misc_feature 1..24: note = Synthetic Construct
  source 1..24: mol_type = other DNA
ggtggaagaatgaggctgtacctt

SEQ ID NO: 7414 - DNA, 28 bp, synthetic construct
  misc_feature 1..28: note = Synthetic Construct
  source 1..28: mol_type = other DNA
caaagactgtatcctccataaagcctaa

SEQ ID NO: 7415 - DNA, 24 bp, synthetic construct
  misc_feature 1..24: note = Synthetic Construct
  source 1..24: mol_type = other DNA
atgtgaaggtagaagcatgtgtct

SEQ ID NO: 7416 - DNA, 19 bp, synthetic construct
  misc_feature 1..19: note = Synthetic Construct
  source 1..19: mol_type = other DNA
tccctcgctcatcccactt

SEQ ID NO: 7417 - DNA, 24 bp, synthetic construct
  misc_feature 1..24: note = Synthetic Construct
  source 1..24: mol_type = other DNA
agcttttgacaggacctcattcaa

SEQ ID NO: 7418 - DNA, 20 bp, synthetic construct
  misc_feature 1..20: note = Synthetic Construct
  source 1..20: mol_type = other DNA
ccgatccaagttgccatcct

SEQ ID NO: 7419 - DNA, 22 bp, synthetic construct
  misc_feature 1..22: note = Synthetic Construct
  source 1..22: mol_type = other DNA
tgctgcaggggttttggtgata

SEQ ID NO: 7420 - DNA, 26 bp, synthetic construct
  misc_feature 1..26: note = Synthetic Construct
  source 1..26: mol_type = other DNA
tgagcagtgacattgtagttaaagct

SEQ ID NO: 7421 - DNA, 24 bp, synthetic construct
  misc_feature 1..24: note = Synthetic Construct
  source 1..24: mol_type = other DNA
agggactgaggaacagcagtaatg

SEQ ID NO: 7422 - DNA, 22 bp, synthetic construct
  misc_feature 1..22: note = Synthetic Construct
  source 1..22: mol_type = other DNA
ggcagcttccaggagtaaagag

SEQ ID NO: 7423 - DNA, 24 bp, synthetic construct
  misc_feature 1..24: note = Synthetic Construct
  source 1..24: mol_type = other DNA
tgatggtcacacagctctcatagg

SEQ ID NO: 7424 - DNA, 20 bp, synthetic construct
  misc_feature 1..20: note = Synthetic Construct
  source 1..20: mol_type = other DNA
tgactgcagggtgtgactgt

SEQ ID NO: 7425 - DNA, 21 bp, synthetic construct
  misc_feature 1..21: note = Synthetic Construct
  source 1..21: mol_type = other DNA
ccacatgctaggctgggtaga

SEQ ID NO: 7426 - DNA, 24 bp, synthetic construct
  misc_feature 1..24: note = Synthetic Construct
  source 1..24: mol_type = other DNA
ccagatggagtggggtaaaatcac

SEQ ID NO: 7427 - DNA, 20 bp, synthetic construct
  misc_feature 1..20: note = Synthetic Construct
  source 1..20: mol_type = other DNA
cagttggcaagctggagact

SEQ ID NO: 7428 - DNA, 22 bp, synthetic construct
  misc_feature 1..22: note = Synthetic Construct
  source 1..22: mol_type = other DNA
ttgtccctgagtcagtggctta

SEQ ID NO: 7429 - DNA, 25 bp, synthetic construct
  misc_feature 1..25: note = Synthetic Construct
  source 1..25: mol_type = other DNA
cctcaagccctcttagtaggcataa

SEQ ID NO: 7430 - DNA, 22 bp, synthetic construct
  misc_feature 1..22: note = Synthetic Construct
  source 1..22: mol_type = other DNA
ctggtccagtcctttcttgctt

SEQ ID NO: 7431 - DNA, 25 bp, synthetic construct
  misc_feature 1..25: note = Synthetic Construct
  source 1..25: mol_type = other DNA
ccctgtcctttactcctaagagtct

SEQ ID NO: 7432 - DNA, 22 bp, synthetic construct
  misc_feature 1..22: note = Synthetic Construct
  source 1..22: mol_type = other DNA
tccacagttcagctcagtcact

SEQ ID NO: 7433 - DNA, 26 bp, synthetic construct
  misc_feature 1..26: note = Synthetic Construct
  source 1..26: mol_type = other DNA
cactgctccattttggcttatgtttt

SEQ ID NO: 7434 - DNA, 25 bp, synthetic construct
  misc_feature 1..25: note = Synthetic Construct
  source 1..25: mol_type = other DNA
cctgctgaacaccttggttatagtg

SEQ ID NO: 7435 - DNA, 22 bp, synthetic construct
  misc_feature 1..22: note = Synthetic Construct
  source 1..22: mol_type = other DNA
tgggttgtggggattggagaga

SEQ ID NO: 7436 - DNA, 20 bp, synthetic construct
  misc_feature 1..20: note = Synthetic Construct
  source 1..20: mol_type = other DNA
cggtgcagaggatggtgtga

SEQ ID NO: 7437 - DNA, 22 bp, synthetic construct
  misc_feature 1..22: note = Synthetic Construct
  source 1..22: mol_type = other DNA
ttctgtcacccccacacacttg

SEQ ID NO: 7438 - DNA, 22 bp, synthetic construct
  misc_feature 1..22: note = Synthetic Construct
  source 1..22: mol_type = other DNA
cgatggaggcagattgtagcaa

SEQ ID NO: 7439 - DNA, 24 bp, synthetic construct
  misc_feature 1..24: note = Synthetic Construct
  source 1..24: mol_type = other DNA
ctgttgcatgttgcttgaggctat

SEQ ID NO: 7440 - DNA, 25 bp, synthetic construct
  misc_feature 1..25: note = Synthetic Construct
  source 1..25: mol_type = other DNA
caaaccttgcaggtctgaccttcat

SEQ ID NO: 7441 - DNA, 24 bp, synthetic construct
  misc_feature 1..24: note = Synthetic Construct
  source 1..24: mol_type = other DNA
tcaacacctgagaaagactgttca

SEQ ID NO: 7442 - DNA, 26 bp, synthetic construct
  misc_feature 1..26: note = Synthetic Construct
  source 1..26: mol_type = other DNA
gactctccagttagatggaccaagag

SEQ ID NO: 7443 - DNA, 27 bp, synthetic construct
  misc_feature 1..27: note = Synthetic Construct
  source 1..27: mol_type = other DNA
ggttaaggagacagaatgttaccagtt

SEQ ID NO: 7444 - DNA, 19 bp, synthetic construct
  misc_feature 1..19: note = Synthetic Construct
  source 1..19: mol_type = other DNA
tggcatggcagtggcagaa

SEQ ID NO: 7445 - DNA, 25 bp, synthetic construct
  misc_feature 1..25: note = Synthetic Construct
  source 1..25: mol_type = other DNA
gttcccagagagtggtttatactgt

SEQ ID NO: 7446 - DNA, 24 bp, synthetic construct
  misc_feature 1..24: note = Synthetic Construct
  source 1..24: mol_type = other DNA
cctctcagaatgcaaatggtagga

SEQ ID NO: 7447 - DNA, 22 bp, synthetic construct
  misc_feature 1..22: note = Synthetic Construct
  source 1..22: mol_type = other DNA
tgcaacgaactttctcctccat

SEQ ID NO: 7448 - DNA, 21 bp, synthetic construct
  misc_feature 1..21: note = Synthetic Construct
  source 1..21: mol_type = other DNA
aagtcacaggggtggtttcca

SEQ ID NO: 7449 - DNA, 26 bp, synthetic construct
  misc_feature 1..26: note = Synthetic Construct
  source 1..26: mol_type = other DNA
gcaaagtccttacgaagtgagatgga

SEQ ID NO: 7450 - DNA, 25 bp, synthetic construct
  misc_feature 1..25: note = Synthetic Construct
  source 1..25: mol_type = other DNA
ggctgtgcatcttagggtcatgata

SEQ ID NO: 7451 - DNA, 22 bp, synthetic construct
  misc_feature 1..22: note = Synthetic Construct
  source 1..22: mol_type = other DNA
cttaagttggacgcagctgtct

SEQ ID NO: 7452 - DNA, 22 bp, synthetic construct
  misc_feature 1..22: note = Synthetic Construct
  source 1..22: mol_type = other DNA
accaacatgcaaacaggacaca

SEQ ID NO: 7453 - DNA, 21 bp, synthetic construct
  misc_feature 1..21: note = Synthetic Construct
  source 1..21: mol_type = other DNA
tcacgcagcctatgagtaggt

SEQ ID NO: 7454 - DNA, 21 bp, synthetic construct
  misc_feature 1..21: note = Synthetic Construct
  source 1..21: mol_type = other DNA
ggctctatcccttgccccaat

SEQ ID NO: 7455 - DNA, 20 bp, synthetic construct
  misc_feature 1..20: note = Synthetic Construct
  source 1..20: mol_type = other DNA
aacgcacagagcctgacttg

SEQ ID NO: 7456 - DNA, 22 bp, synthetic construct
  misc_feature 1..22: note = Synthetic Construct
  source 1..22: mol_type = other DNA
tgtgtcacagtctgccaaccta

SEQ ID NO: 7457 - DNA, 23 bp, synthetic construct
  misc_feature 1..23: note = Synthetic Construct
  source 1..23: mol_type = other DNA
ggccatcatccaattagggtttg

SEQ ID NO: 7458 - DNA, 26 bp, synthetic construct
  misc_feature 1..26: note = Synthetic Construct
  source 1..26: mol_type = other DNA
cagtgttatcttaatgggagcaccta

SEQ ID NO: 7459 - DNA, 27 bp, synthetic construct
  misc_feature 1..27: note = Synthetic Construct
  source 1..27: mol_type = other DNA
cccagctgtatctcaacaggtaagaag

SEQ ID NO: 7460 - DNA, 21 bp, synthetic construct
  misc_feature 1..21: note = Synthetic Construct
  source 1..21: mol_type = other DNA
aggacccagcactctgaggaa

SEQ ID NO: 7461 - DNA, 27 bp, synthetic construct
  misc_feature 1..27: note = Synthetic Construct
  source 1..27: mol_type = other DNA
ggactgcaaaagactgaatgataaggt

SEQ ID NO: 7462 - DNA, 24 bp, synthetic construct
  misc_feature 1..24: note = Synthetic Construct
  source 1..24: mol_type = other DNA
agtggcttataggtccctaatgca

SEQ ID NO: 7463 - DNA, 22 bp, synthetic construct
  misc_feature 1..22: note = Synthetic Construct
  source 1..22: mol_type = other DNA
tccgttttcagggctgggataa

SEQ ID NO: 7464 - DNA, 23 bp, synthetic construct
  misc_feature 1..23: note = Synthetic Construct
  source 1..23: mol_type = other DNA
cctgggtaagctgtcagtagcat

SEQ ID NO: 7465 - DNA, 24 bp, synthetic construct
  misc_feature 1..24: note = Synthetic Construct
  source 1..24: mol_type = other DNA
gttcagagctttgcctagatctca

SEQ ID NO: 7466 - DNA, 21 bp, synthetic construct
  misc_feature 1..21: note = Synthetic Construct
  source 1..21: mol_type = other DNA
gcagggcagaagctacacaga

SEQ ID NO: 7467 - DNA, 29 bp, synthetic construct
  misc_feature 1..29: note = Synthetic Construct
  source 1..29: mol_type = other DNA
acaaactacatgtaaaggcaggatagtag

SEQ ID NO: 7468 - DNA, 24 bp, synthetic construct
  misc_feature 1..24: note = Synthetic Construct
  source 1..24: mol_type = other DNA
caaattgcctggcttcacattctg

SEQ ID NO: 7469 - DNA, 23 bp, synthetic construct
  misc_feature 1..23: note = Synthetic Construct
  source 1..23: mol_type = other DNA
tctcacctcactgtcatctctgt

SEQ ID NO: 7470 - DNA, 21 bp, synthetic construct
  misc_feature 1..21: note = Synthetic Construct
  source 1..21: mol_type = other DNA
tcaggcctcactgagacatca

SEQ ID NO: 7471 - DNA, 20 bp, synthetic construct
  misc_feature 1..20: note = Synthetic Construct
  source 1..20: mol_type = other DNA
ttcagcatgctcgccactac

SEQ ID NO: 7472 - DNA, 22 bp, synthetic construct
  misc_feature 1..22: note = Synthetic Construct
  source 1..22: mol_type = other DNA
agcactggtctggaagtgagat

SEQ ID NO: 7473 - DNA, 19 bp, synthetic construct
  misc_feature 1..19: note = Synthetic Construct
  source 1..19: mol_type = other DNA
ccacagcccacgctactgt

SEQ ID NO: 7474 - DNA, 20 bp, synthetic construct
  misc_feature 1..20: note = Synthetic Construct
  source 1..20: mol_type = other DNA
gctctcctccctcccagtct

SEQ ID NO: 7475 - DNA, 21 bp, synthetic construct
  misc_feature 1..21: note = Synthetic Construct
  source 1..21: mol_type = other DNA
tccctccacccatcttatgca

SEQ ID NO: 7476 - DNA, 23 bp, synthetic construct
  misc_feature 1..23: note = Synthetic Construct
  source 1..23: mol_type = other DNA
tgctttggcatagtctccatctc

SEQ ID NO: 7477 - DNA, 23 bp, synthetic construct
  misc_feature 1..23: note = Synthetic Construct
  source 1..23: mol_type = other DNA
tggagactggtcatgtacacaca

SEQ ID NO: 7478 - DNA, 25 bp, synthetic construct
  misc_feature 1..25: note = Synthetic Construct
  source 1..25: mol_type = other DNA
ggtaatggcaaaagttcctcatgag

SEQ ID NO: 7479 - DNA, 22 bp, synthetic construct
  misc_feature 1..22: note = Synthetic Construct
  source 1..22: mol_type = other DNA
accaggaccacagttggaatcc

SEQ ID NO: 7480 - DNA, 23 bp, synthetic construct
  misc_feature 1..23: note = Synthetic Construct
  source 1..23: mol_type = other DNA
tcctgtgattgctttccctttga

SEQ ID NO: 7481 - DNA, 22 bp, synthetic construct
  misc_feature 1..22: note = Synthetic Construct
  source 1..22: mol_type = other DNA
agcagcaagtacagccatagag

SEQ ID NO: 7482 - DNA, 25 bp, synthetic construct
  misc_feature 1..25: note = Synthetic Construct
  source 1..25: mol_type = other DNA
aaaccacaattatcccccaaaacac

SEQ ID NO: 7483 - DNA, 21 bp, synthetic construct
  misc_feature 1..21: note = Synthetic Construct
  source 1..21: mol_type = other DNA
agctgtctgtgcactgatgtg

SEQ ID NO: 7484 - DNA, 24 bp, synthetic construct
  misc_feature 1..24: note = Synthetic Construct
  source 1..24: mol_type = other DNA
gccctcactcttcagggacaatag

SEQ ID NO: 7485 - DNA, 19 bp, synthetic construct
  misc_feature 1..19: note = Synthetic Construct
  source 1..19: mol_type = other DNA
ccgggtcaagcctgtgaca

SEQ ID NO: 7486 - DNA, 23 bp, synthetic construct
  misc_feature 1..23: note = Synthetic Construct
  source 1..23: mol_type = other DNA
gtctctgggaagttgcatgtaca

SEQ ID NO: 7487 - DNA, 21 bp, synthetic construct
  misc_feature 1..21: note = Synthetic Construct
  source 1..21: mol_type = other DNA
atcctgggacaccggtagcat

SEQ ID NO: 7488 - DNA, 20 bp, synthetic construct
  misc_feature 1..20: note = Synthetic Construct
  source 1..20: mol_type = other DNA
aagcagggctgtgagttgtg

SEQ ID NO: 7489 - DNA, 23 bp, synthetic construct
  misc_feature 1..23: note = Synthetic Construct
  source 1..23: mol_type = other DNA
accgagggtgtctttatcaaggt

SEQ ID NO: 7490 - DNA, 21 bp, synthetic construct
  misc_feature 1..21: note = Synthetic Construct
  source 1..21: mol_type = other DNA
agaaggccacgtgtcacaaga

SEQ ID NO: 7491 - DNA, 22 bp, synthetic construct
  misc_feature 1..22: note = Synthetic Construct
  source 1..22: mol_type = other DNA
ggcgagagagacaaaggattca

SEQ ID NO: 7492 - DNA, 24 bp, synthetic construct
  misc_feature 1..24: note = Synthetic Construct
  source 1..24: mol_type = other DNA
gtgtgtgtgtttatccaggttcac

SEQ ID NO: 7493 - DNA, 19 bp, synthetic construct
  misc_feature 1..19: note = Synthetic Construct
  source 1..19: mol_type = other DNA
gccaggctgcacagatcag

SEQ ID NO: 7494 - DNA, 21 bp, synthetic construct
  misc_feature 1..21: note = Synthetic Construct
  source 1..21: mol_type = other DNA
tgctgagacggtggatttgtg

SEQ ID NO: 7495 - DNA, 22 bp, synthetic construct
  misc_feature 1..22: note = Synthetic Construct
  source 1..22: mol_type = other DNA
agacagatgggtgcatcaagga

SEQ ID NO: 7496 - DNA, 22 bp, synthetic construct
  misc_feature 1..22: note = Synthetic Construct
  source 1..22: mol_type = other DNA
tgccagtgcatttgaaggatga

SEQ ID NO: 7497 - DNA, 22 bp, synthetic construct
  misc_feature 1..22: note = Synthetic Construct
  source 1..22: mol_type = other DNA
actgctgcgtcctaaagaagac

SEQ ID NO: 7498 - DNA, 26 bp, synthetic construct
  misc_feature 1..26: note = Synthetic Construct
  source 1..26: mol_type = other DNA
agctggcaccaaatttatcacataag

SEQ ID NO: 7499 - DNA, 26 bp, synthetic construct
  misc_feature 1..26: note = Synthetic Construct
  source 1..26: mol_type = other DNA
ctactgtttaacttctggggatcact

SEQ ID NO: 7500 - DNA, 24 bp, synthetic construct
  misc_feature 1..24: note = Synthetic Construct
  source 1..24: mol_type = other DNA
gggtggaatggagatcagaaactg

SEQ ID NO: 7501 - DNA, 22 bp, synthetic construct
  misc_feature 1..22: note = Synthetic Construct
  source 1..22: mol_type = other DNA
actttagggccagctgttttct

SEQ ID NO: 7502 - DNA, 28 bp, synthetic construct
  misc_feature 1..28: note = Synthetic Construct
  source 1..28: mol_type = other DNA
acaaagctatactaaacgatctgtctca

SEQ ID NO: 7503 - DNA, 23 bp, synthetic construct
  misc_feature 1..23: note = Synthetic Construct
  source 1..23: mol_type = other DNA
aagttgagaccagtgtcattgct

SEQ ID NO: 7504 - DNA, 20 bp, synthetic construct
  misc_feature 1..20: note = Synthetic Construct
  source 1..20: mol_type = other DNA
acgctccacatgtggcaaat

SEQ ID NO: 7505 - DNA, 19 bp, synthetic construct
  misc_feature 1..19: note = Synthetic Construct
  source 1..19: mol_type = other DNA
ccacccccacctcaagcta

SEQ ID NO: 7506 - DNA, 26 bp, synthetic construct
  misc_feature 1..26: note = Synthetic Construct
  source 1..26: mol_type = other DNA
gggtactctggactttttgcatttgg

SEQ ID NO: 7507 - DNA, 24 bp, synthetic construct
  misc_feature 1..24: note = Synthetic Construct
  source 1..24: mol_type = other DNA
gcctaggaagtgaagaaccaaagc

SEQ ID NO: 7508 - DNA, 21 bp, synthetic construct
  misc_feature 1..21: note = Synthetic Construct
  source 1..21: mol_type = other DNA
agcacccaggcttcaaacact

SEQ ID NO: 7509 - DNA, 25 bp, synthetic construct
  misc_feature 1..25: note = Synthetic Construct
  source 1..25: mol_type = other DNA
cctcactcaggaagaatgtgtcctt

SEQ ID NO: 7510 - DNA, 24 bp, synthetic construct
  misc_feature 1..24: note = Synthetic Construct
  source 1..24: mol_type = other DNA
gagccatcttcctgccttttaaga

SEQ ID NO: 7511 - DNA, 25 bp, synthetic construct
  misc_feature 1..25: note = Synthetic Construct
  source 1..25: mol_type = other DNA
gctactcactcaagacctctgtcaa

SEQ ID NO: 7512 - DNA, 24 bp, synthetic construct
  misc_feature 1..24: note = Synthetic Construct
  source 1..24: mol_type = other DNA
ggtgcttggaaatgggctaaattg

SEQ ID NO: 7513 - DNA, 21 bp, synthetic construct
  misc_feature 1..21: note = Synthetic Construct
  source 1..21: mol_type = other DNA
agtttccctctgtcgcagtct

SEQ ID NO: 7514 - DNA, 22 bp, synthetic construct
  misc_feature 1..22: note = Synthetic Construct
  source 1..22: mol_type = other DNA
gacaattgctcagctcctctgt

SEQ ID NO: 7515 - DNA, 22 bp, synthetic construct
  misc_feature 1..22: note = Synthetic Construct
  source 1..22: mol_type = other DNA
cctgtacagcatctgtcgctat

SEQ ID NO: 7516 - DNA, 24 bp, synthetic construct
  misc_feature 1..24: note = Synthetic Construct
  source 1..24: mol_type = other DNA
ggtggttgaggtcaggtcaatgaa

SEQ ID NO: 7517 - DNA, 24 bp, synthetic construct
  misc_feature 1..24: note = Synthetic Construct
  source 1..24: mol_type = other DNA
gtggtggaatgcctctagattgtg

SEQ ID NO: 7518 - DNA, 23 bp, synthetic construct
  misc_feature 1..23: note = Synthetic Construct
  source 1..23: mol_type = other DNA
tgcggtccaggtatcatctaggt

SEQ ID NO: 7519 - DNA, 23 bp, synthetic construct
  misc_feature 1..23: note = Synthetic Construct
  source 1..23: mol_type = other DNA
ggccaagttctgggataacaaca

SEQ ID NO: 7520 - DNA, 22 bp, synthetic construct
  misc_feature 1..22: note = Synthetic Construct
  source 1..22: mol_type = other DNA
gcagaaatgggagcagttcaca

SEQ ID NO: 7521 - DNA, 24 bp, synthetic construct
  misc_feature 1..24: note = Synthetic Construct
  source 1..24: mol_type = other DNA
ggacagcaggcatttcctagtcaa

SEQ ID NO: 7522 - DNA, 22 bp, synthetic construct
  misc_feature 1..22: note = Synthetic Construct
  source 1..22: mol_type = other DNA
agcaaggaaaggggtcaccaaa

SEQ ID NO: 7523 - DNA, 24 bp, synthetic construct
  misc_feature 1..24: note = Synthetic Construct
  source 1..24: mol_type = other DNA
ggaaccaagcttgtttgcatttgc

SEQ ID NO: 7524 - DNA, 24 bp, synthetic construct
  misc_feature 1..24: note = Synthetic Construct
  source 1..24: mol_type = other DNA
ggaggaataccaatcagacgacaa

SEQ ID NO: 7525 - DNA, 22 bp, synthetic construct
  misc_feature 1..22: note = Synthetic Construct
  source 1..22: mol_type = other DNA
gggttgcttccaaggtcacttt

SEQ ID NO: 7526 - DNA, 22 bp, synthetic construct
  misc_feature 1..22: note = Synthetic Construct
  source 1..22: mol_type = other DNA
ccgtggttctacaagcaaccaa

SEQ ID NO: 7527 - DNA, 22 bp, synthetic construct
  misc_feature 1..22: note = Synthetic Construct
  source 1..22: mol_type = other DNA
tgccacttggagactgtgatca

SEQ ID NO: 7528 - DNA, 23 bp, synthetic construct
  misc_feature 1..23: note = Synthetic Construct
  source 1..23: mol_type = other DNA
tggtgggtggcaaggagtgatat

SEQ ID NO: 7529 - DNA, 24 bp, synthetic construct
  misc_feature 1..24: note = Synthetic Construct
  source 1..24: mol_type = other DNA
ctcaaactcctggcttcatatggt

SEQ ID NO: 7530 - DNA, 22 bp, synthetic construct
  misc_feature 1..22: note = Synthetic Construct
  source 1..22: mol_type = other DNA
cagcagcaacaaggagatctga

SEQ ID NO: 7531 - DNA, 19 bp, synthetic construct
  misc_feature 1..19: note = Synthetic Construct
  source 1..19: mol_type = other DNA
tgcactcctgcctgttctg

SEQ ID NO: 7532 - DNA, 25 bp, synthetic construct
  misc_feature 1..25: note = Synthetic Construct
  source 1..25: mol_type = other DNA
aactggattttttcctagggctaca

SEQ ID NO: 7533 - DNA, 23 bp, synthetic construct
  misc_feature 1..23: note = Synthetic Construct
  source 1..23: mol_type = other DNA
gccactctgccaatcttatttgc

SEQ ID NO: 7534 - DNA, 26 bp, synthetic construct
  misc_feature 1..26: note = Synthetic Construct
  source 1..26: mol_type = other DNA
cctatgggctttacaattggagtaga

SEQ ID NO: 7535 - DNA, 25 bp, synthetic construct
  misc_feature 1..25: note = Synthetic Construct
  source 1..25: mol_type = other DNA
gaaaaggcaacagattacgtcaaca

SEQ ID NO: 7536 - DNA, 25 bp, synthetic construct
  misc_feature 1..25: note = Synthetic Construct
  source 1..25: mol_type = other DNA
ggactaggcaacagaggatatgaac

SEQ ID NO: 7537 - DNA, 28 bp, synthetic construct
  misc_feature 1..28: note = Synthetic Construct
  source 1..28: mol_type = other DNA
agaggtgtagagttatttgcactgtatc

SEQ ID NO: 7538 - DNA, 23 bp, synthetic construct
  misc_feature 1..23: note = Synthetic Construct
  source 1..23: mol_type = other DNA
acctctggggtcttggtatacat

SEQ ID NO: 7539 - DNA, 24 bp, synthetic construct
  misc_feature 1..24: note = Synthetic Construct
  source 1..24: mol_type = other DNA
gatggagagagatggtccaaagac

SEQ ID NO: 7540 - DNA, 21 bp, synthetic construct
  misc_feature 1..21: note = Synthetic Construct
  source 1..21: mol_type = other DNA
gtaagcgtgctggaggatgaa

SEQ ID NO: 7541 - DNA, 26 bp, synthetic construct
  misc_feature 1..26: note = Synthetic Construct
  source 1..26: mol_type = other DNA
cccttcccttgaatgtgttgaaagtg

SEQ ID NO: 7542 - DNA, 24 bp, synthetic construct
  misc_feature 1..24: note = Synthetic Construct
  source 1..24: mol_type = other DNA
tcaaccccatctgaggacattgag

SEQ ID NO: 7543 - DNA, 24 bp, synthetic construct
  misc_feature 1..24: note = Synthetic Construct
  source 1..24: mol_type = other DNA
gcagagaagagaacagctgctttc

SEQ ID NO: 7544 - DNA, 22 bp, synthetic construct
  misc_feature 1..22: note = Synthetic Construct
  source 1..22: mol_type = other DNA
ctgtaggacaagcatggaagca

SEQ ID NO: 7545 - DNA, 21 bp, synthetic construct
  misc_feature 1..21: note = Synthetic Construct
  source 1..21: mol_type = other DNA
tcagggtttcagctgctggaa

SEQ ID NO: 7546 - DNA, 26 bp, synthetic construct
  misc_feature 1..26: note = Synthetic Construct
  source 1..26: mol_type = other DNA
ccaagattgtgatggaaattcccaaa

SEQ ID NO: 7547 - DNA, 25 bp, synthetic construct
  misc_feature 1..25: note = Synthetic Construct
  source 1..25: mol_type = other DNA
ctggataaaagtggggagcttaagg

SEQ ID NO: 7548 - DNA, 25 bp, synthetic construct
  misc_feature 1..25: note = Synthetic Construct
  source 1..25: mol_type = other DNA
gctctgtctccaatgtgtttttgtg

SEQ ID NO: 7549 - DNA, 23 bp, synthetic construct
  misc_feature 1..23: note = Synthetic Construct
  source 1..23: mol_type = other DNA
agcacaggagctgcagagtgaaa

SEQ ID NO: 7550 - DNA, 24 bp, synthetic construct
  misc_feature 1..24: note = Synthetic Construct
  source 1..24: mol_type = other DNA
tgagcccttgaattacaggagaga

SEQ ID NO: 7551 - DNA, 21 bp, synthetic construct
  misc_feature 1..21: note = Synthetic Construct
  source 1..21: mol_type = other DNA
tcctcccttgacccatgttct

SEQ ID NO: 7552 - DNA, 27 bp, synthetic construct
  misc_feature 1..27: note = Synthetic Construct
  source 1..27: mol_type = other DNA
ggcctgaaggtaatgattcttatcaca

SEQ ID NO: 7553 - DNA, 21 bp, synthetic construct
  misc_feature 1..21: note = Synthetic Construct
  source 1..21: mol_type = other DNA
acacagcaaaggcaggctctt

SEQ ID NO: 7554 - DNA, 23 bp, synthetic construct
  misc_feature 1..23: note = Synthetic Construct
  source 1..23: mol_type = other DNA
cagaacctggagctgtgaattca

SEQ ID NO: 7555 - DNA, 20 bp, synthetic construct
  misc_feature 1..20: note = Synthetic Construct
  source 1..20: mol_type = other DNA
atcccatccggagccaaagg

SEQ ID NO: 7556 - DNA, 24 bp, synthetic construct
  misc_feature 1..24: note = Synthetic Construct
  source 1..24: mol_type = other DNA
tgtccaggttgcatactacacaac

SEQ ID NO: 7557 - DNA, 27 bp, synthetic construct
  misc_feature 1..27: note = Synthetic Construct
  source 1..27: mol_type = other DNA
gggtaacaaatgggtcaggtatattgg

SEQ ID NO: 7558 - DNA, 27 bp, synthetic construct
  misc_feature 1..27: note = Synthetic Construct
  source 1..27: mol_type = other DNA
cctgtaatggagttgatggggatttaa

SEQ ID NO: 7559 - DNA, 20 bp, synthetic construct
  misc_feature 1..20: note = Synthetic Construct
  source 1..20: mol_type = other DNA
ggtgggtgtgggtgtcatct

SEQ ID NO: 7560 - DNA, 26 bp, synthetic construct
  misc_feature 1..26: note = Synthetic Construct
  source 1..26: mol_type = other DNA
gatgtgaatgatgtgttacggtaacc

SEQ ID NO: 7561 - DNA, 21 bp, synthetic construct
  misc_feature 1..21: note = Synthetic Construct
  source 1..21: mol_type = other DNA
cgggtgtctgtcgagtaacag

SEQ ID NO: 7562 - DNA, 25 bp, synthetic construct
  misc_feature 1..25: note = Synthetic Construct
  source 1..25: mol_type = other DNA
acaagcttgggatagtctgttgatt

SEQ ID NO: 7563 - DNA, 25 bp, synthetic construct
  misc_feature 1..25: note = Synthetic Construct
  source 1..25: mol_type = other DNA
cagagaagtggcaaggagaagtttg

SEQ ID NO: 7564 - DNA, 24 bp, synthetic construct
  misc_feature 1..24: note = Synthetic Construct
  source 1..24: mol_type = other DNA
aaactgggtctgaacttggaatct

SEQ ID NO: 7565 - DNA, 21 bp, synthetic construct
  misc_feature 1..21: note = Synthetic Construct
  source 1..21: mol_type = other DNA
acaagccagtgtgcccattaa

SEQ ID NO: 7566 - DNA, 23 bp, synthetic construct
  misc_feature 1..23: note = Synthetic Construct
  source 1..23: mol_type = other DNA
ttgaggtcaggaatcccaagttc

SEQ ID NO: 7567 - DNA, 22 bp, synthetic construct
  misc_feature 1..22: note = Synthetic Construct
  source 1..22: mol_type = other DNA
tgaactgtgccttccactgaca

SEQ ID NO: 7568 - DNA, 25 bp, synthetic construct
  misc_feature 1..25: note = Synthetic Construct
  source 1..25: mol_type = other DNA
cagtggtttcttctttgcagtagct

SEQ ID NO: 7569 - DNA, 23 bp, synthetic construct
  misc_feature 1..23: note = Synthetic Construct
  source 1..23: mol_type = other DNA
gccaccaaagacttatggagtgt

SEQ ID NO: 7570 - DNA, 24 bp, synthetic construct
  misc_feature 1..24: note = Synthetic Construct
  source 1..24: mol_type = other DNA
aggccagattggatctccatgaga

SEQ ID NO: 7571 - DNA, 20 bp, synthetic construct
  misc_feature 1..20: note = Synthetic Construct
  source 1..20: mol_type = other DNA
tctcgtgcactggaagcaaa

SEQ ID NO: 7572 - DNA, 22 bp, synthetic construct
  misc_feature 1..22: note = Synthetic Construct
  source 1..22: mol_type = other DNA
agcagtagcatctcctctctgt

SEQ ID NO: 7573 - DNA, 22 bp, synthetic construct
  misc_feature 1..22: note = Synthetic Construct
  source 1..22: mol_type = other DNA
gccgactcattctccctatgca

SEQ ID NO: 7574 - DNA, 22 bp, synthetic construct
  misc_feature 1..22: note = Synthetic Construct
  source 1..22: mol_type = other DNA
agaaagcaagctgcatggagat

SEQ ID NO: 7575 - DNA, 27 bp, synthetic construct
  misc_feature 1..27: note = Synthetic Construct
  source 1..27: mol_type = other DNA
gcctacttctcacatcacagctctcta

SEQ ID NO: 7576 - DNA, 28 bp, synthetic construct
  misc_feature 1..28: note = Synthetic Construct
  source 1..28: mol_type = other DNA
actagaatgtggaaaccctaaattcaga

SEQ ID NO: 7577 - DNA, 23 bp, synthetic construct
  misc_feature 1..23: note = Synthetic Construct
  source 1..23: mol_type = other DNA
gcttgcaggaatctaaccctgta

SEQ ID NO: 7578 - DNA, 24 bp, synthetic construct
  misc_feature 1..24: note = Synthetic Construct
  source 1..24: mol_type = other DNA
atctctgggagttgagttgttgag

SEQ ID NO: 7579 - DNA, 21 bp, synthetic construct
  misc_feature 1..21: note = Synthetic Construct
  source 1..21: mol_type = other DNA
ccatgcttcagtgtgcaagag

SEQ ID NO: 7580 - DNA, 20 bp, synthetic construct
  misc_feature 1..20: note = Synthetic Construct
  source 1..20: mol_type = other DNA
agggtgagaacggagtgcat

SEQ ID NO: 7581 - DNA, 22 bp, synthetic construct
  misc_feature 1..22: note = Synthetic Construct
  source 1..22: mol_type = other DNA
gcacctcaccttccccatcatt

SEQ ID NO: 7582 - DNA, 22 bp, synthetic construct
  misc_feature 1..22: note = Synthetic Construct
  source 1..22: mol_type = other DNA
ggctgtggtattgaacctccaa

SEQ ID NO: 7583 - DNA, 24 bp, synthetic construct
  misc_feature 1..24: note = Synthetic Construct
  source 1..24: mol_type = other DNA
ggtgaacaggtgatgtcgacttga

SEQ ID NO: 7584 - DNA, 22 bp, synthetic construct
  misc_feature 1..22: note = Synthetic Construct
  source 1..22: mol_type = other DNA
tgtcctctgtctcagccatgtg

SEQ ID NO: 7585 - DNA, 19 bp, synthetic construct
  misc_feature 1..19: note = Synthetic Construct
  source 1..19: mol_type = other DNA
tgctgttcaggcccactct

SEQ ID NO: 7586 - DNA, 24 bp, synthetic construct
  misc_feature 1..24: note = Synthetic Construct
  source 1..24: mol_type = other DNA
gctcagcagggggattattctaca

SEQ ID NO: 7587 - DNA, 21 bp, synthetic construct
  misc_feature 1..21: note = Synthetic Construct
  source 1..21: mol_type = other DNA
tgaagcctgggtgtagctttg

SEQ ID NO: 7588 - DNA, 20 bp, synthetic construct
  misc_feature 1..20: note = Synthetic Construct
  source 1..20: mol_type = other DNA
ccagcacagggttggatacc

SEQ ID NO: 7589 - DNA, 22 bp, synthetic construct
  misc_feature 1..22: note = Synthetic Construct
  source 1..22: mol_type = other DNA
gccttggctcacagagtcatct

SEQ ID NO: 7590 - DNA, 20 bp, synthetic construct
  misc_feature 1..20: note = Synthetic Construct
  source 1..20: mol_type = other DNA
aaccggtgtgaggcaatacc

SEQ ID NO: 7591 - DNA, 22 bp, synthetic construct
  misc_feature 1..22: note = Synthetic Construct
  source 1..22: mol_type = other DNA
cgaacgctggttctttctttgc

SEQ ID NO: 7592 - DNA, 22 bp, synthetic construct
  misc_feature 1..22: note = Synthetic Construct
  source 1..22: mol_type = other DNA
ggatttgggctttcggctatct

SEQ ID NO: 7593 - DNA, 20 bp, synthetic construct
  misc_feature 1..20: note = Synthetic Construct
  source 1..20: mol_type = other DNA
gtggcttgggctagattgca

SEQ ID NO: 7594 - DNA, 25 bp, synthetic construct
  misc_feature 1..25: note = Synthetic Construct
  source 1..25: mol_type = other DNA
acaacagacaagcaatgttcattga

SEQ ID NO: 7595 - DNA, 21 bp, synthetic construct
  misc_feature 1..21: note = Synthetic Construct
  source 1..21: mol_type = other DNA
tggggtcaggggaatgtggat

SEQ ID NO: 7596 - DNA, 22 bp, synthetic construct
  misc_feature 1..22: note = Synthetic Construct
  source 1..22: mol_type = other DNA
ggacacacagcactctaaagct

SEQ ID NO: 7597 - DNA, 23 bp, synthetic construct
  misc_feature 1..23: note = Synthetic Construct
  source 1..23: mol_type = other DNA
ccagtgagtggtatctgttggaa

SEQ ID NO: 7598 - DNA, 22 bp, synthetic construct
  misc_feature 1..22: note = Synthetic Construct
  source 1..22: mol_type = other DNA
cgctttcgaagtctgactttcc

SEQ ID NO: 7599 - DNA, 21 bp, synthetic construct
  misc_feature 1..21: note = Synthetic Construct
  source 1..21: mol_type = other DNA
gatgccttctcctgctagcaa

SEQ ID NO: 7600 - DNA, 21 bp, synthetic construct
  misc_feature 1..21: note = Synthetic Construct
  source 1..21: mol_type = other DNA
tccactgccctacctttccat

SEQ ID NO: 7601 - DNA, 22 bp, synthetic construct
  misc_feature 1..22: note = Synthetic Construct
  source 1..22: mol_type = other DNA
gccagtttgcaacctctatgct

SEQ ID NO: 7602 - DNA, 19 bp, synthetic construct
  misc_feature 1..19: note = Synthetic Construct
  source 1..19: mol_type = other DNA
gcgtgggcctggatgttca

SEQ ID NO: 7603 - DNA, 26 bp, synthetic construct
  misc_feature 1..26: note = Synthetic Construct
  source 1..26: mol_type = other DNA
gctgtaaacagaggcatttggtacct

SEQ ID NO: 7604 - DNA, 22 bp, synthetic construct
  misc_feature 1..22: note = Synthetic Construct
  source 1..22: mol_type = other DNA
gtttggtgtagggagccacaat

SEQ ID NO: 7605 - DNA, 25 bp, synthetic construct
  misc_feature 1..25: note = Synthetic Construct
  source 1..25: mol_type = other DNA
gcaaccaacctgtattctcaaaagg

SEQ ID NO: 7606 - DNA, 24 bp, synthetic construct
  misc_feature 1..24: note = Synthetic Construct
  source 1..24: mol_type = other DNA
ggctggaagctaattttggtttgg

SEQ ID NO: 7607 - DNA, 24 bp, synthetic construct
  misc_feature 1..24: note = Synthetic Construct
  source 1..24: mol_type = other DNA
acacaccttggacagtctataacc

SEQ ID NO: 7608 - DNA, 22 bp, synthetic construct
  misc_feature 1..22: note = Synthetic Construct
  source 1..22: mol_type = other DNA
tttagccaggcatgagctacag

SEQ ID NO: 7609 - DNA, 22 bp, synthetic construct
  misc_feature 1..22: note = Synthetic Construct
  source 1..22: mol_type = other DNA
agattccacaaagggcccatct

SEQ ID NO: 7610 - DNA, 24 bp, synthetic construct
  misc_feature 1..24: note = Synthetic Construct
  source 1..24: mol_type = other DNA
gtctaacctatggccatgggattt

SEQ ID NO: 7611 - DNA, 26 bp, synthetic construct
  misc_feature 1..26: note = Synthetic Construct
  source 1..26: mol_type = other DNA
cgttgaggaaagtttcaagggaggat

SEQ ID NO: 7612 - DNA, 20 bp, synthetic construct
  misc_feature 1..20: note = Synthetic Construct
  source 1..20: mol_type = other DNA
aaatggctgcaggtgtcaca

SEQ ID NO: 7613 - DNA, 21 bp, synthetic construct
  misc_feature 1..21: note = Synthetic Construct
  source 1..21: mol_type = other DNA
cccccatcctacacagagcaa

SEQ ID NO: 7614 - DNA, 25 bp, synthetic construct
  misc_feature 1..25: note = Synthetic Construct
  source 1..25: mol_type = other DNA
gacaaagtcttcatggtggttttca

SEQ ID NO: 7615 - DNA, 28 bp, synthetic construct
  misc_feature 1..28: note = Synthetic Construct
  source 1..28: mol_type = other DNA
ggaaatgctagtacctactgctctatcc

SEQ ID NO: 7616 - DNA, 20 bp, synthetic construct
  misc_feature 1..20: note = Synthetic Construct
  source 1..20: mol_type = other DNA
ggggaggctttctgctccta

SEQ ID NO: 7617 - DNA, 24 bp, synthetic construct
  misc_feature 1..24: note = Synthetic Construct
  source 1..24: mol_type = other DNA
ggatgggttcagttgcattttgtc

SEQ ID NO: 7618 - DNA, 23 bp, synthetic construct
  misc_feature 1..23: note = Synthetic Construct
  source 1..23: mol_type = other DNA
gaagccaggaaatgacgtaggat

SEQ ID NO: 7619 - DNA, 25 bp, synthetic construct
  misc_feature 1..25: note = Synthetic Construct
  source 1..25: mol_type = other DNA
ctgggaatttgtggttaacattggt

SEQ ID NO: 7620 - DNA, 22 bp, synthetic construct
  misc_feature 1..22: note = Synthetic Construct
  source 1..22: mol_type = other DNA
ccgattcacagtgctgctttca

SEQ ID NO: 7621 - DNA, 25 bp, synthetic construct
  misc_feature 1..25: note = Synthetic Construct
  source 1..25: mol_type = other DNA
ccccagctatactcacaacagtgat

SEQ ID NO: 7622 - DNA, 22 bp, synthetic construct
  misc_feature 1..22: note = Synthetic Construct
  source 1..22: mol_type = other DNA
tgggcagttcagcttgttgtgt

SEQ ID NO: 7623 - DNA, 25 bp, synthetic construct
  misc_feature 1..25: note = Synthetic Construct
  source 1..25: mol_type = other DNA
agagctgataatacaccctgactgt

SEQ ID NO: 7624 - DNA, 24 bp, synthetic construct
  misc_feature 1..24: note = Synthetic Construct
  source 1..24: mol_type = other DNA
cagcagttggggttattccagaag

SEQ ID NO: 7625 - DNA, 24 bp, synthetic construct
  misc_feature 1..24: note = Synthetic Construct
  source 1..24: mol_type = other DNA
cattctgaactagccacggtactg

SEQ ID NO: 7626 - DNA, 22 bp, synthetic construct
  misc_feature 1..22: note = Synthetic Construct
  source 1..22: mol_type = other DNA
ccctaatgatgggcacaaggtt

SEQ ID NO: 7627 - DNA, 21 bp, synthetic construct
  misc_feature 1..21: note = Synthetic Construct
  source 1..21: mol_type = other DNA
cccagctcctccacggtctgt

SEQ ID NO: 7628 - DNA, 22 bp, synthetic construct
  misc_feature 1..22: note = Synthetic Construct
  source 1..22: mol_type = other DNA
gcttggaaatgtggcactgagt

SEQ ID NO: 7629 - DNA, 22 bp, synthetic construct
  misc_feature 1..22: note = Synthetic Construct
  source 1..22: mol_type = other DNA
tggagtggggactgagttcatt

SEQ ID NO: 7630 - DNA, 21 bp, synthetic construct
  misc_feature 1..21: note = Synthetic Construct
  source 1..21: mol_type = other DNA
agctgtaagacctggggcttt

SEQ ID NO: 7631 - DNA, 25 bp, synthetic construct
  misc_feature 1..25: note = Synthetic Construct
  source 1..25: mol_type = other DNA
gagatgtctctggtgcaaatacaga

SEQ ID NO: 7632 - DNA, 22 bp, synthetic construct
  misc_feature 1..22: note = Synthetic Construct
  source 1..22: mol_type = other DNA
agccaaaccctgctagcttacc

SEQ ID NO: 7633 - DNA, 22 bp, synthetic construct
  misc_feature 1..22: note = Synthetic Construct
  source 1..22: mol_type = other DNA
acccagtgaagctgatgcgtaa

SEQ ID NO: 7634 - DNA, 25 bp, synthetic construct
  misc_feature 1..25: note = Synthetic Construct
  source 1..25: mol_type = other DNA
gctcaaatcagttctgtctctggtt

SEQ ID NO: 7635 - DNA, 25 bp, synthetic construct
  misc_feature 1..25: note = Synthetic Construct
  source 1..25: mol_type = other DNA
gcactcactctggttaacagtggtt

SEQ ID NO: 7636 - DNA, 21 bp, synthetic construct
  misc_feature 1..21: note = Synthetic Construct
  source 1..21: mol_type = other DNA
agggcagactgggttgggtta

SEQ ID NO: 7637 - DNA, 24 bp, synthetic construct
  misc_feature 1..24: note = Synthetic Construct
  source 1..24: mol_type = other DNA
agggagaagacactctctcacctt

SEQ ID NO: 7638 - DNA, 22 bp, synthetic construct
  misc_feature 1..22: note = Synthetic Construct
  source 1..22: mol_type = other DNA
tggcaggataaaagcccctaag

SEQ ID NO: 7639 - DNA, 26 bp, synthetic construct
  misc_feature 1..26: note = Synthetic Construct
  source 1..26: mol_type = other DNA
gtctgcatgattgagatttgattgca

SEQ ID NO: 7640 - DNA, 22 bp, synthetic construct
  misc_feature 1..22: note = Synthetic Construct
  source 1..22: mol_type = other DNA
aggaagcctccagcaattacag

SEQ ID NO: 7641 - DNA, 23 bp, synthetic construct
  misc_feature 1..23: note = Synthetic Construct
  source 1..23: mol_type = other DNA
gtgccctattgtgggaaattagc

SEQ ID NO: 7642 - DNA, 24 bp, synthetic construct
  misc_feature 1..24: note = Synthetic Construct
  source 1..24: mol_type = other DNA
aggtacaagcactccttcaagtag

SEQ ID NO: 7643 - DNA, 26 bp, synthetic construct
  misc_feature 1..26: note = Synthetic Construct
  source 1..26: mol_type = other DNA
gcagataaaatcttggtgttcgtaca

SEQ ID NO: 7644 - DNA, 23 bp, synthetic construct
  misc_feature 1..23: note = Synthetic Construct
  source 1..23: mol_type = other DNA
gaaaagtgggtcaatgggagtca

SEQ ID NO: 7645 - DNA, 18 bp, synthetic construct
  misc_feature 1..18: note = Synthetic Construct
  source 1..18: mol_type = other DNA
tggcacctccggatctca

SEQ ID NO: 7646 - DNA, 22 bp, synthetic construct
  misc_feature 1..22: note = Synthetic Construct
  source 1..22: mol_type = other DNA
ctgtggtgagctcaaggatgtt

SEQ ID NO: 7647 - DNA, 26 bp, synthetic construct
  misc_feature 1..26: note = Synthetic Construct
  source 1..26: mol_type = other DNA
ccatagaacaaatctctgggttgatg

SEQ ID NO: 7648 - DNA, 24 bp, synthetic construct
  misc_feature 1..24: note = Synthetic Construct
  source 1..24: mol_type = other DNA
cctctccacatccagtcatccaat

SEQ ID NO: 7649 - DNA, 21 bp, synthetic construct
  misc_feature 1..21: note = Synthetic Construct
  source 1..21: mol_type = other DNA
gacctggagggctgagtgata

SEQ ID NO: 7650 - DNA, 29 bp, synthetic construct
  misc_feature 1..29: note = Synthetic Construct
  source 1..29: mol_type = other DNA
ctcaaagtaattgttgggattgaatgaga

SEQ ID NO: 7651 - DNA, 24 bp, synthetic construct
  misc_feature 1..24: note = Synthetic Construct
  source 1..24: mol_type = other DNA
ctgaaggcaggttgataagagcat

SEQ ID NO: 7652 - DNA, 27 bp, synthetic construct
  misc_feature 1..27: note = Synthetic Construct
  source 1..27: mol_type = other DNA
cctccagaacttttgttacagtaagga

SEQ ID NO: 7653 - DNA, 22 bp, synthetic construct
  misc_feature 1..22: note = Synthetic Construct
  source 1..22: mol_type = other DNA
agtacggaacaggaggaggaaa

SEQ ID NO: 7654 - DNA, 26 bp, synthetic construct
  misc_feature 1..26: note = Synthetic Construct
  source 1..26: mol_type = other DNA
cctttgtactgcagtctgcttctaac

SEQ ID NO: 7655 - DNA, 21 bp, synthetic construct
  misc_feature 1..21: note = Synthetic Construct
  source 1..21: mol_type = other DNA
aggggtcaagcagcagtttga

SEQ ID NO: 7656 - DNA, 26 bp, synthetic construct
  misc_feature 1..26: note = Synthetic Construct
  source 1..26: mol_type = other DNA
ctctgtgaatattctacccccatcaa

SEQ ID NO: 7657 - DNA, 22 bp, synthetic construct
  misc_feature 1..22: note = Synthetic Construct
  source 1..22: mol_type = other DNA
gctaggcgcataatccttctct

SEQ ID NO: 7658 - DNA, 27 bp, synthetic construct
  misc_feature 1..27: note = Synthetic Construct
  source 1..27: mol_type = other DNA
ccattgagaactttacttcccacatca

SEQ ID NO: 7659 - DNA, 21 bp, synthetic construct
  misc_feature 1..21: note = Synthetic Construct
  source 1..21: mol_type = other DNA
actcacgccgctatccctatt

SEQ ID NO: 7660 - DNA, 20 bp, synthetic construct
  misc_feature 1..20: note = Synthetic Construct
  source 1..20: mol_type = other DNA
cagacactgccacccatctg

SEQ ID NO: 7661 - DNA, 18 bp, synthetic construct
  misc_feature 1..18: note = Synthetic Construct
  source 1..18: mol_type = other DNA
tgctggtgcgaggagaga

SEQ ID NO: 7662 - DNA, 26 bp, synthetic construct
  misc_feature 1..26: note = Synthetic Construct
  source 1..26: mol_type = other DNA
cagccaaaccatatcattcactatgc

SEQ ID NO: 7663 - DNA, 18 bp, synthetic construct
  misc_feature 1..18: note = Synthetic Construct
  source 1..18: mol_type = other DNA
ctggctgccagggagtgt

SEQ ID NO: 7664 - DNA, 22 bp, synthetic construct
  misc_feature 1..22: note = Synthetic Construct
  source 1..22: mol_type = other DNA
gcataagccaggctgtagtaca

SEQ ID NO: 7665 - DNA, 23 bp, synthetic construct
  misc_feature 1..23: note = Synthetic Construct
  source 1..23: mol_type = other DNA
ggaaagaaaagggtgctctggat

SEQ ID NO: 7666 - DNA, 23 bp, synthetic construct
  misc_feature 1..23: note = Synthetic Construct
  source 1..23: mol_type = other DNA
gcagaacccctacaaagaaggta

SEQ ID NO: 7667 - DNA, 25 bp, synthetic construct
  misc_feature 1..25: note = Synthetic Construct
  source 1..25: mol_type = other DNA
ggtggtgttaagaagccaagaagat

SEQ ID NO: 7668 - DNA, 28 bp, synthetic construct
  misc_feature 1..28: note = Synthetic Construct
  source 1..28: mol_type = other DNA
gggtcaggaaaatattgtctggagtgtt

SEQ ID NO: 7669 - DNA, 22 bp, synthetic construct
  misc_feature 1..22: note = Synthetic Construct
  source 1..22: mol_type = other DNA
gcttttgcacttggctccttgt

SEQ ID NO: 7670 - DNA, 24 bp, synthetic construct
  misc_feature 1..24: note = Synthetic Construct
  source 1..24: mol_type = other DNA
tgcctcccaagtaggatagaactc

SEQ ID NO: 7671 - DNA, 25 bp, synthetic construct
  misc_feature 1..25: note = Synthetic Construct
  source 1..25: mol_type = other DNA
ccttctcattgctgagtgtttaacc

SEQ ID NO: 7672 - DNA, 21 bp, synthetic construct
  misc_feature 1..21: note = Synthetic Construct
  source 1..21: mol_type = other DNA
cctctcccctttgagcagaca

SEQ ID NO: 7673 - DNA, 25 bp, synthetic construct
  misc_feature 1..25: note = Synthetic Construct
  source 1..25: mol_type = other DNA
gaggcacaagataaagaggtttagc

SEQ ID NO: 7674 - DNA, 24 bp, synthetic construct
  misc_feature 1..24: note = Synthetic Construct
  source 1..24: mol_type = other DNA
gaataggaatgtgtggagcagaca

SEQ ID NO: 7675 - DNA, 21 bp, synthetic construct
  misc_feature 1..21: note = Synthetic Construct
  source 1..21: mol_type = other DNA
catgtgttgcaagccacatgt

SEQ ID NO: 7676 - DNA, 21 bp, synthetic construct
  misc_feature 1..21: note = Synthetic Construct
  source 1..21: mol_type = other DNA
agccctcccacctggtaacta

SEQ ID NO: 7677 - DNA, 18 bp, synthetic construct
  misc_feature 1..18: note = Synthetic Construct
  source 1..18: mol_type = other DNA
ccctgctgcccacatcag

SEQ ID NO: 7678 - DNA, 20 bp, synthetic construct
  misc_feature 1..20: note = Synthetic Construct
  source 1..20: mol_type = other DNA
tcattgctggcatgcatcca

SEQ ID NO: 7679 - DNA, 24 bp, synthetic construct
  misc_feature 1..24: note = Synthetic Construct
  source 1..24: mol_type = other DNA
cctttgcagtcaccaatgttttgt

SEQ ID NO: 7680 - DNA, 28 bp, synthetic construct
  misc_feature 1..28: note = Synthetic Construct
  source 1..28: mol_type = other DNA
cgagctataagtgatggagctagtatct

SEQ ID NO: 7681 - DNA, 22 bp, synthetic construct
  misc_feature 1..22: note = Synthetic Construct
  source 1..22: mol_type = other DNA
gaactggagctccacacttagg

SEQ ID NO: 7682 - DNA, 26 bp, synthetic construct
  misc_feature 1..26: note = Synthetic Construct
  source 1..26: mol_type = other DNA
ccagttctgaaggaggcatttatcag

SEQ ID NO: 7683 - DNA, 23 bp, synthetic construct
  misc_feature 1..23: note = Synthetic Construct
  source 1..23: mol_type = other DNA
gtgtacccactgtcactcatacc

SEQ ID NO: 7684 - DNA, 23 bp, synthetic construct
  misc_feature 1..23: note = Synthetic Construct
  source 1..23: mol_type = other DNA
gcagattttgacaagggttggaa

SEQ ID NO: 7685 - DNA, 24 bp, synthetic construct
  misc_feature 1..24: note = Synthetic Construct
  source 1..24: mol_type = other DNA
ccacagagctaggaaactcgtgaa

SEQ ID NO: 7686 - DNA, 23 bp, synthetic construct
  misc_feature 1..23: note = Synthetic Construct
  source 1..23: mol_type = other DNA
ttcctcggcccttcttcctgaga

SEQ ID NO: 7687 - DNA, 24 bp, synthetic construct
  misc_feature 1..24: note = Synthetic Construct
  source 1..24: mol_type = other DNA
aggggtgaaacaaatcatgcttct

SEQ ID NO: 7688 - DNA, 24 bp, synthetic construct
  misc_feature 1..24: note = Synthetic Construct
  source 1..24: mol_type = other DNA
aggaaccctgtccttgctttaacc

SEQ ID NO: 7689 - DNA, 25 bp, synthetic construct
  misc_feature 1..25: note = Synthetic Construct
  source 1..25: mol_type = other DNA
ggaaagtctgaacacacacttccat

SEQ ID NO: 7690 - DNA, 22 bp, synthetic construct
  misc_feature 1..22: note = Synthetic Construct
  source 1..22: mol_type = other DNA
aagccaaatacgcacccctaac

SEQ ID NO: 7691 - DNA, 25 bp, synthetic construct
  misc_feature 1..25: note = Synthetic Construct
  source 1..25: mol_type = other DNA
ggcctttcacaaactactccttcct

SEQ ID NO: 7692 - DNA, 23 bp, synthetic construct
  misc_feature 1..23: note = Synthetic Construct
  source 1..23: mol_type = other DNA
gtgtttgtgtgcagacactgtac

SEQ ID NO: 7693 - DNA, 23 bp, synthetic construct
  misc_feature 1..23: note = Synthetic Construct
  source 1..23: mol_type = other DNA
gtgcttgcttgagttctcagcta

SEQ ID NO: 7694 - DNA, 26 bp, synthetic construct
  misc_feature 1..26: note = Synthetic Construct
  source 1..26: mol_type = other DNA
gcaacagcatctttgatagggaacac

SEQ ID NO: 7695 - DNA, 22 bp, synthetic construct
  misc_feature 1..22: note = Synthetic Construct
  source 1..22: mol_type = other DNA
ggctggaaggaaaggcaaacat

SEQ ID NO: 7696 - DNA, 22 bp, synthetic construct
  misc_feature 1..22: note = Synthetic Construct
  source 1..22: mol_type = other DNA
agatccctgctgccctacatta

SEQ ID NO: 7697 - DNA, 23 bp, synthetic construct
  misc_feature 1..23: note = Synthetic Construct
  source 1..23: mol_type = other DNA
cctgagccacccaggactttttg

SEQ ID NO: 7698 - DNA, 26 bp, synthetic construct
  misc_feature 1..26: note = Synthetic Construct
  source 1..26: mol_type = other DNA
ttgccaccaatatcaggagtgtatag

SEQ ID NO: 7699 - DNA, 28 bp, synthetic construct
  misc_feature 1..28: note = Synthetic Construct
  source 1..28: mol_type = other DNA
tgtgagactctttggtacttaagtttgt

SEQ ID NO: 7700 - DNA, 20 bp, synthetic construct
  misc_feature 1..20: note = Synthetic Construct
  source 1..20: mol_type = other DNA
tgcctcacagccaagcttct

SEQ ID NO: 7701 - DNA, 25 bp, synthetic construct
  misc_feature 1..25: note = Synthetic Construct
  source 1..25: mol_type = other DNA
tgaagtaattgacggtctcagttct

SEQ ID NO: 7702 - DNA, 26 bp, synthetic construct
  misc_feature 1..26: note = Synthetic Construct
  source 1..26: mol_type = other DNA
cgtggttatcttgtcaatgggaactc

SEQ ID NO: 7703 - DNA, 29 bp, synthetic construct
  misc_feature 1..29: note = Synthetic Construct
  source 1..29: mol_type = other DNA
ggtcaagatggagcagtattttgatcatc

SEQ ID NO: 7704 - DNA, 22 bp, synthetic construct
  misc_feature 1..22: note = Synthetic Construct
  source 1..22: mol_type = other DNA
aacacctgccagtgtcaatgag

SEQ ID NO: 7705 - DNA, 22 bp, synthetic construct
  misc_feature 1..22: note = Synthetic Construct
  source 1..22: mol_type = other DNA
tgcctggaggtgaggtgtgttt

SEQ ID NO: 7706 - DNA, 23 bp, synthetic construct
  misc_feature 1..23: note = Synthetic Construct
  source 1..23: mol_type = other DNA
agattgaggtggcatttcctgaa

SEQ ID NO: 7707 - DNA, 21 bp, synthetic construct
  misc_feature 1..21: note = Synthetic Construct
  source 1..21: mol_type = other DNA
acacgggggttacagagatga

SEQ ID NO: 7708 - DNA, 25 bp, synthetic construct
  misc_feature 1..25: note = Synthetic Construct
  source 1..25: mol_type = other DNA
tgaaaagtagaagagtctgctgtgt

SEQ ID NO: 7709 - DNA, 25 bp, synthetic construct
  misc_feature 1..25: note = Synthetic Construct
  source 1..25: mol_type = other DNA
ggtttcacagggaggactggagtta

SEQ ID NO: 7710 - DNA, 25 bp, synthetic construct
  misc_feature 1..25: note = Synthetic Construct
  source 1..25: mol_type = other DNA
aggccattgggttaaatatccatca

SEQ ID NO: 7711 - DNA, 22 bp, synthetic construct
  misc_feature 1..22: note = Synthetic Construct
  source 1..22: mol_type = other DNA
gcaaactccacttcagcaggat

SEQ ID NO: 7712 - DNA, 18 bp, synthetic construct
  misc_feature 1..18: note = Synthetic Construct
  source 1..18: mol_type = other DNA
gctttctgccggcaagca

SEQ ID NO: 7713 - DNA, 25 bp, synthetic construct
  misc_feature 1..25: note = Synthetic Construct
  source 1..25: mol_type = other DNA
actaaggcaatggatttcaaatgca

SEQ ID NO: 7714 - DNA, 27 bp, synthetic construct
  misc_feature 1..27: note = Synthetic Construct
  source 1..27: mol_type = other DNA
ccaccaatttcagtagggttttatgca

SEQ ID NO: 7715 - DNA, 26 bp, synthetic construct
  misc_feature 1..26: note = Synthetic Construct
  source 1..26: mol_type = other DNA
ctcagacacacatcatagctctacag

SEQ ID NO: 7716 - DNA, 23 bp, synthetic construct
  misc_feature 1..23: note = Synthetic Construct
  source 1..23: mol_type = other DNA
agatctagaaccaaggccactga

SEQ ID NO: 7717 - DNA, 20 bp, synthetic construct
  misc_feature 1..20: note = Synthetic Construct
  source 1..20: mol_type = other DNA
ccatcagagccacccacact

SEQ ID NO: 7718 - DNA, 24 bp, synthetic construct
  misc_feature 1..24: note = Synthetic Construct
  source 1..24: mol_type = other DNA
ctaaggtggggattcacatcaaca

SEQ ID NO: 7719 - DNA, 22 bp, synthetic construct
  misc_feature 1..22: note = Synthetic Construct
  source 1..22: mol_type = other DNA
ccttgaactgttggctgtagca

SEQ ID NO: 7720 - DNA, 20 bp, synthetic construct
  misc_feature 1..20: note = Synthetic Construct
  source 1..20: mol_type = other DNA
accgttgagctgttgcaact

SEQ ID NO: 7721 - DNA, 24 bp, synthetic construct
  misc_feature 1..24: note = Synthetic Construct
  source 1..24: mol_type = other DNA
ctggtggctcaaaccgttagtgaa

SEQ ID NO: 7722 - DNA, 23 bp, synthetic construct
  misc_feature 1..23: note = Synthetic Construct
  source 1..23: mol_type = other DNA
gacattactggaagctgggttga

SEQ ID NO: 7723 - DNA, 22 bp, synthetic construct
  misc_feature 1..22: note = Synthetic Construct
  source 1..22: mol_type = other DNA
cttgggtgtgtttctcctgtct

SEQ ID NO: 7724 - DNA, 24 bp, synthetic construct
  misc_feature 1..24: note = Synthetic Construct
  source 1..24: mol_type = other DNA
gtaacccttccagtgattgagtca

SEQ ID NO: 7725 - DNA, 21 bp, synthetic construct
  misc_feature 1..21: note = Synthetic Construct
  source 1..21: mol_type = other DNA
cagcccagtgtctcagaacag

SEQ ID NO: 7726 - DNA, 24 bp, synthetic construct
  misc_feature 1..24: note = Synthetic Construct
  source 1..24: mol_type = other DNA
actcagctgaactattgccttctc

SEQ ID NO: 7727 - DNA, 22 bp, synthetic construct
  misc_feature 1..22: note = Synthetic Construct
  source 1..22: mol_type = other DNA
gcgtttgttcaggctcaaagtc

SEQ ID NO: 7728 - DNA, 22 bp, synthetic construct
  misc_feature 1..22: note = Synthetic Construct
  source 1..22: mol_type = other DNA
caggcggtggaattttctgcta

SEQ ID NO: 7729 - DNA, 20 bp, synthetic construct
  misc_feature 1..20: note = Synthetic Construct
  source 1..20: mol_type = other DNA
acaggagccaaaccggtact

SEQ ID NO: 7730 - DNA, 24 bp, synthetic construct
  misc_feature 1..24: note = Synthetic Construct
  source 1..24: mol_type = other DNA
caaccacagaagcagcagaagttg

SEQ ID NO: 7731 - DNA, 24 bp, synthetic construct
  misc_feature 1..24: note = Synthetic Construct
  source 1..24: mol_type = other DNA
cagaggctctgtagagttcagact

SEQ ID NO: 7732 - DNA, 24 bp, synthetic construct
  misc_feature 1..24: note = Synthetic Construct
  source 1..24: mol_type = other DNA
gggtttccctctagctgtttactg

SEQ ID NO: 7733 - DNA, 25 bp, synthetic construct
  misc_feature 1..25: note = Synthetic Construct
  source 1..25: mol_type = other DNA
ctctagataggtgcctgtagcctaa

SEQ ID NO: 7734 - DNA, 22 bp, synthetic construct
  misc_feature 1..22: note = Synthetic Construct
  source 1..22: mol_type = other DNA
gcctaacttgcttgctcctgtt

SEQ ID NO: 7735 - DNA, 24 bp, synthetic construct
  misc_feature 1..24: note = Synthetic Construct
  source 1..24: mol_type = other DNA
agaagccctgcttatactgtcatc

SEQ ID NO: 7736 - DNA, 20 bp, synthetic construct
  misc_feature 1..20: note = Synthetic Construct
  source 1..20: mol_type = other DNA
caccctctggcactctcaga

SEQ ID NO: 7737 - DNA, 22 bp, synthetic construct
  misc_feature 1..22: note = Synthetic Construct
  source 1..22: mol_type = other DNA
ccagatagctgcttcacatggt

SEQ ID NO: 7738 - DNA, 21 bp, synthetic construct
  misc_feature 1..21: note = Synthetic Construct
  source 1..21: mol_type = other DNA
tggcttacctgcaacctgtca

SEQ ID NO: 7739 - DNA, 19 bp, synthetic construct
  misc_feature 1..19: note = Synthetic Construct
  source 1..19: mol_type = other DNA
tgcgaggggcagagacttt

SEQ ID NO: 7740 - DNA, 28 bp, synthetic construct
  misc_feature 1..28: note = Synthetic Construct
  source 1..28: mol_type = other DNA
cctgtcttcaagtttactgaacgttcct

SEQ ID NO: 7741 - DNA, 22 bp, synthetic construct
  misc_feature 1..22: note = Synthetic Construct
  source 1..22: mol_type = other DNA
gagtggcctttgaagtcttgca

SEQ ID NO: 7742 - DNA, 27 bp, synthetic construct
  misc_feature 1..27: note = Synthetic Construct
  source 1..27: mol_type = other DNA
aagaattgctagaaatgtgggaacatc

SEQ ID NO: 7743 - DNA, 24 bp, synthetic construct
  misc_feature 1..24: note = Synthetic Construct
  source 1..24: mol_type = other DNA
ccgctgaacaggttcttgagttga

SEQ ID NO: 7744 - DNA, 22 bp, synthetic construct
  misc_feature 1..22: note = Synthetic Construct
  source 1..22: mol_type = other DNA
gcagcaacaactcattcaggtt

SEQ ID NO: 7745 - DNA, 21 bp, synthetic construct
  misc_feature 1..21: note = Synthetic Construct
  source 1..21: mol_type = other DNA
aagtgcctttcagccattcca

SEQ ID NO: 7746 - DNA, 26 bp, synthetic construct
  misc_feature 1..26: note = Synthetic Construct
  source 1..26: mol_type = other DNA
agtctagatacagcctcagaatcctt

SEQ ID NO: 7747 - DNA, 21 bp, synthetic construct
  misc_feature 1..21: note = Synthetic Construct
  source 1..21: mol_type = other DNA
gcccttgagatctgcccaagt

SEQ ID NO: 7748 - DNA, 26 bp, synthetic construct
  misc_feature 1..26: note = Synthetic Construct
  source 1..26: mol_type = other DNA
ggtagccaaagctccatattcttagc

SEQ ID NO: 7749 - DNA, 22 bp, synthetic construct
  misc_feature 1..22: note = Synthetic Construct
  source 1..22: mol_type = other DNA
cccatgacttccacccaaaacc

SEQ ID NO: 7750 - DNA, 22 bp, synthetic construct
  misc_feature 1..22: note = Synthetic Construct
  source 1..22: mol_type = other DNA
ggcctgtctgcaatctctttgt

SEQ ID NO: 7751 - DNA, 20 bp, synthetic construct
  misc_feature 1..20: note = Synthetic Construct
  source 1..20: mol_type = other DNA
atccggccgtgattccattt

SEQ ID NO: 7752 - DNA, 22 bp, synthetic construct
  misc_feature 1..22: note = Synthetic Construct
  source 1..22: mol_type = other DNA
gcaataccagaccctgtggaat

SEQ ID NO: 7753 - DNA, 25 bp, synthetic construct
  misc_feature 1..25: note = Synthetic Construct
  source 1..25: mol_type = other DNA
caagaacagccaacaggaaatgatg

SEQ ID NO: 7754 - DNA, 22 bp, synthetic construct
  misc_feature 1..22: note = Synthetic Construct
  source 1..22: mol_type = other DNA
ctgcacgcatgatcagttatgg

SEQ ID NO: 7755 - DNA, 22 bp, synthetic construct
  misc_feature 1..22: note = Synthetic Construct
  source 1..22: mol_type = other DNA
tgtgcacacacacttccctctt

SEQ ID NO: 7756 - DNA, 22 bp, synthetic construct
  misc_feature 1..22: note = Synthetic Construct
  source 1..22: mol_type = other DNA
tccatcccctggtgtatgaaca

SEQ ID NO: 7757 - DNA, 23 bp, synthetic construct
  misc_feature 1..23: note = Synthetic Construct
  source 1..23: mol_type = other DNA
gtgtccctgtgtcttcagcaata

SEQ ID NO: 7758 - DNA, 28 bp, synthetic construct
  misc_feature 1..28: note = Synthetic Construct
  source 1..28: mol_type = other DNA
agcattgacacagtttatcatacaacag

SEQ ID NO: 7759 - DNA, 20 bp, synthetic construct
  misc_feature 1..20: note = Synthetic Construct
  source 1..20: mol_type = other DNA
tgcagctgcagaaacgatca

SEQ ID NO: 7760 - DNA, 26 bp, synthetic construct
  misc_feature 1..26: note = Synthetic Construct
  source 1..26: mol_type = other DNA
gcctcctgtctctcatatccatgaac

SEQ ID NO: 7761 - DNA, 20 bp, synthetic construct
  misc_feature 1..20: note = Synthetic Construct
  source 1..20: mol_type = other DNA
ggctcctcctgctccaactt

SEQ ID NO: 7762 - DNA, 21 bp, synthetic construct
  misc_feature 1..21: note = Synthetic Construct
  source 1..21: mol_type = other DNA
tggccgctgaactcttccttt

SEQ ID NO: 7763 - DNA, 26 bp, synthetic construct
  misc_feature 1..26: note = Synthetic Construct
  source 1..26: mol_type = other DNA
gcattcaattaaccagaggggagaca

SEQ ID NO: 7764 - DNA, 26 bp, synthetic construct
  misc_feature 1..26: note = Synthetic Construct
  source 1..26: mol_type = other DNA
gcatgtgacctagggagataccagat

SEQ ID NO: 7765 - DNA, 25 bp, synthetic construct
  misc_feature 1..25: note = Synthetic Construct
  source 1..25: mol_type = other DNA
gagtcctgctctctggaatgattct

SEQ ID NO: 7766 - DNA, 22 bp, synthetic construct
  misc_feature 1..22: note = Synthetic Construct
  source 1..22: mol_type = other DNA
cagagccacacctgaactgttt

SEQ ID NO: 7767 - DNA, 26 bp, synthetic construct
  misc_feature 1..26: note = Synthetic Construct
  source 1..26: mol_type = other DNA
ggttgtatgtgtagttgtgtgtgctt

SEQ ID NO: 7768 - DNA, 26 bp, synthetic construct
  misc_feature 1..26: note = Synthetic Construct
  source 1..26: mol_type = other DNA
gtaaggctttctgggataggagatag

SEQ ID NO: 7769 - DNA, 26 bp, synthetic construct
  misc_feature 1..26: note = Synthetic Construct
  source 1..26: mol_type = other DNA
ggcccagactagaaagggattatcca

SEQ ID NO: 7770 - DNA, 25 bp, synthetic construct
  misc_feature 1..25: note = Synthetic Construct
  source 1..25: mol_type = other DNA
caagagatgctgctgttgatgttag

SEQ ID NO: 7771 - DNA, 27 bp, synthetic construct
  misc_feature 1..27: note = Synthetic Construct
  source 1..27: mol_type = other DNA
gcagaatgctaagggaggttgttaagg

SEQ ID NO: 7772 - DNA, 25 bp, synthetic construct
  misc_feature 1..25: note = Synthetic Construct
  source 1..25: mol_type = other DNA
ggtgagcctaaagtccatgcatgat

SEQ ID NO: 7773 - DNA, 26 bp, synthetic construct
  misc_feature 1..26: note = Synthetic Construct
  source 1..26: mol_type = other DNA
cagccaagtatgcgtttaaacttctc

SEQ ID NO: 7774 - DNA, 22 bp, synthetic construct
  misc_feature 1..22: note = Synthetic Construct
  source 1..22: mol_type = other DNA
agcaaggagcaatgaacagcta

SEQ ID NO: 7775 - DNA, 27 bp, synthetic construct
  misc_feature 1..27: note = Synthetic Construct
  source 1..27: mol_type = other DNA
aggcatacattttaactaggacaccaa

SEQ ID NO: 7776 - DNA, 22 bp, synthetic construct
  misc_feature 1..22: note = Synthetic Construct
  source 1..22: mol_type = other DNA
gcattggtgtgaaagcctgctt

SEQ ID NO: 7777 - DNA, 20 bp, synthetic construct
  misc_feature 1..20: note = Synthetic Construct
  source 1..20: mol_type = other DNA
aggccatccaccactgaaca

SEQ ID NO: 7778 - DNA, 25 bp, synthetic construct
  misc_feature 1..25: note = Synthetic Construct
  source 1..25: mol_type = other DNA
tctccatggtactaacccattctct

SEQ ID NO: 7779 - DNA, 20 bp, synthetic construct
  misc_feature 1..20: note = Synthetic Construct
  source 1..20: mol_type = other DNA
actcctccgttggtgtgttc

SEQ ID NO: 7780 - DNA, 21 bp, synthetic construct
  misc_feature 1..21: note = Synthetic Construct
  source 1..21: mol_type = other DNA
cctgctgggattctgctctca

SEQ ID NO: 7781 - DNA, 18 bp, synthetic construct
  misc_feature 1..18: note = Synthetic Construct
  source 1..18: mol_type = other DNA
ctcacccctggccctctt

SEQ ID NO: 7782 - DNA, 27 bp, synthetic construct
  misc_feature 1..27: note = Synthetic Construct
  source 1..27: mol_type = other DNA
gcataatgtaacaggtaggggtacttc

SEQ ID NO: 7783 - DNA, 20 bp, synthetic construct
  misc_feature 1..20: note = Synthetic Construct
  source 1..20: mol_type = other DNA
tgcggtcccatttctgaaca

SEQ ID NO: 7784 - DNA, 24 bp, synthetic construct
  misc_feature 1..24: note = Synthetic Construct
  source 1..24: mol_type = other DNA
cccagatggatgagtctgaagctt

SEQ ID NO: 7785 - DNA, 26 bp, synthetic construct
  misc_feature 1..26: note = Synthetic Construct
  source 1..26: mol_type = other DNA
ggaactccatcaattaaacagttgca

SEQ ID NO: 7786 - DNA, 22 bp, synthetic construct
  misc_feature 1..22: note = Synthetic Construct
  source 1..22: mol_type = other DNA
tgcagactgaccctgtgacttt

SEQ ID NO: 7787 - DNA, 25 bp, synthetic construct
  misc_feature 1..25: note = Synthetic Construct
  source 1..25: mol_type = other DNA
gtcattcaaggccatagaggtacag

SEQ ID NO: 7788 - DNA, 24 bp, synthetic construct
  misc_feature 1..24: note = Synthetic Construct
  source 1..24: mol_type = other DNA
gggagaggatggggattaaagcat

SEQ ID NO: 7789 - DNA, 23 bp, synthetic construct
  misc_feature 1..23: note = Synthetic Construct
  source 1..23: mol_type = other DNA
catgggctaagaggacacattct

SEQ ID NO: 7790 - DNA, 22 bp, synthetic construct
  misc_feature 1..22: note = Synthetic Construct
  source 1..22: mol_type = other DNA
gcctcaggaacttgagtccttt

SEQ ID NO: 7791 - DNA, 26 bp, synthetic construct
  misc_feature 1..26: note = Synthetic Construct
  source 1..26: mol_type = other DNA
ccagtaagaacatgctagaacactca

SEQ ID NO: 7792 - DNA, 20 bp, synthetic construct
  misc_feature 1..20: note = Synthetic Construct
  source 1..20: mol_type = other DNA
tcctgccctgtgagccttct

SEQ ID NO: 7793 - DNA, 23 bp, synthetic construct
  misc_feature 1..23: note = Synthetic Construct
  source 1..23: mol_type = other DNA
tctaaagagccctcctcccatct

SEQ ID NO: 7794 - DNA, 24 bp, synthetic construct
  misc_feature 1..24: note = Synthetic Construct
  source 1..24: mol_type = other DNA
agcaaagaccatgttcctcatgtt

SEQ ID NO: 7795 - DNA, 24 bp, synthetic construct
  misc_feature 1..24: note = Synthetic Construct
  source 1..24: mol_type = other DNA
accctcatctcaggcctttatctg

SEQ ID NO: 7796 - DNA, 25 bp, synthetic construct
  misc_feature 1..25: note = Synthetic Construct
  source 1..25: mol_type = other DNA
gttagtcttctctctgccaggaaac

SEQ ID NO: 7797 - DNA, 22 bp, synthetic construct
  misc_feature 1..22: note = Synthetic Construct
  source 1..22: mol_type = other DNA
ccagcgtttgttcacagtgtgt

SEQ ID NO: 7798 - DNA, 26 bp, synthetic construct
  misc_feature 1..26: note = Synthetic Construct
  source 1..26: mol_type = other DNA
agtggcaactatctttcatcttagct

SEQ ID NO: 7799 - DNA, 24 bp, synthetic construct
  misc_feature 1..24: note = Synthetic Construct
  source 1..24: mol_type = other DNA
gcagtggaatgagtgaaggtacag

SEQ ID NO: 7800 - DNA, 23 bp, synthetic construct
  misc_feature 1..23: note = Synthetic Construct
  source 1..23: mol_type = other DNA
caaggctcaagttcagagaggtt

SEQ ID NO: 7801 - DNA, 25 bp, synthetic construct
  misc_feature 1..25: note = Synthetic Construct
  source 1..25: mol_type = other DNA
gctacatcctgcatttccacatagc

SEQ ID NO: 7802 - DNA, 24 bp, synthetic construct
  misc_feature 1..24: note = Synthetic Construct
  source 1..24: mol_type = other DNA
cctttgggaacatggtttggaaag

SEQ ID NO: 7803 - DNA, 22 bp, synthetic construct
  misc_feature 1..22: note = Synthetic Construct
  source 1..22: mol_type = other DNA
aaggcgcacattagtcccataa

SEQ ID NO: 7804 - DNA, 24 bp, synthetic construct
  misc_feature 1..24: note = Synthetic Construct
  source 1..24: mol_type = other DNA
ccaaccccacagactgtcaacatt

SEQ ID NO: 7805 - DNA, 24 bp, synthetic construct
  misc_feature 1..24: note = Synthetic Construct
  source 1..24: mol_type = other DNA
cccggttattctgtggcctattgt

SEQ ID NO: 7806 - DNA, 22 bp, synthetic construct
  misc_feature 1..22: note = Synthetic Construct
  source 1..22: mol_type = other DNA
tcaggggaagcagcatcattag

SEQ ID NO: 7807 - DNA, 21 bp, synthetic construct
  misc_feature 1..21: note = Synthetic Construct
  source 1..21: mol_type = other DNA
tctggttccacaggagggtaa

SEQ ID NO: 7808 - DNA, 26 bp, synthetic construct
  misc_feature 1..26: note = Synthetic Construct
  source 1..26: mol_type = other DNA
gtactatctgggctcaatgatactgt

SEQ ID NO: 7809 - DNA, 23 bp, synthetic construct
  misc_feature 1..23: note = Synthetic Construct
  source 1..23: mol_type = other DNA
gcagaagtggggatgtgagaatt

SEQ ID NO: 7810 - DNA, 22 bp, synthetic construct
  misc_feature 1..22: note = Synthetic Construct
  source 1..22: mol_type = other DNA
cagagtgccatgcattgtggta

SEQ ID NO: 7811 - DNA, 22 bp, synthetic construct
  misc_feature 1..22: note = Synthetic Construct
  source 1..22: mol_type = other DNA
gctacctgggctgtggtatctt

SEQ ID NO: 7812 - DNA, 29 bp, synthetic construct
  misc_feature 1..29: note = Synthetic Construct
  source 1..29: mol_type = other DNA
atgtctagagctctacataatagcttctg

SEQ ID NO: 7813 - DNA, 22 bp, synthetic construct
  misc_feature 1..22: note = Synthetic Construct
  source 1..22: mol_type = other DNA
caccttgcatccacttgagact

SEQ ID NO: 7814 - DNA, 21 bp, synthetic construct
  misc_feature 1..21: note = Synthetic Construct
  source 1..21: mol_type = other DNA
ccaacttcccctctccagtct

SEQ ID NO: 7815 - DNA, 26 bp, synthetic construct
  misc_feature 1..26: note = Synthetic Construct
  source 1..26: mol_type = other DNA
cattaacccatcattcagcttcaaca

SEQ ID NO: 7816 - DNA, 22 bp, synthetic construct
  misc_feature 1..22: note = Synthetic Construct
  source 1..22: mol_type = other DNA
agtttgcccctagagctgaaac

SEQ ID NO: 7817 - DNA, 22 bp, synthetic construct
  misc_feature 1..22: note = Synthetic Construct
  source 1..22: mol_type = other DNA
acgtaggagctccacaacctaa

SEQ ID NO: 7818 - DNA, 23 bp, synthetic construct
  misc_feature 1..23: note = Synthetic Construct
  source 1..23: mol_type = other DNA
acttggcataaaaccccacgtaa

SEQ ID NO: 7819 - DNA, 22 bp, synthetic construct
  misc_feature 1..22: note = Synthetic Construct
  source 1..22: mol_type = other DNA
gaagccccagtcctacttgaaa

SEQ ID NO: 7820 - DNA, 23 bp, synthetic construct
  misc_feature 1..23: note = Synthetic Construct
  source 1..23: mol_type = other DNA
ctacacttgtggagctgtctgaa

SEQ ID NO: 7821 - DNA, 19 bp, synthetic construct
  misc_feature 1..19: note = Synthetic Construct
  source 1..19: mol_type = other DNA
tggctccactccggcacaa

SEQ ID NO: 7822 - DNA, 22 bp, synthetic construct
  misc_feature 1..22: note = Synthetic Construct
  source 1..22: mol_type = other DNA
cctcctgacctgttcacagtga

SEQ ID NO: 7823 - DNA, 22 bp, synthetic construct
  misc_feature 1..22: note = Synthetic Construct
  source 1..22: mol_type = other DNA
gtgcccaaactattcccactgt

SEQ ID NO: 7824 - DNA, 25 bp, synthetic construct
  misc_feature 1..25: note = Synthetic Construct
  source 1..25: mol_type = other DNA
ttggtaacctgacttcaacacctaa

SEQ ID NO: 7825 - DNA, 22 bp, synthetic construct
  misc_feature 1..22: note = Synthetic Construct
  source 1..22: mol_type = other DNA
gcatgggccaagacatacacaa

SEQ ID NO: 7826 - DNA, 22 bp, synthetic construct
  misc_feature 1..22: note = Synthetic Construct
  source 1..22: mol_type = other DNA
tttgggcaaggcggtttcctta

SEQ ID NO: 7827 - DNA, 25 bp, synthetic construct
  misc_feature 1..25: note = Synthetic Construct
  source 1..25: mol_type = other DNA
ggtctgtactcaagtacacatgctt

SEQ ID NO: 7828 - DNA, 20 bp, synthetic construct
  misc_feature 1..20: note = Synthetic Construct
  source 1..20: mol_type = other DNA
tgccagccagtcacagaagt

SEQ ID NO: 7829 - DNA, 28 bp, synthetic construct
  misc_feature 1..28: note = Synthetic Construct
  source 1..28: mol_type = other DNA
aatgtcactcttacccattgcattaatc

SEQ ID NO: 7830 - DNA, 22 bp, synthetic construct
  misc_feature 1..22: note = Synthetic Construct
  source 1..22: mol_type = other DNA
ggtaggcaaagcttgggtatct

SEQ ID NO: 7831 - DNA, 23 bp, synthetic construct
  misc_feature 1..23: note = Synthetic Construct
  source 1..23: mol_type = other DNA
tcctgtgcttgggatctgagtca

SEQ ID NO: 7832 - DNA, 23 bp, synthetic construct
  misc_feature 1..23: note = Synthetic Construct
  source 1..23: mol_type = other DNA
gcagcttcagtattggggatttc

SEQ ID NO: 7833 - DNA, 26 bp, synthetic construct
  misc_feature 1..26: note = Synthetic Construct
  source 1..26: mol_type = other DNA
gggtacaattagccatgacccatctg

SEQ ID NO: 7834 - DNA, 29 bp, synthetic construct
  misc_feature 1..29: note = Synthetic Construct
  source 1..29: mol_type = other DNA
gactagaaaaatgtaatcagtccccaagt

SEQ ID NO: 7835 - DNA, 22 bp, synthetic construct
  misc_feature 1..22: note = Synthetic Construct
  source 1..22: mol_type = other DNA
acactgaccagaaccacaagtt

SEQ ID NO: 7836 - DNA, 22 bp, synthetic construct
  misc_feature 1..22: note = Synthetic Construct
  source 1..22: mol_type = other DNA
ccaaatttctggcctccacttg

SEQ ID NO: 7837 - DNA, 22 bp, synthetic construct
  misc_feature 1..22: note = Synthetic Construct
  source 1..22: mol_type = other DNA
tcagcaatgcagtgtgttcaga

SEQ ID NO: 7838 - DNA, 22 bp, synthetic construct
  misc_feature 1..22: note = Synthetic Construct
  source 1..22: mol_type = other DNA
gaatggccacactcaagcttct

SEQ ID NO: 7839 - DNA, 21 bp, synthetic construct
  misc_feature 1..21: note = Synthetic Construct
  source 1..21: mol_type = other DNA
aggccgtccaggtagagtaga

SEQ ID NO: 7840 - DNA, 20 bp, synthetic construct
  misc_feature 1..20: note = Synthetic Construct
  source 1..20: mol_type = other DNA
tggccaccctgagatgtcat

SEQ ID NO: 7841 - DNA, 22 bp, synthetic construct
  misc_feature 1..22: note = Synthetic Construct
  source 1..22: mol_type = other DNA
tgcctgtcagtcacatgcttct

SEQ ID NO: 7842 - DNA, 24 bp, synthetic construct
  misc_feature 1..24: note = Synthetic Construct
  source 1..24: mol_type = other DNA
gacaaatgtctgcttcaacaagct

SEQ ID NO: 7843 - DNA, 26 bp, synthetic construct
  misc_feature 1..26: note = Synthetic Construct
  source 1..26: mol_type = other DNA
agtggggtatcagtatcttcctcatt

SEQ ID NO: 7844 - DNA, 22 bp, synthetic construct
  misc_feature 1..22: note = Synthetic Construct
  source 1..22: mol_type = other DNA
ttcccccactgatccattgctt

SEQ ID NO: 7845 - DNA, 20 bp, synthetic construct
  misc_feature 1..20: note = Synthetic Construct
  source 1..20: mol_type = other DNA
tcctctcccggtctctacct

SEQ ID NO: 7846 - DNA, 22 bp, synthetic construct
  misc_feature 1..22: note = Synthetic Construct
  source 1..22: mol_type = other DNA
tccaggagtggagatgtcacat

SEQ ID NO: 7847 - DNA, 24 bp, synthetic construct
  misc_feature 1..24: note = Synthetic Construct
  source 1..24: mol_type = other DNA
gactggtgtgtgtctctgaaagtc

SEQ ID NO: 7848 - DNA, 22 bp, synthetic construct
  misc_feature 1..22: note = Synthetic Construct
  source 1..22: mol_type = other DNA
tgaggacagagggcatattcct

SEQ ID NO: 7849 - DNA, 18 bp, synthetic construct
  misc_feature 1..18: note = Synthetic Construct
  source 1..18: mol_type = other DNA
ggaccggcagcagaacca

SEQ ID NO: 7850 - DNA, 22 bp, synthetic construct
  misc_feature 1..22: note = Synthetic Construct
  source 1..22: mol_type = other DNA
cagcaccactttgcactacttc

SEQ ID NO: 7851 - DNA, 22 bp, synthetic construct
  misc_feature 1..22: note = Synthetic Construct
  source 1..22: mol_type = other DNA
ctgacctcagacatgcaggatt

SEQ ID NO: 7852 - DNA, 21 bp, synthetic construct
  misc_feature 1..21: note = Synthetic Construct
  source 1..21: mol_type = other DNA
tgcctccccacaatccgttct

SEQ ID NO: 7853 - DNA, 23 bp, synthetic construct
  misc_feature 1..23: note = Synthetic Construct
  source 1..23: mol_type = other DNA
ctgtgcattacctccatccttgt

SEQ ID NO: 7854 - DNA, 24 bp, synthetic construct
  misc_feature 1..24: note = Synthetic Construct
  source 1..24: mol_type = other DNA
acatcacacagagtcctttgctaa

SEQ ID NO: 7855 - DNA, 25 bp, synthetic construct
  misc_feature 1..25: note = Synthetic Construct
  source 1..25: mol_type = other DNA
agtatggcatgggagactaatttgg

SEQ ID NO: 7856 - DNA, 22 bp, synthetic construct
  misc_feature 1..22: note = Synthetic Construct
  source 1..22: mol_type = other DNA
tggacgtgatgggtagaatcca

SEQ ID NO: 7857 - DNA, 23 bp, synthetic construct
  misc_feature 1..23: note = Synthetic Construct
  source 1..23: mol_type = other DNA
ggtgctttagaaggcccttaaca

SEQ ID NO: 7858 - DNA, 28 bp, synthetic construct
  misc_feature 1..28: note = Synthetic Construct
  source 1..28: mol_type = other DNA
acctttgtaacctaagatagggtagact

SEQ ID NO: 7859 - DNA, 22 bp, synthetic construct
  misc_feature 1..22: note = Synthetic Construct
  source 1..22: mol_type = other DNA
accgtctccttctccaagttct

SEQ ID NO: 7860 - DNA, 20 bp, synthetic construct
  misc_feature 1..20: note = Synthetic Construct
  source 1..20: mol_type = other DNA
cagccaggtcagcaggttca

SEQ ID NO: 7861 - DNA, 19 bp, synthetic construct
  misc_feature 1..19: note = Synthetic Construct
  source 1..19: mol_type = other DNA
aggaagccgcagagccata

SEQ ID NO: 7862 - DNA, 23 bp, synthetic construct
  misc_feature 1..23: note = Synthetic Construct
  source 1..23: mol_type = other DNA
ggctgagacttgaactcttctgt

SEQ ID NO: 7863 - DNA, 19 bp, synthetic construct
  misc_feature 1..19: note = Synthetic Construct
  source 1..19: mol_type = other DNA
tgggtccgtgccacagtga

SEQ ID NO: 7864 - DNA, 26 bp, synthetic construct
  misc_feature 1..26: note = Synthetic Construct
  source 1..26: mol_type = other DNA
ggatttagggacccagcttcttactg

SEQ ID NO: 7865 - DNA, 24 bp, synthetic construct
  misc_feature 1..24: note = Synthetic Construct
  source 1..24: mol_type = other DNA
agacagtttgccagtcattatcca

SEQ ID NO: 7866 - DNA, 26 bp, synthetic construct
  misc_feature 1..26: note = Synthetic Construct
  source 1..26: mol_type = other DNA
cctctagaaggaggggatagtcagat

SEQ ID NO: 7867 - DNA, 24 bp, synthetic construct
  misc_feature 1..24: note = Synthetic Construct
  source 1..24: mol_type = other DNA
gacctggtattggtgaccctaaga

SEQ ID NO: 7868 - DNA, 25 bp, synthetic construct
  misc_feature 1..25: note = Synthetic Construct
  source 1..25: mol_type = other DNA
gctcggaggtgactatcttctacag

SEQ ID NO: 7869 - DNA, 22 bp, synthetic construct
  misc_feature 1..22: note = Synthetic Construct
  source 1..22: mol_type = other DNA
ccaaccactccctcatgctaca

SEQ ID NO: 7870 - DNA, 27 bp, synthetic construct
  misc_feature 1..27: note = Synthetic Construct
  source 1..27: mol_type = other DNA
ccactgctatttctttgttgtgacaca

SEQ ID NO: 7871 - DNA, 26 bp, synthetic construct
  misc_feature 1..26: note = Synthetic Construct
  source 1..26: mol_type = other DNA
gctgactatatgcttctgctgaactg

SEQ ID NO: 7872 - DNA, 24 bp, synthetic construct
  misc_feature 1..24: note = Synthetic Construct
  source 1..24: mol_type = other DNA
gccacaaagtagttgccagatcac

SEQ ID NO: 7873 - DNA, 21 bp, synthetic construct
  misc_feature 1..21: note = Synthetic Construct
  source 1..21: mol_type = other DNA
tgggagcatggatggtgatca

SEQ ID NO: 7874 - DNA, 26 bp, synthetic construct
  misc_feature 1..26: note = Synthetic Construct
  source 1..26: mol_type = other DNA
ctgcacatccttaattcttcctgtct

SEQ ID NO: 7875 - DNA, 21 bp, synthetic construct
  misc_feature 1..21: note = Synthetic Construct
  source 1..21: mol_type = other DNA
tgctgtgctaggtggctttag

SEQ ID NO: 7876 - DNA, 21 bp, synthetic construct
  misc_feature 1..21: note = Synthetic Construct
  source 1..21: mol_type = other DNA
aaaccctggcacacagaatca

SEQ ID NO: 7877 - DNA, 20 bp, synthetic construct
  misc_feature 1..20: note = Synthetic Construct
  source 1..20: mol_type = other DNA
tggagaccctggggcttgtg

SEQ ID NO: 7878 - DNA, 22 bp, synthetic construct
  misc_feature 1..22: note = Synthetic Construct
  source 1..22: mol_type = other DNA
acaccttagcagcactgaacac

SEQ ID NO: 7879 - DNA, 21 bp, synthetic construct
  misc_feature 1..21: note = Synthetic Construct
  source 1..21: mol_type = other DNA
gaacacccgagccattctgaa

SEQ ID NO: 7880 - DNA, 26 bp, synthetic construct
  misc_feature 1..26: note = Synthetic Construct
  source 1..26: mol_type = other DNA
ccagtgtaactatttgagctggacta

SEQ ID NO: 7881 - DNA, 24 bp, synthetic construct
  misc_feature 1..24: note = Synthetic Construct
  source 1..24: mol_type = other DNA
tcttgcttgaggctgatctctatg

SEQ ID NO: 7882 - DNA, 22 bp, synthetic construct
  misc_feature 1..22: note = Synthetic Construct
  source 1..22: mol_type = other DNA
aacagggtctggaagggctttt

SEQ ID NO: 7883 - DNA, 25 bp, synthetic construct
  misc_feature 1..25: note = Synthetic Construct
  source 1..25: mol_type = other DNA
ggtgtgtatgaagccaagtctagga

SEQ ID NO: 7884 - DNA, 21 bp, synthetic construct
  misc_feature 1..21: note = Synthetic Construct
  source 1..21: mol_type = other DNA
tgatgcagctctctcctgtca

SEQ ID NO: 7885 - DNA, 28 bp, synthetic construct
  misc_feature 1..28: note = Synthetic Construct
  source 1..28: mol_type = other DNA
gagataggtcatctcttgaagacagagt

SEQ ID NO: 7886 - DNA, 24 bp, synthetic construct
  misc_feature 1..24: note = Synthetic Construct
  source 1..24: mol_type = other DNA
gcaacggaggcagttctagatctt

SEQ ID NO: 7887 - DNA, 23 bp, synthetic construct
  misc_feature 1..23: note = Synthetic Construct
  source 1..23: mol_type = other DNA
gctctggaaggtacaagccataa

SEQ ID NO: 7888 - DNA, 21 bp, synthetic construct
  misc_feature 1..21: note = Synthetic Construct
  source 1..21: mol_type = other DNA
ctaggccccacccacaaaacc

SEQ ID NO: 7889 - DNA, 21 bp, synthetic construct
  misc_feature 1..21: note = Synthetic Construct
  source 1..21: mol_type = other DNA
cacaccatccaacctgagcaa

SEQ ID NO: 7890 - DNA, 25 bp, synthetic construct
  misc_feature 1..25: note = Synthetic Construct
  source 1..25: mol_type = other DNA
gtttgaccaaatacctgtggaccta

SEQ ID NO: 7891 - DNA, 22 bp, synthetic construct
  misc_feature 1..22: note = Synthetic Construct
  source 1..22: mol_type = other DNA
ctcctgctccttcacacacaaa

SEQ ID NO: 7892 - DNA, 24 bp, synthetic construct
  misc_feature 1..24: note = Synthetic Construct
  source 1..24: mol_type = other DNA
tccactctaaagctttcccattcc

SEQ ID NO: 7893 - DNA, 25 bp, synthetic construct
  misc_feature 1..25: note = Synthetic Construct
  source 1..25: mol_type = other DNA
agcattccaatgtcacttgattgtg

SEQ ID NO: 7894 - DNA, 21 bp, synthetic construct
  misc_feature 1..21: note = Synthetic Construct
  source 1..21: mol_type = other DNA
aatgtgtggcagggacagcaa

SEQ ID NO: 7895 - DNA, 25 bp, synthetic construct
  misc_feature 1..25: note = Synthetic Construct
  source 1..25: mol_type = other DNA
cctttaggggacaacttttcatgga

SEQ ID NO: 7896 - DNA, 19 bp, synthetic construct
  misc_feature 1..19: note = Synthetic Construct
  source 1..19: mol_type = other DNA
cagggtgaaccagcaagct

SEQ ID NO: 7897 - DNA, 22 bp, synthetic construct
  misc_feature 1..22: note = Synthetic Construct
  source 1..22: mol_type = other DNA
agggcagggaccttatttacct

SEQ ID NO: 7898 - DNA, 23 bp, synthetic construct
  misc_feature 1..23: note = Synthetic Construct
  source 1..23: mol_type = other DNA
tggaccatctgaaggcctactga

SEQ ID NO: 7899 - DNA, 25 bp, synthetic construct
  misc_feature 1..25: note = Synthetic Construct
  source 1..25: mol_type = other DNA
cccactgaacctgcagacattattt

SEQ ID NO: 7900 - DNA, 24 bp, synthetic construct
  misc_feature 1..24: note = Synthetic Construct
  source 1..24: mol_type = other DNA
caagaggagaaagtgtggatttgc

SEQ ID NO: 7901 - DNA, 23 bp, synthetic construct
  misc_feature 1..23: note = Synthetic Construct
  source 1..23: mol_type = other DNA
catgcaggagcttagagactgat

SEQ ID NO: 7902 - DNA, 21 bp, synthetic construct
  misc_feature 1..21: note = Synthetic Construct
  source 1..21: mol_type = other DNA
ttggacccgaatgcagatctg

SEQ ID NO: 7903 - DNA, 24 bp, synthetic construct
  misc_feature 1..24: note = Synthetic Construct
  source 1..24: mol_type = other DNA
tggagcccagagaggttttatgtc

SEQ ID NO: 7904 - DNA, 22 bp, synthetic construct
  misc_feature 1..22: note = Synthetic Construct
  source 1..22: mol_type = other DNA
tcctcagcttgtggacacaaac

SEQ ID NO: 7905 - DNA, 21 bp, synthetic construct
  misc_feature 1..21: note = Synthetic Construct
  source 1..21: mol_type = other DNA
caaaaaggcagcacacacgat

SEQ ID NO: 7906 - DNA, 22 bp, synthetic construct
  misc_feature 1..22: note = Synthetic Construct
  source 1..22: mol_type = other DNA
gggtaggaggaggacacagtac

SEQ ID NO: 7907 - DNA, 24 bp, synthetic construct
  misc_feature 1..24: note = Synthetic Construct
  source 1..24: mol_type = other DNA
gcactaccaaaacctctcctccaa

SEQ ID NO: 7908 - DNA, 25 bp, synthetic construct
  misc_feature 1..25: note = Synthetic Construct
  source 1..25: mol_type = other DNA
ggcttagagcaataggagtttgttc

SEQ ID NO: 7909 - DNA, 27 bp, synthetic construct
  misc_feature 1..27: note = Synthetic Construct
  source 1..27: mol_type = other DNA
gtggtaactgtttagtccacacttagg

SEQ ID NO: 7910 - DNA, 21 bp, synthetic construct
  misc_feature 1..21: note = Synthetic Construct
  source 1..21: mol_type = other DNA
caaagctgtggtgacccagat

SEQ ID NO: 7911 - DNA, 24 bp, synthetic construct
  misc_feature 1..24: note = Synthetic Construct
  source 1..24: mol_type = other DNA
ggaatagaaggcagggaacacttc

SEQ ID NO: 7912 - DNA, 22 bp, synthetic construct
  misc_feature 1..22: note = Synthetic Construct
  source 1..22: mol_type = other DNA
ctgtcaacagggctttcaagct

SEQ ID NO: 7913 - DNA, 24 bp, synthetic construct
  misc_feature 1..24: note = Synthetic Construct
  source 1..24: mol_type = other DNA
gccatcattcagaggagctttcga

SEQ ID NO: 7914 - DNA, 24 bp, synthetic construct
  misc_feature 1..24: note = Synthetic Construct
  source 1..24: mol_type = other DNA
gtcaacagcctgcctctttttatg

SEQ ID NO: 7915 - DNA, 22 bp, synthetic construct
  misc_feature 1..22: note = Synthetic Construct
  source 1..22: mol_type = other DNA
gtgcatctccaatccaggtgat

SEQ ID NO: 7916 - DNA, 24 bp, synthetic construct
  misc_feature 1..24: note = Synthetic Construct
  source 1..24: mol_type = other DNA
gacctggagatttcttctcacctt

SEQ ID NO: 7917 - DNA, 22 bp, synthetic construct
  misc_feature 1..22: note = Synthetic Construct
  source 1..22: mol_type = other DNA
acctgacttcccatgcttaagc

SEQ ID NO: 7918 - DNA, 27 bp, synthetic construct
  misc_feature 1..27: note = Synthetic Construct
  source 1..27: mol_type = other DNA
ccaaagtttgaaaaggatagagcttga

SEQ ID NO: 7919 - DNA, 22 bp, synthetic construct
  misc_feature 1..22: note = Synthetic Construct
  source 1..22: mol_type = other DNA
tctccagccagtctacctctca

SEQ ID NO: 7920 - DNA, 24 bp, synthetic construct
  misc_feature 1..24: note = Synthetic Construct
  source 1..24: mol_type = other DNA
gataggggcagagtcttcctaaac

SEQ ID NO: 7921 - DNA, 18 bp, synthetic construct
  misc_feature 1..18: note = Synthetic Construct
  source 1..18: mol_type = other DNA
tggctgacccgggtagct

SEQ ID NO: 7922 - DNA, 24 bp, synthetic construct
  misc_feature 1..24: note = Synthetic Construct
  source 1..24: mol_type = other DNA
ggtgtgacttacagccagatgatc

SEQ ID NO: 7923 - DNA, 27 bp, synthetic construct
  misc_feature 1..27: note = Synthetic Construct
  source 1..27: mol_type = other DNA
ctgcacattgtggcctaccctctctta

SEQ ID NO: 7924 - DNA, 22 bp, synthetic construct
  misc_feature 1..22: note = Synthetic Construct
  source 1..22: mol_type = other DNA
tgggattgtgctcctgctaagt

SEQ ID NO: 7925 - DNA, 25 bp, synthetic construct
  misc_feature 1..25: note = Synthetic Construct
  source 1..25: mol_type = other DNA
aaacagacttcatttccccaatcac

SEQ ID NO: 7926 - DNA, 27 bp, synthetic construct
  misc_feature 1..27: note = Synthetic Construct
  source 1..27: mol_type = other DNA
gcttaaaaagaaggtttgcatcccata

SEQ ID NO: 7927 - DNA, 26 bp, synthetic construct
  misc_feature 1..26: note = Synthetic Construct
  source 1..26: mol_type = other DNA
gtgaccataaagatgcgtctctttcc

SEQ ID NO: 7928 - DNA, 24 bp, synthetic construct
  misc_feature 1..24: note = Synthetic Construct
  source 1..24: mol_type = other DNA
cccatcccacctttctacagcatt

SEQ ID NO: 7929 - DNA, 20 bp, synthetic construct
  misc_feature 1..20: note = Synthetic Construct
  source 1..20: mol_type = other DNA
ttctggcccctctccctaca

SEQ ID NO: 7930 - DNA, 23 bp, synthetic construct
  misc_feature 1..23: note = Synthetic Construct
  source 1..23: mol_type = other DNA
atgggaagaaagccatagagcaa

SEQ ID NO: 7931 - DNA, 20 bp, synthetic construct
  misc_feature 1..20: note = Synthetic Construct
  source 1..20: mol_type = other DNA
tgcttgactcacgccttcca

SEQ ID NO: 7932 - DNA, 21 bp, synthetic construct
  misc_feature 1..21: note = Synthetic Construct
  source 1..21: mol_type = other DNA
aagactggggacgggatactt

SEQ ID NO: 7933 - DNA, 24 bp, synthetic construct
  misc_feature 1..24: note = Synthetic Construct
  source 1..24: mol_type = other DNA
ccaggaactctagggaagacagaa

SEQ ID NO: 7934 - DNA, 23 bp, synthetic construct
  misc_feature 1..23: note = Synthetic Construct
  source 1..23: mol_type = other DNA
cacccagataacacactctggaa

SEQ ID NO: 7935 - DNA, 22 bp, synthetic construct
  misc_feature 1..22: note = Synthetic Construct
  source 1..22: mol_type = other DNA
cagcaaggcttcttctggtcaa

SEQ ID NO: 7936 - DNA, 21 bp, synthetic construct
  misc_feature 1..21: note = Synthetic Construct
  source 1..21: mol_type = other DNA
tgccagcgaaccctagaagga

SEQ ID NO: 7937 - DNA, 26 bp, synthetic construct
  misc_feature 1..26: note = Synthetic Construct
  source 1..26: mol_type = other DNA
accagcccaatattatccccaatatg

SEQ ID NO: 7938 - DNA, 23 bp, synthetic construct
  misc_feature 1..23: note = Synthetic Construct
  source 1..23: mol_type = other DNA
agcccagattcctgagggcttta

SEQ ID NO: 7939 - DNA, 22 bp, synthetic construct
  misc_feature 1..22: note = Synthetic Construct
  source 1..22: mol_type = other DNA
tgctccacttcagtgactaggt

SEQ ID NO: 7940 - DNA, 19 bp, synthetic construct
  misc_feature 1..19: note = Synthetic Construct
  source 1..19: mol_type = other DNA
agagctgtgctgccttctg

SEQ ID NO: 7941 - DNA, 27 bp, synthetic construct
  misc_feature 1..27: note = Synthetic Construct
  source 1..27: mol_type = other DNA
gctccttctattttgagggtcaaggtt

SEQ ID NO: 7942 - DNA, 23 bp, synthetic construct
  misc_feature 1..23: note = Synthetic Construct
  source 1..23: mol_type = other DNA
cctcttgggaaacagctctttgg

SEQ ID NO: 7943 - DNA, 24 bp, synthetic construct
  misc_feature 1..24: note = Synthetic Construct
  source 1..24: mol_type = other DNA
cgtctctctccctgatacattcct

SEQ ID NO: 7944 - DNA, 20 bp, synthetic construct
  misc_feature 1..20: note = Synthetic Construct
  source 1..20: mol_type = other DNA
acggctctttccacccatca

SEQ ID NO: 7945 - DNA, 22 bp, synthetic construct
  misc_feature 1..22: note = Synthetic Construct
  source 1..22: mol_type = other DNA
aggcccatgtctgagctggtaa

SEQ ID NO: 7946 - DNA, 22 bp, synthetic construct
  misc_feature 1..22: note = Synthetic Construct
  source 1..22: mol_type = other DNA
tcactgtgcccagcctttgtaa

SEQ ID NO: 7947 - DNA, 24 bp, synthetic construct
  misc_feature 1..24: note = Synthetic Construct
  source 1..24: mol_type = other DNA
actacaggattcggagagggaaac

SEQ ID NO: 7948 - DNA, 22 bp, synthetic construct
  misc_feature 1..22: note = Synthetic Construct
  source 1..22: mol_type = other DNA
ggaacgcttgtctttggattgg

SEQ ID NO: 7949 - DNA, 25 bp, synthetic construct
  misc_feature 1..25: note = Synthetic Construct
  source 1..25: mol_type = other DNA
gaaaggatgttcataggggagtgat

SEQ ID NO: 7950 - DNA, 21 bp, synthetic construct
  misc_feature 1..21: note = Synthetic Construct
  source 1..21: mol_type = other DNA
aggctggaggaggacacattt

SEQ ID NO: 7951 - DNA, 23 bp, synthetic construct
  misc_feature 1..23: note = Synthetic Construct
  source 1..23: mol_type = other DNA
tgtcttcatgtgtatggctgtgt

SEQ ID NO: 7952 - DNA, 22 bp, synthetic construct
  misc_feature 1..22: note = Synthetic Construct
  source 1..22: mol_type = other DNA
gggtcaacagatgcatgtgaag

SEQ ID NO: 7953 - DNA, 23 bp, synthetic construct
  misc_feature 1..23: note = Synthetic Construct
  source 1..23: mol_type = other DNA
caccacacctggcctattttcct

SEQ ID NO: 7954 - DNA, 20 bp, synthetic construct
  misc_feature 1..20: note = Synthetic Construct
  source 1..20: mol_type = other DNA
accaggtggctgggtgacat

SEQ ID NO: 7955 - DNA, 26 bp, synthetic construct
  misc_feature 1..26: note = Synthetic Construct
  source 1..26: mol_type = other DNA
cctacagtgatcatgatgaactgcta

SEQ ID NO: 7956 - DNA, 30 bp, synthetic construct
  misc_feature 1..30: note = Synthetic Construct
  source 1..30: mol_type = other DNA
ctgttcttattttaggtgcatagggttatg

SEQ ID NO: 7957 - DNA, 19 bp, synthetic construct
  misc_feature 1..19: note = Synthetic Construct
  source 1..19: mol_type = other DNA
acttccccaaccccactct

SEQ ID NO: 7958 - DNA, 22 bp, synthetic construct
  misc_feature 1..22: note = Synthetic Construct
  source 1..22: mol_type = other DNA
cagctccaggaattgctgtact

SEQ ID NO: 7959 - DNA, 24 bp, synthetic construct
  misc_feature 1..24: note = Synthetic Construct
  source 1..24: mol_type = other DNA
acctgggtcttcattctggagaga

SEQ ID NO: 7960 - DNA, 23 bp, synthetic construct
  misc_feature 1..23: note = Synthetic Construct
  source 1..23: mol_type = other DNA
actctttcctgcttcaactgcaa

SEQ ID NO: 7961 - DNA, 26 bp, synthetic construct
  misc_feature 1..26: note = Synthetic Construct
  source 1..26: mol_type = other DNA
ccctaaaacacaaccttgatcatgct

SEQ ID NO: 7962 - DNA, 24 bp, synthetic construct
  misc_feature 1..24: note = Synthetic Construct
  source 1..24: mol_type = other DNA
ccttccctcaaatcactgctgctt

SEQ ID NO: 7963 - DNA, 22 bp, synthetic construct
  misc_feature 1..22: note = Synthetic Construct
  source 1..22: mol_type = other DNA
aggaggaacccaggcaaatagg

SEQ ID NO: 7964 - DNA, 23 bp, synthetic construct
  misc_feature 1..23: note = Synthetic Construct
  source 1..23: mol_type = other DNA
agtcagtggcctgagttctagtc

SEQ ID NO: 7965 - DNA, 24 bp, synthetic construct
  misc_feature 1..24: note = Synthetic Construct
  source 1..24: mol_type = other DNA
cctggaagacagaaagctcattcc

SEQ ID NO: 7966 - DNA, 20 bp, synthetic construct
  misc_feature 1..20: note = Synthetic Construct
  source 1..20: mol_type = other DNA
tcccccatgccttccaaatc

SEQ ID NO: 7967 - DNA, 26 bp, synthetic construct
  misc_feature 1..26: note = Synthetic Construct
  source 1..26: mol_type = other DNA
ctcttgttgattggactctgctagtg

SEQ ID NO: 7968 - DNA, 23 bp, synthetic construct
  misc_feature 1..23: note = Synthetic Construct
  source 1..23: mol_type = other DNA
tggagggacctggaattccatgt

SEQ ID NO: 7969 - DNA, 25 bp, synthetic construct
  misc_feature 1..25: note = Synthetic Construct
  source 1..25: mol_type = other DNA
gggatccatagttacccttctccta

SEQ ID NO: 7970 - DNA, 23 bp, synthetic construct
  misc_feature 1..23: note = Synthetic Construct
  source 1..23: mol_type = other DNA
ccctacctcttagcccagaaact

SEQ ID NO: 7971 - DNA, 25 bp, synthetic construct
  misc_feature 1..25: note = Synthetic Construct
  source 1..25: mol_type = other DNA
ctgcagtgtcactttacttctctgt

SEQ ID NO: 7972 - DNA, 22 bp, synthetic construct
  misc_feature 1..22: note = Synthetic Construct
  source 1..22: mol_type = other DNA
tcactctgtccactcctcagtt

SEQ ID NO: 7973 - DNA, 24 bp, synthetic construct
  misc_feature 1..24: note = Synthetic Construct
  source 1..24: mol_type = other DNA
ccaaccatggcttgagatcttcac

SEQ ID NO: 7974 - DNA, 20 bp, synthetic construct
  misc_feature 1..20: note = Synthetic Construct
  source 1..20: mol_type = other DNA
atttcacggcagaggtgtgt

SEQ ID NO: 7975 - DNA, 24 bp, synthetic construct
  misc_feature 1..24: note = Synthetic Construct
  source 1..24: mol_type = other DNA
ggctggtactgtgggtgattacaa

SEQ ID NO: 7976 - DNA, 23 bp, synthetic construct
  misc_feature 1..23: note = Synthetic Construct
  source 1..23: mol_type = other DNA
gagagaggcctgggtcagatcct

SEQ ID NO: 7977 - DNA, 24 bp, synthetic construct
  misc_feature 1..24: note = Synthetic Construct
  source 1..24: mol_type = other DNA
gctctttcacatgtgggagtagct

SEQ ID NO: 7978 - DNA, 22 bp, synthetic construct
  misc_feature 1..22: note = Synthetic Construct
  source 1..22: mol_type = other DNA
ccaggtcatgcacaaagaccta

SEQ ID NO: 7979 - DNA, 25 bp, synthetic construct
  misc_feature 1..25: note = Synthetic Construct
  source 1..25: mol_type = other DNA
cgaagcccatgtttagtcacttagt

SEQ ID NO: 7980 - DNA, 25 bp, synthetic construct
  misc_feature 1..25: note = Synthetic Construct
  source 1..25: mol_type = other DNA
gagtggttctagggaagtcacactt

SEQ ID NO: 7981 - DNA, 26 bp, synthetic construct
  misc_feature 1..26: note = Synthetic Construct
  source 1..26: mol_type = other DNA
caatcatgttttggagactggaggat

SEQ ID NO: 7982 - DNA, 22 bp, synthetic construct
  misc_feature 1..22: note = Synthetic Construct
  source 1..22: mol_type = other DNA
cagccttccacaacatgaacca

SEQ ID NO: 7983 - DNA, 21 bp, synthetic construct
  misc_feature 1..21: note = Synthetic Construct
  source 1..21: mol_type = other DNA
ccacttgcagaagaggtgcat

SEQ ID NO: 7984 - DNA, 22 bp, synthetic construct
  misc_feature 1..22: note = Synthetic Construct
  source 1..22: mol_type = other DNA
gttcccacacagttaccaagct

SEQ ID NO: 7985 - DNA, 22 bp, synthetic construct
  misc_feature 1..22: note = Synthetic Construct
  source 1..22: mol_type = other DNA
tgcactaagggaaagggaacac

SEQ ID NO: 7986 - DNA, 25 bp, synthetic construct
  misc_feature 1..25: note = Synthetic Construct
  source 1..25: mol_type = other DNA
ccaatttgggattccaatgctactt

SEQ ID NO: 7987 - DNA, 22 bp, synthetic construct
  misc_feature 1..22: note = Synthetic Construct
  source 1..22: mol_type = other DNA
cagttacgctcactggatggat

SEQ ID NO: 7988 - DNA, 26 bp, synthetic construct
  misc_feature 1..26: note = Synthetic Construct
  source 1..26: mol_type = other DNA
gcatgaggactactctgggtctattg

SEQ ID NO: 7989 - DNA, 22 bp, synthetic construct
  misc_feature 1..22: note = Synthetic Construct
  source 1..22: mol_type = other DNA
cctgatgggaacaggcattctt

SEQ ID NO: 7990 - DNA, 23 bp, synthetic construct
  misc_feature 1..23: note = Synthetic Construct
  source 1..23: mol_type = other DNA
gaagcagcctgaggttaatctct

SEQ ID NO: 7991 - DNA, 24 bp, synthetic construct
  misc_feature 1..24: note = Synthetic Construct
  source 1..24: mol_type = other DNA
ccttacttgtgggagtgacatggt

SEQ ID NO: 7992 - DNA, 21 bp, synthetic construct
  misc_feature 1..21: note = Synthetic Construct
  source 1..21: mol_type = other DNA
aggtaaccgaggctgggagtt

SEQ ID NO: 7993 - DNA, 22 bp, synthetic construct
  misc_feature 1..22: note = Synthetic Construct
  source 1..22: mol_type = other DNA
ttgagcaggaccatctcctttg

SEQ ID NO: 7994 - DNA, 23 bp, synthetic construct
  misc_feature 1..23: note = Synthetic Construct
  source 1..23: mol_type = other DNA
tcaataaatggcagccaccatca

SEQ ID NO: 7995 - DNA, 20 bp, synthetic construct
  misc_feature 1..20: note = Synthetic Construct
  source 1..20: mol_type = other DNA
tgcctgcatctcctcccttt

SEQ ID NO: 7996 - DNA, 24 bp, synthetic construct
  misc_feature 1..24: note = Synthetic Construct
  source 1..24: mol_type = other DNA
ggaggtcagacacaggacaaacaa

SEQ ID NO: 7997 - DNA, 18 bp, synthetic construct
  misc_feature 1..18: note = Synthetic Construct
  source 1..18: mol_type = other DNA
tcgccacccagctcaaca

SEQ ID NO: 7998 - DNA, 24 bp, synthetic construct
  misc_feature 1..24: note = Synthetic Construct
  source 1..24: mol_type = other DNA
gctgccgtgttaaaaaaccatggt

SEQ ID NO: 7999 - DNA, 24 bp, synthetic construct
  misc_feature 1..24: note = Synthetic Construct
  source 1..24: mol_type = other DNA
cagctgagctcatctcttcctctt

SEQ ID NO: 8000 - DNA, 22 bp, synthetic construct
  misc_feature 1..22: note = Synthetic Construct
  source 1..22: mol_type = other DNA
ggcctagaagagctctgagaca

SEQ ID NO: 8001 - DNA, 20 bp, synthetic construct
  misc_feature 1..20: note = Synthetic Construct
  source 1..20: mol_type = other DNA
acggtagttccccccttacc

SEQ ID NO: 8002 - DNA, 23 bp, synthetic construct
  misc_feature 1..23: note = Synthetic Construct
  source 1..23: mol_type = other DNA
caaatatgcagtcagcccttgtc

SEQ ID NO: 8003 - DNA, 22 bp, synthetic construct
  misc_feature 1..22: note = Synthetic Construct
  source 1..22: mol_type = other DNA
ccacagcattcccagtctacct

SEQ ID NO: 8004 - DNA, 25 bp, synthetic construct
  misc_feature 1..25: note = Synthetic Construct
  source 1..25: mol_type = other DNA
agctcctggattaaaaggcacatag

SEQ ID NO: 8005 - DNA, 23 bp, synthetic construct
  misc_feature 1..23: note = Synthetic Construct
  source 1..23: mol_type = other DNA
agactgctgctgagtttttgagt

SEQ ID NO: 8006 - DNA, 23 bp, synthetic construct
  misc_feature 1..23: note = Synthetic Construct
  source 1..23: mol_type = other DNA
gaagccgggtatggaaatagtga

SEQ ID NO: 8007 - DNA, 24 bp, synthetic construct
  misc_feature 1..24: note = Synthetic Construct
  source 1..24: mol_type = other DNA
gggtcagtcaacaccaggagttaa

SEQ ID NO: 8008 - DNA, 23 bp, synthetic construct
  misc_feature 1..23: note = Synthetic Construct
  source 1..23: mol_type = other DNA
tcagtttcccccctacacaatgg

SEQ ID NO: 8009 - DNA, 27 bp, synthetic construct
  misc_feature 1..27: note = Synthetic Construct
  source 1..27: mol_type = other DNA
tgtatagataggggtcttgccattttg

SEQ ID NO: 8010 - DNA, 21 bp, synthetic construct
  misc_feature 1..21: note = Synthetic Construct
  source 1..21: mol_type = other DNA
ggtggaacggatttgggcata

SEQ ID NO: 8011 - DNA, 21 bp, synthetic construct
  misc_feature 1..21: note = Synthetic Construct
  source 1..21: mol_type = other DNA
caggatggcttggttcactga

SEQ ID NO: 8012 - DNA, 22 bp, synthetic construct
  misc_feature 1..22: note = Synthetic Construct
  source 1..22: mol_type = other DNA
catccagctgtgtctgctttgt

SEQ ID NO: 8013 - DNA, 26 bp, synthetic construct
  misc_feature 1..26: note = Synthetic Construct
  source 1..26: mol_type = other DNA
cttaccttaagattcatgccccatca

SEQ ID NO: 8014 - DNA, 20 bp, synthetic construct
  misc_feature 1..20: note = Synthetic Construct
  source 1..20: mol_type = other DNA
agtcctgcctttcccacatg

SEQ ID NO: 8015 - DNA, 25 bp, synthetic construct
  misc_feature 1..25: note = Synthetic Construct
  source 1..25: mol_type = other DNA
gggagagaggtgtgaaggaccacat

SEQ ID NO: 8016 - DNA, 22 bp, synthetic construct
  misc_feature 1..22: note = Synthetic Construct
  source 1..22: mol_type = other DNA
tccagggtcacggtgttctttt

SEQ ID NO: 8017 - DNA, 23 bp, synthetic construct
  misc_feature 1..23: note = Synthetic Construct
  source 1..23: mol_type = other DNA
ccttctgtggctgctctcctttt

SEQ ID NO: 8018 - DNA, 23 bp, synthetic construct
  misc_feature 1..23: note = Synthetic Construct
  source 1..23: mol_type = other DNA
ccaatgccattagctccagaaca

SEQ ID NO: 8019 - DNA, 25 bp, synthetic construct
  misc_feature 1..25: note = Synthetic Construct
  source 1..25: mol_type = other DNA
gtgttaagttaagccgtgtcagcaa

SEQ ID NO: 8020 - DNA, 24 bp, synthetic construct
  misc_feature 1..24: note = Synthetic Construct
  source 1..24: mol_type = other DNA
ggtgatcccctgcaaagttgaaac

SEQ ID NO: 8021 - DNA, 25 bp, synthetic construct
  misc_feature 1..25: note = Synthetic Construct
  source 1..25: mol_type = other DNA
ggcttgaccttttacagatcacctt

SEQ ID NO: 8022 - DNA, 26 bp, synthetic construct
  misc_feature 1..26: note = Synthetic Construct
  source 1..26: mol_type = other DNA
gttcaagagtcacggcaaacatacag

SEQ ID NO: 8023 - DNA, 26 bp, synthetic construct
  misc_feature 1..26: note = Synthetic Construct
  source 1..26: mol_type = other DNA
ctgcaatagtttggtggagacataac

SEQ ID NO: 8024 - DNA, 20 bp, synthetic construct
  misc_feature 1..20: note = Synthetic Construct
  source 1..20: mol_type = other DNA
atgcccctgtgcctttgagt

SEQ ID NO: 8025 - DNA, 21 bp, synthetic construct
  misc_feature 1..21: note = Synthetic Construct
  source 1..21: mol_type = other DNA
agtcgcacccttccatctcat

SEQ ID NO: 8026 - DNA, 23 bp, synthetic construct
  misc_feature 1..23: note = Synthetic Construct
  source 1..23: mol_type = other DNA
cacctaattcctccccagatcct

SEQ ID NO: 8027 - DNA, 24 bp, synthetic construct
  misc_feature 1..24: note = Synthetic Construct
  source 1..24: mol_type = other DNA
ggaagacaaaggaggcaagacatc

SEQ ID NO: 8028 - DNA, 24 bp, synthetic construct
  misc_feature 1..24: note = Synthetic Construct
  source 1..24: mol_type = other DNA
gggttgccagtctgattgtggtaa

SEQ ID NO: 8029 - DNA, 23 bp, synthetic construct
  misc_feature 1..23: note = Synthetic Construct
  source 1..23: mol_type = other DNA
gccatgggctgtgatctcactta

SEQ ID NO: 8030 - DNA, 23 bp, synthetic construct
  misc_feature 1..23: note = Synthetic Construct
  source 1..23: mol_type = other DNA
gacaatcctcacaatggctctgt

SEQ ID NO: 8031 - DNA, 22 bp, synthetic construct
  misc_feature 1..22: note = Synthetic Construct
  source 1..22: mol_type = other DNA
agaccctgaccaccctgtttaa

SEQ ID NO: 8032 - DNA, 19 bp, synthetic construct
  misc_feature 1..19: note = Synthetic Construct
  source 1..19: mol_type = other DNA
tgctgctggggctgacaga

SEQ ID NO: 8033 - DNA, 25 bp, synthetic construct
  misc_feature 1..25: note = Synthetic Construct
  source 1..25: mol_type = other DNA
agtgatacccctgtgtagaatcgat

SEQ ID NO: 8034 - DNA, 21 bp, synthetic construct
  misc_feature 1..21: note = Synthetic Construct
  source 1..21: mol_type = other DNA
tgggtctagcctccctactgt

SEQ ID NO: 8035 - DNA, 21 bp, synthetic construct
  misc_feature 1..21: note = Synthetic Construct
  source 1..21: mol_type = other DNA
tcccaccttcccaggatgtca

SEQ ID NO: 8036 - DNA, 21 bp, synthetic construct
  misc_feature 1..21: note = Synthetic Construct
  source 1..21: mol_type = other DNA
agccatggagagacaggaact

SEQ ID NO: 8037 - DNA, 26 bp, synthetic construct
  misc_feature 1..26: note = Synthetic Construct
  source 1..26: mol_type = other DNA
catggttgctgtgataattggatcag

SEQ ID NO: 8038 - DNA, 22 bp, synthetic construct
  misc_feature 1..22: note = Synthetic Construct
  source 1..22: mol_type = other DNA
catccagggacaacaagactgt

SEQ ID NO: 8039 - DNA, 24 bp, synthetic construct
  misc_feature 1..24: note = Synthetic Construct
  source 1..24: mol_type = other DNA
gagccgcccaggtataaaataacc

SEQ ID NO: 8040 - DNA, 19 bp, synthetic construct
  misc_feature 1..19: note = Synthetic Construct
  source 1..19: mol_type = other DNA
tggtgccaatgcagttgct

SEQ ID NO: 8041 - DNA, 22 bp, synthetic construct
  misc_feature 1..22: note = Synthetic Construct
  source 1..22: mol_type = other DNA
aaggagcttggaagtcgccatt

SEQ ID NO: 8042 - DNA, 19 bp, synthetic construct
  misc_feature 1..19: note = Synthetic Construct
  source 1..19: mol_type = other DNA
atgtgcccccttccttcca

SEQ ID NO: 8043 - DNA, 19 bp, synthetic construct
  misc_feature 1..19: note = Synthetic Construct
  source 1..19: mol_type = other DNA
gccctcccctcagcttctg

SEQ ID NO: 8044 - DNA, 26 bp, synthetic construct
  misc_feature 1..26: note = Synthetic Construct
  source 1..26: mol_type = other DNA
ccaaaactcaggaaagaaaggtacga

SEQ ID NO: 8045 - DNA, 22 bp, synthetic construct
  misc_feature 1..22: note = Synthetic Construct
  source 1..22: mol_type = other DNA
aggtaaaccccatctggctttc

SEQ ID NO: 8046 - DNA, 27 bp, synthetic construct
  misc_feature 1..27: note = Synthetic Construct
  source 1..27: mol_type = other DNA
caacacacatatccaggtgtttttctc

SEQ ID NO: 8047 - DNA, 21 bp, synthetic construct
  misc_feature 1..21: note = Synthetic Construct
  source 1..21: mol_type = other DNA
atcaaccagcagggctcatca

SEQ ID NO: 8048 - DNA, 30 bp, synthetic construct
  misc_feature 1..30: note = Synthetic Construct
  source 1..30: mol_type = other DNA
gcataaagagtaggtggtttagaagggtta

SEQ ID NO: 8049 - DNA, 19 bp, synthetic construct
  misc_feature 1..19: note = Synthetic Construct
  source 1..19: mol_type = other DNA
tgcgtaaagcccccacaac

SEQ ID NO: 8050 - DNA, 21 bp, synthetic construct
  misc_feature 1..21: note = Synthetic Construct
  source 1..21: mol_type = other DNA
tgtgtgtttcgggtgggagta

SEQ ID NO: 8051 - DNA, 22 bp, synthetic construct
  misc_feature 1..22: note = Synthetic Construct
  source 1..22: mol_type = other DNA
aactcgccagtcccttcctaat

SEQ ID NO: 8052 - DNA, 21 bp, synthetic construct
  misc_feature 1..21: note = Synthetic Construct
  source 1..21: mol_type = other DNA
ccatgacccagagctcagaga

SEQ ID NO: 8053 - DNA, 21 bp, synthetic construct
  misc_feature 1..21: note = Synthetic Construct
  source 1..21: mol_type = other DNA
ccagccttgccaatcatacca

SEQ ID NO: 8054 - DNA, 24 bp, synthetic construct
  misc_feature 1..24: note = Synthetic Construct
  source 1..24: mol_type = other DNA
gcctgtgataactctggcttgatg

SEQ ID NO: 8055 - DNA, 21 bp, synthetic construct
  misc_feature 1..21: note = Synthetic Construct
  source 1..21: mol_type = other DNA
tgcacaagcctcagtgtttgg

SEQ ID NO: 8056 - DNA, 25 bp, synthetic construct
  misc_feature 1..25: note = Synthetic Construct
  source 1..25: mol_type = other DNA
tctggtgtttaaaagacaccctctt

SEQ ID NO: 8057 - DNA, 19 bp, synthetic construct
  misc_feature 1..19: note = Synthetic Construct
  source 1..19: mol_type = other DNA
gcacaggactggtgcttct

SEQ ID NO: 8058 - DNA, 22 bp, synthetic construct
  misc_feature 1..22: note = Synthetic Construct
  source 1..22: mol_type = other DNA
cctcatggggtggttgggaata

SEQ ID NO: 8059 - DNA, 20 bp, synthetic construct
  misc_feature 1..20: note = Synthetic Construct
  source 1..20: mol_type = other DNA
ggctctcagtcctccaaagc

SEQ ID NO: 8060 - DNA, 22 bp, synthetic construct
  misc_feature 1..22: note = Synthetic Construct
  source 1..22: mol_type = other DNA
gaggggcctgataaagtttggt

SEQ ID NO: 8061 - DNA, 18 bp, synthetic construct
  misc_feature 1..18: note = Synthetic Construct
  source 1..18: mol_type = other DNA
acaggccaggtggacagt

SEQ ID NO: 8062 - DNA, 24 bp, synthetic construct
  misc_feature 1..24: note = Synthetic Construct
  source 1..24: mol_type = other DNA
agcaggtacaccgttaatgagaag

SEQ ID NO: 8063 - DNA, 27 bp, synthetic construct
  misc_feature 1..27: note = Synthetic Construct
  source 1..27: mol_type = other DNA
ccttacctctactctgaactggacttg

SEQ ID NO: 8064 - DNA, 23 bp, synthetic construct
  misc_feature 1..23: note = Synthetic Construct
  source 1..23: mol_type = other DNA
aggcactctgagttacagtttgg

SEQ ID NO: 8065 - DNA, 22 bp, synthetic construct
  misc_feature 1..22: note = Synthetic Construct
  source 1..22: mol_type = other DNA
gaagccagcatggtctcatgtt

SEQ ID NO: 8066 - DNA, 25 bp, synthetic construct
  misc_feature 1..25: note = Synthetic Construct
  source 1..25: mol_type = other DNA
gactgtcttcaaatcagctgcattc

SEQ ID NO: 8067 - DNA, 22 bp, synthetic construct
  misc_feature 1..22: note = Synthetic Construct
  source 1..22: mol_type = other DNA
aagacagcaggagggagacatt

SEQ ID NO: 8068 - DNA, 24 bp, synthetic construct
  misc_feature 1..24: note = Synthetic Construct
  source 1..24: mol_type = other DNA
ctgtactttgcccatctctttcct

SEQ ID NO: 8069 - DNA, 24 bp, synthetic construct
  misc_feature 1..24: note = Synthetic Construct
  source 1..24: mol_type = other DNA
gctcaagccccctcaataatggat

SEQ ID NO: 8070 - DNA, 20 bp, synthetic construct
  misc_feature 1..20: note = Synthetic Construct
  source 1..20: mol_type = other DNA
acagacactgagcccagtca

SEQ ID NO: 8071 - DNA, 26 bp, synthetic construct
  misc_feature 1..26: note = Synthetic Construct
  source 1..26: mol_type = other DNA
tcacatagagcagtgttacttcttca

SEQ ID NO: 8072 - DNA, 26 bp, synthetic construct
  misc_feature 1..26: note = Synthetic Construct
  source 1..26: mol_type = other DNA
ggacatttgttaccaaaggctaagca

SEQ ID NO: 8073 - DNA, 24 bp, synthetic construct
  misc_feature 1..24: note = Synthetic Construct
  source 1..24: mol_type = other DNA
gagtaccctaacacaccccatagt

SEQ ID NO: 8074 - DNA, 22 bp, synthetic construct
  misc_feature 1..22: note = Synthetic Construct
  source 1..22: mol_type = other DNA
ttcccttgcagtgagcttttcc

SEQ ID NO: 8075 - DNA, 25 bp, synthetic construct
  misc_feature 1..25: note = Synthetic Construct
  source 1..25: mol_type = other DNA
gagacactcattttgcagagaacaa

SEQ ID NO: 8076 - DNA, 22 bp, synthetic construct
  misc_feature 1..22: note = Synthetic Construct
  source 1..22: mol_type = other DNA
tggtggcctgacttccttctga

SEQ ID NO: 8077 - DNA, 22 bp, synthetic construct
  misc_feature 1..22: note = Synthetic Construct
  source 1..22: mol_type = other DNA
gcactgaggattccagattcca

SEQ ID NO: 8078 - DNA, 23 bp, synthetic construct
  misc_feature 1..23: note = Synthetic Construct
  source 1..23: mol_type = other DNA
tcctcctgtctatctgcctttct

SEQ ID NO: 8079 - DNA, 24 bp, synthetic construct
  misc_feature 1..24: note = Synthetic Construct
  source 1..24: mol_type = other DNA
cctctgcttgtcagcccttatctt

SEQ ID NO: 8080 - DNA, 22 bp, synthetic construct
  misc_feature 1..22: note = Synthetic Construct
  source 1..22: mol_type = other DNA
tgggaaaagagaaccagttgca

SEQ ID NO: 8081 - DNA, 22 bp, synthetic construct
  misc_feature 1..22: note = Synthetic Construct
  source 1..22: mol_type = other DNA
gttcacatggagcatcgtgcat

SEQ ID NO: 8082 - DNA, 24 bp, synthetic construct
  misc_feature 1..24: note = Synthetic Construct
  source 1..24: mol_type = other DNA
gcaccaaaagggagagcaagtttc

SEQ ID NO: 8083 - DNA, 24 bp, synthetic construct
  misc_feature 1..24: note = Synthetic Construct
  source 1..24: mol_type = other DNA
agcaggacctgactctgacctata

SEQ ID NO: 8084 - DNA, 22 bp, synthetic construct
  misc_feature 1..22: note = Synthetic Construct
  source 1..22: mol_type = other DNA
aacctcagacccaggctctaca

SEQ ID NO: 8085 - DNA, 24 bp, synthetic construct
  misc_feature 1..24: note = Synthetic Construct
  source 1..24: mol_type = other DNA
ggcttccttgctgtaccttcatct

SEQ ID NO: 8086 - DNA, 23 bp, synthetic construct
  misc_feature 1..23: note = Synthetic Construct
  source 1..23: mol_type = other DNA
aggctgggaatgggattctttcc

SEQ ID NO: 8087 - DNA, 24 bp, synthetic construct
  misc_feature 1..24: note = Synthetic Construct
  source 1..24: mol_type = other DNA
gccttagtgagtggaagtcatgtt

SEQ ID NO: 8088 - DNA, 22 bp, synthetic construct
  misc_feature 1..22: note = Synthetic Construct
  source 1..22: mol_type = other DNA
ccaggacacagtgctactccaa

SEQ ID NO: 8089 - DNA, 22 bp, synthetic construct
  misc_feature 1..22: note = Synthetic Construct
  source 1..22: mol_type = other DNA
tctgacaatggtgccgatatgg

SEQ ID NO: 8090 - DNA, 20 bp, synthetic construct
  misc_feature 1..20: note = Synthetic Construct
  source 1..20: mol_type = other DNA
accagaagcaagggcagaca

SEQ ID NO: 8091 - DNA, 24 bp, synthetic construct
  misc_feature 1..24: note = Synthetic Construct
  source 1..24: mol_type = other DNA
tgccaggatttgatgacttgttga

SEQ ID NO: 8092 - DNA, 22 bp, synthetic construct
  misc_feature 1..22: note = Synthetic Construct
  source 1..22: mol_type = other DNA
tggaggccacccttatgtctca

SEQ ID NO: 8093 - DNA, 28 bp, synthetic construct
  misc_feature 1..28: note = Synthetic Construct
  source 1..28: mol_type = other DNA
agtgccagtatattattcaaacgtctct

SEQ ID NO: 8094 - DNA, 22 bp, synthetic construct
  misc_feature 1..22: note = Synthetic Construct
  source 1..22: mol_type = other DNA
gaaatctggctaggagcaaggt

SEQ ID NO: 8095 - DNA, 22 bp, synthetic construct
  misc_feature 1..22: note = Synthetic Construct
  source 1..22: mol_type = other DNA
ggccatttctacaggggattcc

SEQ ID NO: 8096 - DNA, 21 bp, synthetic construct
  misc_feature 1..21: note = Synthetic Construct
  source 1..21: mol_type = other DNA
cgctgaccctcccatagtgtt

SEQ ID NO: 8097 - DNA, 24 bp, synthetic construct
  misc_feature 1..24: note = Synthetic Construct
  source 1..24: mol_type = other DNA
cctgcataaagccctgatggtgaa

SEQ ID NO: 8098 - DNA, 19 bp, synthetic construct
  misc_feature 1..19: note = Synthetic Construct
  source 1..19: mol_type = other DNA
aggagggcaggtggaagca

SEQ ID NO: 8099 - DNA, 18 bp, synthetic construct
  misc_feature 1..18: note = Synthetic Construct
  source 1..18: mol_type = other DNA
gccccctcactggcttct

SEQ ID NO: 8100 - DNA, 24 bp, synthetic construct
  misc_feature 1..24: note = Synthetic Construct
  source 1..24: mol_type = other DNA
ggaaaacctcagagacgagggttt

SEQ ID NO: 8101 - DNA, 24 bp, synthetic construct
  misc_feature 1..24: note = Synthetic Construct
  source 1..24: mol_type = other DNA
tgggagtgctgtcattgagctatg

SEQ ID NO: 8102 - DNA, 26 bp, synthetic construct
  misc_feature 1..26: note = Synthetic Construct
  source 1..26: mol_type = other DNA
tgcacctatgatttttactgcacttg

SEQ ID NO: 8103 - DNA, 22 bp, synthetic construct
  misc_feature 1..22: note = Synthetic Construct
  source 1..22: mol_type = other DNA
tccagctgtcactgtggtatga

SEQ ID NO: 8104 - DNA, 22 bp, synthetic construct
  misc_feature 1..22: note = Synthetic Construct
  source 1..22: mol_type = other DNA
tgttgcggcttaggacatgcta

SEQ ID NO: 8105 - DNA, 24 bp, synthetic construct
  misc_feature 1..24: note = Synthetic Construct
  source 1..24: mol_type = other DNA
gggtgtctagatgggtgagtaagt

SEQ ID NO: 8106 - DNA, 29 bp, synthetic construct
  misc_feature 1..29: note = Synthetic Construct
  source 1..29: mol_type = other DNA
gcaaggtattcactatgattcccttacag

SEQ ID NO: 8107 - DNA, 23 bp, synthetic construct
  misc_feature 1..23: note = Synthetic Construct
  source 1..23: mol_type = other DNA
cagcccataaggtttctcttggt

SEQ ID NO: 8108 - DNA, 27 bp, synthetic construct
  misc_feature 1..27: note = Synthetic Construct
  source 1..27: mol_type = other DNA
gttgggagtttaagatagctgaatcac

SEQ ID NO: 8109 - DNA, 26 bp, synthetic construct
  misc_feature 1..26: note = Synthetic Construct
  source 1..26: mol_type = other DNA
gtataggcctagagactaaggtgtca

SEQ ID NO: 8110 - DNA, 26 bp, synthetic construct
  misc_feature 1..26: note = Synthetic Construct
  source 1..26: mol_type = other DNA
ggtaaatcagagtggactcagcatct

SEQ ID NO: 8111 - DNA, 24 bp, synthetic construct
  misc_feature 1..24: note = Synthetic Construct
  source 1..24: mol_type = other DNA
ccagtgccatgctctaaacaagga

SEQ ID NO: 8112 - DNA, 25 bp, synthetic construct
  misc_feature 1..25: note = Synthetic Construct
  source 1..25: mol_type = other DNA
gactctactgcaaaaggatctggat

SEQ ID NO: 8113 - DNA, 26 bp, synthetic construct
  misc_feature 1..26: note = Synthetic Construct
  source 1..26: mol_type = other DNA
gatgaaaagagatgaagggacatgac

SEQ ID NO: 8114 - DNA, 19 bp, synthetic construct
  misc_feature 1..19: note = Synthetic Construct
  source 1..19: mol_type = other DNA
gctgaccccttggcaccat

SEQ ID NO: 8115 - DNA, 21 bp, synthetic construct
  misc_feature 1..21: note = Synthetic Construct
  source 1..21: mol_type = other DNA
tctcaatggtggctgcaatca

SEQ ID NO: 8116 - DNA, 22 bp, synthetic construct
  misc_feature 1..22: note = Synthetic Construct
  source 1..22: mol_type = other DNA
ttggagcccagtgagcttcatc

SEQ ID NO: 8117 - DNA, 20 bp, synthetic construct
  misc_feature 1..20: note = Synthetic Construct
  source 1..20: mol_type = other DNA
tccttgcaagttgcctggaa

SEQ ID NO: 8118 - DNA, 19 bp, synthetic construct
  misc_feature 1..19: note = Synthetic Construct
  source 1..19: mol_type = other DNA
ttcccccacctccatgaca

SEQ ID NO: 8119 - DNA, 21 bp, synthetic construct
  misc_feature 1..21: note = Synthetic Construct
  source 1..21: mol_type = other DNA
gtgatcaagggggaggaacct

SEQ ID NO: 8120 - DNA, 25 bp, synthetic construct
  misc_feature 1..25: note = Synthetic Construct
  source 1..25: mol_type = other DNA
gctaaaatctcaggccattgctatc

SEQ ID NO: 8121 - DNA, 22 bp, synthetic construct
  misc_feature 1..22: note = Synthetic Construct
  source 1..22: mol_type = other DNA
gtccagggaatcagcaaagaca

SEQ ID NO: 8122 - DNA, 24 bp, synthetic construct
  misc_feature 1..24: note = Synthetic Construct
  source 1..24: mol_type = other DNA
cccccttcagaaaagcagctttca

SEQ ID NO: 8123 - DNA, 21 bp, synthetic construct
  misc_feature 1..21: note = Synthetic Construct
  source 1..21: mol_type = other DNA
tcccgtaacagcagcctaatc

SEQ ID NO: 8124 - DNA, 22 bp, synthetic construct
  misc_feature 1..22: note = Synthetic Construct
  source 1..22: mol_type = other DNA
ccttgatgtcctgctcaattgc

SEQ ID NO: 8125 - DNA, 22 bp, synthetic construct
  misc_feature 1..22: note = Synthetic Construct
  source 1..22: mol_type = other DNA
ggaggttgcacacagttggtat

SEQ ID NO: 8126 - DNA, 21 bp, synthetic construct
  misc_feature 1..21: note = Synthetic Construct
  source 1..21: mol_type = other DNA
tgggacaggcagaagaagtgt

SEQ ID NO: 8127 - DNA, 19 bp, synthetic construct
  misc_feature 1..19: note = Synthetic Construct
  source 1..19: mol_type = other DNA
aaacacccagcccccaaca

SEQ ID NO: 8128 - DNA, 25 bp, synthetic construct
  misc_feature 1..25: note = Synthetic Construct
  source 1..25: mol_type = other DNA
ccagttctgagcacagagttatgtg

SEQ ID NO: 8129 - DNA, 20 bp, synthetic construct
  misc_feature 1..20: note = Synthetic Construct
  source 1..20: mol_type = other DNA
ccaagcctgcagcaaggtta

SEQ ID NO: 8130 - DNA, 23 bp, synthetic construct
  misc_feature 1..23: note = Synthetic Construct
  source 1..23: mol_type = other DNA
gagttgcaggaggtagctgtatg

SEQ ID NO: 8131 - DNA, 22 bp, synthetic construct
  misc_feature 1..22: note = Synthetic Construct
  source 1..22: mol_type = other DNA
ggctgaacctgaggttttcact

SEQ ID NO: 8132 - DNA, 23 bp, synthetic construct
  misc_feature 1..23: note = Synthetic Construct
  source 1..23: mol_type = other DNA
ccaaaagagatcccatccttcca

SEQ ID NO: 8133 - DNA, 22 bp, synthetic construct
  misc_feature 1..22: note = Synthetic Construct
  source 1..22: mol_type = other DNA
aacccttcctcttcccagatga

SEQ ID NO: 8134 - DNA, 22 bp, synthetic construct
  misc_feature 1..22: note = Synthetic Construct
  source 1..22: mol_type = other DNA
tggggacatttgcatctcacat

SEQ ID NO: 8135 - DNA, 23 bp, synthetic construct
  misc_feature 1..23: note = Synthetic Construct
  source 1..23: mol_type = other DNA
ggttccagaactgttggaatcct

SEQ ID NO: 8136 - DNA, 24 bp, synthetic construct
  misc_feature 1..24: note = Synthetic Construct
  source 1..24: mol_type = other DNA
ggttccctaacgacatcctttcac

SEQ ID NO: 8137 - DNA, 26 bp, synthetic construct
  misc_feature 1..26: note = Synthetic Construct
  source 1..26: mol_type = other DNA
ctcctgatggttaaatcgtggaagac

SEQ ID NO: 8138 - DNA, 18 bp, synthetic construct
  misc_feature 1..18: note = Synthetic Construct
  source 1..18: mol_type = other DNA
cgaatccccggccagtct

SEQ ID NO: 8139 - DNA, 24 bp, synthetic construct
  misc_feature 1..24: note = Synthetic Construct
  source 1..24: mol_type = other DNA
ggcaggaaatgtttctgcctaagc

SEQ ID NO: 8140 - DNA, 22 bp, synthetic construct
  misc_feature 1..22: note = Synthetic Construct
  source 1..22: mol_type = other DNA
tggcagaactcaaggggcaaaa

SEQ ID NO: 8141 - DNA, 24 bp, synthetic construct
  misc_feature 1..24: note = Synthetic Construct
  source 1..24: mol_type = other DNA
tgccaactctgtaatcttgggaaa

SEQ ID NO: 8142 - DNA, 27 bp, synthetic construct
  misc_feature 1..27: note = Synthetic Construct
  source 1..27: mol_type = other DNA
cagaggatgcctaagagttttctaggt

SEQ ID NO: 8143 - DNA, 21 bp, synthetic construct
  misc_feature 1..21: note = Synthetic Construct
  source 1..21: mol_type = other DNA
acccctggtgtatcgtatgct

SEQ ID NO: 8144 - DNA, 18 bp, synthetic construct
  misc_feature 1..18: note = Synthetic Construct
  source 1..18: mol_type = other DNA
gtggcccacacgaaggtt

SEQ ID NO: 8145 - DNA, 21 bp, synthetic construct
  misc_feature 1..21: note = Synthetic Construct
  source 1..21: mol_type = other DNA
ctgtgtgcacctcaccctatc

SEQ ID NO: 8146 - DNA, 25 bp, synthetic construct
  misc_feature 1..25: note = Synthetic Construct
  source 1..25: mol_type = other DNA
gactttgggccctttttgattttca

SEQ ID NO: 8147 - DNA, 24 bp, synthetic construct
  misc_feature 1..24: note = Synthetic Construct
  source 1..24: mol_type = other DNA
ggacaccaaaaatctcagcaagtt

SEQ ID NO: 8148 - DNA, 22 bp, synthetic construct
  misc_feature 1..22: note = Synthetic Construct
  source 1..22: mol_type = other DNA
aggaatgtgtaggtggctgaga

SEQ ID NO: 8149 - DNA, 27 bp, synthetic construct
  misc_feature 1..27: note = Synthetic Construct
  source 1..27: mol_type = other DNA
gggagtaagggttgattttactttcgt

SEQ ID NO: 8150 - DNA, 25 bp, synthetic construct
  misc_feature 1..25: note = Synthetic Construct
  source 1..25: mol_type = other DNA
ggacataacctagtcgtatggcaaa

SEQ ID NO: 8151 - DNA, 23 bp, synthetic construct
  misc_feature 1..23: note = Synthetic Construct
  source 1..23: mol_type = other DNA
cccaaaagccatatgctctgttg

SEQ ID NO: 8152 - DNA, 22 bp, synthetic construct
  misc_feature 1..22: note = Synthetic Construct
  source 1..22: mol_type = other DNA
gccctgattaccctaagccaat

SEQ ID NO: 8153 - DNA, 29 bp, synthetic construct
  misc_feature 1..29: note = Synthetic Construct
  source 1..29: mol_type = other DNA
ccaataggcaaagaaattactctgttgga

SEQ ID NO: 8154 - DNA, 20 bp, synthetic construct
  misc_feature 1..20: note = Synthetic Construct
  source 1..20: mol_type = other DNA
tcccaggatcaccagagcat

SEQ ID NO: 8155 - DNA, 19 bp, synthetic construct
  misc_feature 1..19: note = Synthetic Construct
  source 1..19: mol_type = other DNA
tgcttggggcatgcgttca

SEQ ID NO: 8156 - DNA, 22 bp, synthetic construct
  misc_feature 1..22: note = Synthetic Construct
  source 1..22: mol_type = other DNA
tgctcccgaccttgtcagagta

SEQ ID NO: 8157 - DNA, 24 bp, synthetic construct
  misc_feature 1..24: note = Synthetic Construct
  source 1..24: mol_type = other DNA
ggagctacaatcacctgagctgaa

SEQ ID NO: 8158 - DNA, 22 bp, synthetic construct
  misc_feature 1..22: note = Synthetic Construct
  source 1..22: mol_type = other DNA
gacaattggcagacaccaacag

SEQ ID NO: 8159 - DNA, 20 bp, synthetic construct
  misc_feature 1..20: note = Synthetic Construct
  source 1..20: mol_type = other DNA
aggtgagctgggtcagacaa

SEQ ID NO: 8160 - DNA, 24 bp, synthetic construct
  misc_feature 1..24: note = Synthetic Construct
  source 1..24: mol_type = other DNA
ccactgctcttgaaaaggcctgaa

SEQ ID NO: 8161 - DNA, 22 bp, synthetic construct
  misc_feature 1..22: note = Synthetic Construct
  source 1..22: mol_type = other DNA
ggaatgaagagggcttctcaca

SEQ ID NO: 8162 - DNA, 25 bp, synthetic construct
  misc_feature 1..25: note = Synthetic Construct
  source 1..25: mol_type = other DNA
gagtctgcactgctaatctctacca

SEQ ID NO: 8163 - DNA, 21 bp, synthetic construct
  misc_feature 1..21: note = Synthetic Construct
  source 1..21: mol_type = other DNA
ggggggaatagcacagaaggt

SEQ ID NO: 8164 - DNA, 24 bp, synthetic construct
  misc_feature 1..24: note = Synthetic Construct
  source 1..24: mol_type = other DNA
gaaagatgggcagagttcttttgg

SEQ ID NO: 8165 - DNA, 22 bp, synthetic construct
  misc_feature 1..22: note = Synthetic Construct
  source 1..22: mol_type = other DNA
ggacgcacagcctttttatgag

SEQ ID NO: 8166 - DNA, 20 bp, synthetic construct
  misc_feature 1..20: note = Synthetic Construct
  source 1..20: mol_type = other DNA
gcagtgaaatgggcatgcat

SEQ ID NO: 8167 - DNA, 21 bp, synthetic construct
  misc_feature 1..21: note = Synthetic Construct
  source 1..21: mol_type = other DNA
ggtttgggtgggctagaaagc

SEQ ID NO: 8168 - DNA, 23 bp, synthetic construct
  misc_feature 1..23: note = Synthetic Construct
  source 1..23: mol_type = other DNA
tgcatctgctgatccttcagttc

SEQ ID NO: 8169 - DNA, 21 bp, synthetic construct
  misc_feature 1..21: note = Synthetic Construct
  source 1..21: mol_type = other DNA
agctgttggaagggtcaagct

SEQ ID NO: 8170 - DNA, 26 bp, synthetic construct
  misc_feature 1..26: note = Synthetic Construct
  source 1..26: mol_type = other DNA
caggtagatgaataaggccagaatgg

SEQ ID NO: 8171 - DNA, 19 bp, synthetic construct
  misc_feature 1..19: note = Synthetic Construct
  source 1..19: mol_type = other DNA
atggctgcagaggccttga

SEQ ID NO: 8172 - DNA, 22 bp, synthetic construct
  misc_feature 1..22: note = Synthetic Construct
  source 1..22: mol_type = other DNA
atttccctcccccaacatgtct

SEQ ID NO: 8173 - DNA, 22 bp, synthetic construct
  misc_feature 1..22: note = Synthetic Construct
  source 1..22: mol_type = other DNA
agccaccccctcgactattcaa

SEQ ID NO: 8174 - DNA, 21 bp, synthetic construct
  misc_feature 1..21: note = Synthetic Construct
  source 1..21: mol_type = other DNA
ggtggtgagtgcaaagaggat

SEQ ID NO: 8175 - DNA, 24 bp, synthetic construct
  misc_feature 1..24: note = Synthetic Construct
  source 1..24: mol_type = other DNA
gccttgtaccctgaaaacctccat

SEQ ID NO: 8176 - DNA, 28 bp, synthetic construct
  misc_feature 1..28: note = Synthetic Construct
  source 1..28: mol_type = other DNA
cactcttcatgggatcattactgtaact

SEQ ID NO: 8177 - DNA, 19 bp, synthetic construct
  misc_feature 1..19: note = Synthetic Construct
  source 1..19: mol_type = other DNA
cttggccacagcactggaa

SEQ ID NO: 8178 - DNA, 21 bp, synthetic construct
  misc_feature 1..21: note = Synthetic Construct
  source 1..21: mol_type = other DNA
ccacagggggttgggactaaa

SEQ ID NO: 8179 - DNA, 28 bp, synthetic construct
  misc_feature 1..28: note = Synthetic Construct
  source 1..28: mol_type = other DNA
gcctaataagaaagcttagggtacaagt

SEQ ID NO: 8180 - DNA, 22 bp, synthetic construct
  misc_feature 1..22: note = Synthetic Construct
  source 1..22: mol_type = other DNA
gcttgcaagggtgagtaactga

SEQ ID NO: 8181 - DNA, 28 bp, synthetic construct
  misc_feature 1..28: note = Synthetic Construct
  source 1..28: mol_type = other DNA
gtgatgcatgactatacttctacacaca

SEQ ID NO: 8182 - DNA, 25 bp, synthetic construct
  misc_feature 1..25: note = Synthetic Construct
  source 1..25: mol_type = other DNA
gctgttatggtatcggtgtctacaa

SEQ ID NO: 8183 - DNA, 20 bp, synthetic construct
  misc_feature 1..20: note = Synthetic Construct
  source 1..20: mol_type = other DNA
tgctcgtggttctgcagatt

SEQ ID NO: 8184 - DNA, 27 bp, synthetic construct
  misc_feature 1..27: note = Synthetic Construct
  source 1..27: mol_type = other DNA
gaagaggagtcaggtagatgttctaag

SEQ ID NO: 8185 - DNA, 21 bp, synthetic construct
  misc_feature 1..21: note = Synthetic Construct
  source 1..21: mol_type = other DNA
gctgagggagccaagcttaca

SEQ ID NO: 8186 - DNA, 23 bp, synthetic construct
  misc_feature 1..23: note = Synthetic Construct
  source 1..23: mol_type = other DNA
cacgagacttgttgatcctgtga

SEQ ID NO: 8187 - DNA, 26 bp, synthetic construct
  misc_feature 1..26: note = Synthetic Construct
  source 1..26: mol_type = other DNA
gggaagatgaccttagttcacacaga

SEQ ID NO: 8188 - DNA, 19 bp, synthetic construct
  misc_feature 1..19: note = Synthetic Construct
  source 1..19: mol_type = other DNA
acccctgcctcctgctctt

SEQ ID NO: 8189 - DNA, 25 bp, synthetic construct
  misc_feature 1..25: note = Synthetic Construct
  source 1..25: mol_type = other DNA
ctgctcacaactagagatggacatc

SEQ ID NO: 8190 - DNA, 22 bp, synthetic construct
  misc_feature 1..22: note = Synthetic Construct
  source 1..22: mol_type = other DNA
gcctgtagcatggtggtatggt

SEQ ID NO: 8191 - DNA, 27 bp, synthetic construct
  misc_feature 1..27: note = Synthetic Construct
  source 1..27: mol_type = other DNA
agtgtttccaaatacatagaccaccat

SEQ ID NO: 8192 - DNA, 28 bp, synthetic construct
  misc_feature 1..28: note = Synthetic Construct
  source 1..28: mol_type = other DNA
acaaaaatcttcacatatcatgccactt

SEQ ID NO: 8193 - DNA, 22 bp, synthetic construct
  misc_feature 1..22: note = Synthetic Construct
  source 1..22: mol_type = other DNA
cacaaggaagtgaggtgatcca

SEQ ID NO: 8194 - DNA, 24 bp, synthetic construct
  misc_feature 1..24: note = Synthetic Construct
  source 1..24: mol_type = other DNA
gctctgtggtcaaggggatgtaat

SEQ ID NO: 8195 - DNA, 20 bp, synthetic construct
  misc_feature 1..20: note = Synthetic Construct
  source 1..20: mol_type = other DNA
tcacctccctgtcccatgtt

SEQ ID NO: 8196 - DNA, 24 bp, synthetic construct
  misc_feature 1..24: note = Synthetic Construct
  source 1..24: mol_type = other DNA
aggtcagggactactagacatgct

SEQ ID NO: 8197 - DNA, 24 bp, synthetic construct
  misc_feature 1..24: note = Synthetic Construct
  source 1..24: mol_type = other DNA
tggctgtaaatcgctttgagtttg

SEQ ID NO: 8198 - DNA, 21 bp, synthetic construct
  misc_feature 1..21: note = Synthetic Construct
  source 1..21: mol_type = other DNA
gaagtgggctttgggcaaaat

SEQ ID NO: 8199 - DNA, 25 bp, synthetic construct
  misc_feature 1..25: note = Synthetic Construct
  source 1..25: mol_type = other DNA
tggaacagaaaagatgggataacga

SEQ ID NO: 8200 - DNA, 21 bp, synthetic construct
  misc_feature 1..21: note = Synthetic Construct
  source 1..21: mol_type = other DNA
cacttccccacccagaggtaa

SEQ ID NO: 8201 - DNA, 24 bp, synthetic construct
  misc_feature 1..24: note = Synthetic Construct
  source 1..24: mol_type = other DNA
gggagccttggaaggagtctttat

SEQ ID NO: 8202 - DNA, 22 bp, synthetic construct
  misc_feature 1..22: note = Synthetic Construct
  source 1..22: mol_type = other DNA
gaagggagaatggctgttggat

SEQ ID NO: 8203 - DNA, 24 bp, synthetic construct
  misc_feature 1..24: note = Synthetic Construct
  source 1..24: mol_type = other DNA
gtggaatcatgtccctgactgatg

SEQ ID NO: 8204 - DNA, 24 bp, synthetic construct
  misc_feature 1..24: note = Synthetic Construct
  source 1..24: mol_type = other DNA
tctctggtatctttcccactctgt

SEQ ID NO: 8205 - DNA, 26 bp, synthetic construct
  misc_feature 1..26: note = Synthetic Construct
  source 1..26: mol_type = other DNA
actttgaatcttaccaccagcttaga

SEQ ID NO: 8206 - DNA, 19 bp, synthetic construct
  misc_feature 1..19: note = Synthetic Construct
  source 1..19: mol_type = other DNA
cggttccacccaggtttgg

SEQ ID NO: 8207 - DNA, 22 bp, synthetic construct
  misc_feature 1..22: note = Synthetic Construct
  source 1..22: mol_type = other DNA
agttccaggggatgtcaatgct

SEQ ID NO: 8208 - DNA, 22 bp, synthetic construct
  misc_feature 1..22: note = Synthetic Construct
  source 1..22: mol_type = other DNA
aatgcctcaagccagtgttact

SEQ ID NO: 8209 - DNA, 24 bp, synthetic construct
  misc_feature 1..24: note = Synthetic Construct
  source 1..24: mol_type = other DNA
gaaaagtctgttgcctaggacaca

SEQ ID NO: 8210 - DNA, 26 bp, synthetic construct
  misc_feature 1..26: note = Synthetic Construct
  source 1..26: mol_type = other DNA
ggggcaggcatataatacacaatcaa

SEQ ID NO: 8211 - DNA, 26 bp, synthetic construct
  misc_feature 1..26: note = Synthetic Construct
  source 1..26: mol_type = other DNA
caaactgaaggtattgtttggtcctt

SEQ ID NO: 8212 - DNA, 23 bp, synthetic construct
  misc_feature 1..23: note = Synthetic Construct
  source 1..23: mol_type = other DNA
gctgttaaaaaccactgcacaca

SEQ ID NO: 8213 - DNA, 24 bp, synthetic construct
  misc_feature 1..24: note = Synthetic Construct
  source 1..24: mol_type = other DNA
ctcatcacgtggcttagtgttctg

SEQ ID NO: 8214 - DNA, 25 bp, synthetic construct
  misc_feature 1..25: note = Synthetic Construct
  source 1..25: mol_type = other DNA
ctattcatcaggctctgtgtacact

SEQ ID NO: 8215 - DNA, 26 bp, synthetic construct
  misc_feature 1..26: note = Synthetic Construct
  source 1..26: mol_type = other DNA
catcattagatgtgcctgtgtactct

SEQ ID NO: 8216 - DNA, 24 bp, synthetic construct
  misc_feature 1..24: note = Synthetic Construct
  source 1..24: mol_type = other DNA
ctcctccatgtaagctcctatgct

SEQ ID NO: 8217 - DNA, 18 bp, synthetic construct
  misc_feature 1..18: note = Synthetic Construct
  source 1..18: mol_type = other DNA
ccccgggcaagacaagct

SEQ ID NO: 8218 - DNA, 26 bp, synthetic construct
  misc_feature 1..26: note = Synthetic Construct
  source 1..26: mol_type = other DNA
ccccaccatctacactttctgaacag

SEQ ID NO: 8219 - DNA, 26 bp, synthetic construct
  misc_feature 1..26: note = Synthetic Construct
  source 1..26: mol_type = other DNA
gaagtgcctattcctaaaccaatcac

SEQ ID NO: 8220 - DNA, 26 bp, synthetic construct
  misc_feature 1..26: note = Synthetic Construct
  source 1..26: mol_type = other DNA
cccatggatagtagggaatggtgtag

SEQ ID NO: 8221 - DNA, 22 bp, synthetic construct
  misc_feature 1..22: note = Synthetic Construct
  source 1..22: mol_type = other DNA
gcctttgttgcccatcacttac

SEQ ID NO: 8222 - DNA, 24 bp, synthetic construct
  misc_feature 1..24: note = Synthetic Construct
  source 1..24: mol_type = other DNA
aagaagtggactgacatcggaatt

SEQ ID NO: 8223 - DNA, 25 bp, synthetic construct
  misc_feature 1..25: note = Synthetic Construct
  source 1..25: mol_type = other DNA
gtagccttgggaacattgtttaacc

SEQ ID NO: 8224 - DNA, 21 bp, synthetic construct
  misc_feature 1..21: note = Synthetic Construct
  source 1..21: mol_type = other DNA
ttatcctccctccccaaagca

SEQ ID NO: 8225 - DNA, 24 bp, synthetic construct
  misc_feature 1..24: note = Synthetic Construct
  source 1..24: mol_type = other DNA
cccagtggaagttgagtgtaagtc

SEQ ID NO: 8226 - DNA, 23 bp, synthetic construct
  misc_feature 1..23: note = Synthetic Construct
  source 1..23: mol_type = other DNA
ttgtagagggcctttctctcact

SEQ ID NO: 8227 - DNA, 25 bp, synthetic construct
  misc_feature 1..25: note = Synthetic Construct
  source 1..25: mol_type = other DNA
tgggagcaaaatgttttactttgca

SEQ ID NO: 8228 - DNA, 21 bp, synthetic construct
  misc_feature 1..21: note = Synthetic Construct
  source 1..21: mol_type = other DNA
agcctgcatctgactcctgta

SEQ ID NO: 8229 - DNA, 23 bp, synthetic construct
  misc_feature 1..23: note = Synthetic Construct
  source 1..23: mol_type = other DNA
gaatcaggaagtccagcacaagt

SEQ ID NO: 8230 - DNA, 24 bp, synthetic construct
  misc_feature 1..24: note = Synthetic Construct
  source 1..24: mol_type = other DNA
ggtttctgccaatgacatctcaca

SEQ ID NO: 8231 - DNA, 21 bp, synthetic construct
  misc_feature 1..21: note = Synthetic Construct
  source 1..21: mol_type = other DNA
cccgcatcgttttaggggtaa

SEQ ID NO: 8232 - DNA, 24 bp, synthetic construct
  misc_feature 1..24: note = Synthetic Construct
  source 1..24: mol_type = other DNA
ctctccaatgcccctttcttcttc

SEQ ID NO: 8233 - DNA, 20 bp, synthetic construct
  misc_feature 1..20: note = Synthetic Construct
  source 1..20: mol_type = other DNA
gggtgtgctccagaatgcat

SEQ ID NO: 8234 - DNA, 22 bp, synthetic construct
  misc_feature 1..22: note = Synthetic Construct
  source 1..22: mol_type = other DNA
acagctgcctgaatttggaaac

SEQ ID NO: 8235 - DNA, 22 bp, synthetic construct
  misc_feature 1..22: note = Synthetic Construct
  source 1..22: mol_type = other DNA
agatcacattgggtcccacaca

SEQ ID NO: 8236 - DNA, 24 bp, synthetic construct
  misc_feature 1..24: note = Synthetic Construct
  source 1..24: mol_type = other DNA
ctcacaagtggaattggagctctt

SEQ ID NO: 8237 - DNA, 25 bp, synthetic construct
  misc_feature 1..25: note = Synthetic Construct
  source 1..25: mol_type = other DNA
ccactttagctaccttggagaacat

SEQ ID NO: 8238 - DNA, 22 bp, synthetic construct
  misc_feature 1..22: note = Synthetic Construct
  source 1..22: mol_type = other DNA
cagtttgtggagccttgctttt

SEQ ID NO: 8239 - DNA, 22 bp, synthetic construct
  misc_feature 1..22: note = Synthetic Construct
  source 1..22: mol_type = other DNA
agggtgccaaacaggtttatgg

SEQ ID NO: 8240 - DNA, 18 bp, synthetic construct
  misc_feature 1..18: note = Synthetic Construct
  source 1..18: mol_type = other DNA
tgccacgctgccacatct

SEQ ID NO: 8241 - DNA, 21 bp, synthetic construct
  misc_feature 1..21: note = Synthetic Construct
  source 1..21: mol_type = other DNA
accttcaggcccacctactgt

SEQ ID NO: 8242 - DNA, 27 bp, synthetic construct
  misc_feature 1..27: note = Synthetic Construct
  source 1..27: mol_type = other DNA
gaaacctgtagagtcttacatgccatt

SEQ ID NO: 8243 - DNA, 20 bp, synthetic construct
  misc_feature 1..20: note = Synthetic Construct
  source 1..20: mol_type = other DNA
cctaggctggcccaagatga

SEQ ID NO: 8244 - DNA, 19 bp, synthetic construct
  misc_feature 1..19: note = Synthetic Construct
  source 1..19: mol_type = other DNA
ctcaccatgcgcagttcct

SEQ ID NO: 8245 - DNA, 24 bp, synthetic construct
  misc_feature 1..24: note = Synthetic Construct
  source 1..24: mol_type = other DNA
cacaggtcagacaaggctaaaacc

SEQ ID NO: 8246 - DNA, 22 bp, synthetic construct
  misc_feature 1..22: note = Synthetic Construct
  source 1..22: mol_type = other DNA
aggactagcccttggtttggat

SEQ ID NO: 8247 - DNA, 22 bp, synthetic construct
  misc_feature 1..22: note = Synthetic Construct
  source 1..22: mol_type = other DNA
aggcagaccactaactggagaa

SEQ ID NO: 8248 - DNA, 20 bp, synthetic construct
  misc_feature 1..20: note = Synthetic Construct
  source 1..20: mol_type = other DNA
accactggtcccagcaacta

SEQ ID NO: 8249 - DNA, 20 bp, synthetic construct
  misc_feature 1..20: note = Synthetic Construct
  source 1..20: mol_type = other DNA
agctgctacccacctaaggt

SEQ ID NO: 8250 - DNA, 26 bp, synthetic construct
  misc_feature 1..26: note = Synthetic Construct
  source 1..26: mol_type = other DNA
gcttatctgggattgctaccaactag

SEQ ID NO: 8251 - DNA, 22 bp, synthetic construct
  misc_feature 1..22: note = Synthetic Construct
  source 1..22: mol_type = other DNA
tgccttggatggtgtggcaaca

SEQ ID NO: 8252 - DNA, 26 bp, synthetic construct
  misc_feature 1..26: note = Synthetic Construct
  source 1..26: mol_type = other DNA
ccaggtaggtaaaacctcttggattc

SEQ ID NO: 8253 - DNA, 26 bp, synthetic construct
  misc_feature 1..26: note = Synthetic Construct
  source 1..26: mol_type = other DNA
ctccaacaagccacgtatatgttagg

SEQ ID NO: 8254 - DNA, 19 bp, synthetic construct
  misc_feature 1..19: note = Synthetic Construct
  source 1..19: mol_type = other DNA
gggacagatgcggcaacaa

SEQ ID NO: 8255 - DNA, 25 bp, synthetic construct
  misc_feature 1..25: note = Synthetic Construct
  source 1..25: mol_type = other DNA
ggcagcttgagcaatcttctaaagg

SEQ ID NO: 8256 - DNA, 25 bp, synthetic construct
  misc_feature 1..25: note = Synthetic Construct
  source 1..25: mol_type = other DNA
gtgacattttcctgtgtccttgagt

SEQ ID NO: 8257 - DNA, 26 bp, synthetic construct
  misc_feature 1..26: note = Synthetic Construct
  source 1..26: mol_type = other DNA
gcaggaaggatgagggttagatacca

SEQ ID NO: 8258 - DNA, 22 bp, synthetic construct
  misc_feature 1..22: note = Synthetic Construct
  source 1..22: mol_type = other DNA
ggagtccacagaggcagcttat

SEQ ID NO: 8259 - DNA, 19 bp, synthetic construct
  misc_feature 1..19: note = Synthetic Construct
  source 1..19: mol_type = other DNA
ccgtcttgggtggttcaca

SEQ ID NO: 8260 - DNA, 23 bp, synthetic construct
  misc_feature 1..23: note = Synthetic Construct
  source 1..23: mol_type = other DNA
ctctgcttctcacactgtgcaaa

SEQ ID NO: 8261 - DNA, 23 bp, synthetic construct
  misc_feature 1..23: note = Synthetic Construct
  source 1..23: mol_type = other DNA
gcttaaagctgcagtggagaaca

SEQ ID NO: 8262 - DNA, 22 bp, synthetic construct
  misc_feature 1..22: note = Synthetic Construct
  source 1..22: mol_type = other DNA
ggcactagtgatcctcctacct

SEQ ID NO: 8263 - DNA, 24 bp, synthetic construct
  misc_feature 1..24: note = Synthetic Construct
  source 1..24: mol_type = other DNA
ctatgtctcctccctgcataggta

SEQ ID NO: 8264 - DNA, 23 bp, synthetic construct
  misc_feature 1..23: note = Synthetic Construct
  source 1..23: mol_type = other DNA
agtttcctgcagaaagacaagca

SEQ ID NO: 8265 - DNA, 18 bp, synthetic construct
  misc_feature 1..18: note = Synthetic Construct
  source 1..18: mol_type = other DNA
aggaggcttgccctgtgt

SEQ ID NO: 8266 - DNA, 27 bp, synthetic construct
  misc_feature 1..27: note = Synthetic Construct
  source 1..27: mol_type = other DNA
gcacacttgtcctagtaacaggtgaat

SEQ ID NO: 8267 - DNA, 20 bp, synthetic construct
  misc_feature 1..20: note = Synthetic Construct
  source 1..20: mol_type = other DNA
tgggagtggagcaggaatcc

SEQ ID NO: 8268 - DNA, 22 bp, synthetic construct
  misc_feature 1..22: note = Synthetic Construct
  source 1..22: mol_type = other DNA
tggggaaactgaccaacacaag

SEQ ID NO: 8269 - DNA, 22 bp, synthetic construct
  misc_feature 1..22: note = Synthetic Construct
  source 1..22: mol_type = other DNA
ccctgatcactgcattctggat

SEQ ID NO: 8270 - DNA, 23 bp, synthetic construct
  misc_feature 1..23: note = Synthetic Construct
  source 1..23: mol_type = other DNA
gtggggagtcaccaatgatactt

SEQ ID NO: 8271 - DNA, 22 bp, synthetic construct
  misc_feature 1..22: note = Synthetic Construct
  source 1..22: mol_type = other DNA
ctggaggtccttcaaggtcttg

SEQ ID NO: 8272 - DNA, 24 bp, synthetic construct
  misc_feature 1..24: note = Synthetic Construct
  source 1..24: mol_type = other DNA
aggggaagtgacacagagttacag

SEQ ID NO: 8273 - DNA, 22 bp, synthetic construct
  misc_feature 1..22: note = Synthetic Construct
  source 1..22: mol_type = other DNA
gttcccacatccttgtgcatct

SEQ ID NO: 8274 - DNA, 24 bp, synthetic construct
  misc_feature 1..24: note = Synthetic Construct
  source 1..24: mol_type = other DNA
cacagctgatgcaaactagctctt

SEQ ID NO: 8275 - DNA, 24 bp, synthetic construct
  misc_feature 1..24: note = Synthetic Construct
  source 1..24: mol_type = other DNA
cgcactcagcctttgttgtagaag

SEQ ID NO: 8276 - DNA, 24 bp, synthetic construct
  misc_feature 1..24: note = Synthetic Construct
  source 1..24: mol_type = other DNA
ctcaggtatggaggatgcaggaat

SEQ ID NO: 8277 - DNA, 26 bp, synthetic construct
  misc_feature 1..26: note = Synthetic Construct
  source 1..26: mol_type = other DNA
cgcatagtccacaactgggatacttc

SEQ ID NO: 8278 - DNA, 23 bp, synthetic construct
  misc_feature 1..23: note = Synthetic Construct
  source 1..23: mol_type = other DNA
caccaccaaacaaaccccaaatc

SEQ ID NO: 8279 - DNA, 20 bp, synthetic construct
  misc_feature 1..20: note = Synthetic Construct
  source 1..20: mol_type = other DNA
tgtcccctccctacctcaca

SEQ ID NO: 8280 - DNA, 24 bp, synthetic construct
  misc_feature 1..24: note = Synthetic Construct
  source 1..24: mol_type = other DNA
gaacagagagaatgaggggagaga

SEQ ID NO: 8281 - DNA, 22 bp, synthetic construct
  misc_feature 1..22: note = Synthetic Construct
  source 1..22: mol_type = other DNA
tggaggtttgtgtcacccttct

SEQ ID NO: 8282 - DNA, 22 bp, synthetic construct
  misc_feature 1..22: note = Synthetic Construct
  source 1..22: mol_type = other DNA
agtcagaacctgccacttcact

SEQ ID NO: 8283 - DNA, 24 bp, synthetic construct
  misc_feature 1..24: note = Synthetic Construct
  source 1..24: mol_type = other DNA
gcagataggatggtctggaatgtc

SEQ ID NO: 8284 - DNA, 28 bp, synthetic construct
  misc_feature 1..28: note = Synthetic Construct
  source 1..28: mol_type = other DNA
ggaaagcccctagtcacttagtcatatg

SEQ ID NO: 8285 - DNA, 19 bp, synthetic construct
  misc_feature 1..19: note = Synthetic Construct
  source 1..19: mol_type = other DNA
aaggggctggtggcttcca

SEQ ID NO: 8286 - DNA, 25 bp, synthetic construct
  misc_feature 1..25: note = Synthetic Construct
  source 1..25: mol_type = other DNA
tgctggacttgcatttcaaattagg

SEQ ID NO: 8287 - DNA, 22 bp, synthetic construct
  misc_feature 1..22: note = Synthetic Construct
  source 1..22: mol_type = other DNA
tcaaactgtgggttgcaatcca

SEQ ID NO: 8288 - DNA, 25 bp, synthetic construct
  misc_feature 1..25: note = Synthetic Construct
  source 1..25: mol_type = other DNA
gctcatccttcaggcttaaggacaa

SEQ ID NO: 8289 - DNA, 22 bp, synthetic construct
  misc_feature 1..22: note = Synthetic Construct
  source 1..22: mol_type = other DNA
agagagcaagccagtgagtaga

SEQ ID NO: 8290 - DNA, 22 bp, synthetic construct
  misc_feature 1..22: note = Synthetic Construct
  source 1..22: mol_type = other DNA
acaccactgctcccaagttgta

SEQ ID NO: 8291 - DNA, 26 bp, synthetic construct
  misc_feature 1..26: note = Synthetic Construct
  source 1..26: mol_type = other DNA
agctgcttactacataccatcatcag

SEQ ID NO: 8292 - DNA, 24 bp, synthetic construct
  misc_feature 1..24: note = Synthetic Construct
  source 1..24: mol_type = other DNA
gcagtttgtttcctgggctaatcc

SEQ ID NO: 8293 - DNA, 24 bp, synthetic construct
  misc_feature 1..24: note = Synthetic Construct
  source 1..24: mol_type = other DNA
acaccaacatagctttcagttcct

SEQ ID NO: 8294 - DNA, 23 bp, synthetic construct
  misc_feature 1..23: note = Synthetic Construct
  source 1..23: mol_type = other DNA
cacagcaagaataaagccaagct

SEQ ID NO: 8295 - DNA, 25 bp, synthetic construct
  misc_feature 1..25: note = Synthetic Construct
  source 1..25: mol_type = other DNA
gagtttggtagcacagcaaaaactg

SEQ ID NO: 8296 - DNA, 24 bp, synthetic construct
  misc_feature 1..24: note = Synthetic Construct
  source 1..24: mol_type = other DNA
ctgtgtgtagcctttgctctcaag

SEQ ID NO: 8297 - DNA, 22 bp, synthetic construct
  misc_feature 1..22: note = Synthetic Construct
  source 1..22: mol_type = other DNA
gcttgggaaagggaggtcaatt

SEQ ID NO: 8298 - DNA, 23 bp, synthetic construct
  misc_feature 1..23: note = Synthetic Construct
  source 1..23: mol_type = other DNA
acacataggcctagggaaagaca

SEQ ID NO: 8299 - DNA, 24 bp, synthetic construct
  misc_feature 1..24: note = Synthetic Construct
  source 1..24: mol_type = other DNA
ggacctgcttgcagagtttatgat

SEQ ID NO: 8300 - DNA, 24 bp, synthetic construct
  misc_feature 1..24: note = Synthetic Construct
  source 1..24: mol_type = other DNA
ggctgcaactaaatttcccaaacc

SEQ ID NO: 8301 - DNA, 22 bp, synthetic construct
  misc_feature 1..22: note = Synthetic Construct
  source 1..22: mol_type = other DNA
agcatttggcagccagtgaaag

SEQ ID NO: 8302 - DNA, 21 bp, synthetic construct
  misc_feature 1..21: note = Synthetic Construct
  source 1..21: mol_type = other DNA
tcgcctcctggtgagcttgta

SEQ ID NO: 8303 - DNA, 26 bp, synthetic construct
  misc_feature 1..26: note = Synthetic Construct
  source 1..26: mol_type = other DNA
ggacagattcagaaggagggagaata

SEQ ID NO: 8304 - DNA, 22 bp, synthetic construct
  misc_feature 1..22: note = Synthetic Construct
  source 1..22: mol_type = other DNA
ggagccccaaagtgcaacaatt

SEQ ID NO: 8305 - DNA, 22 bp, synthetic construct
  misc_feature 1..22: note = Synthetic Construct
  source 1..22: mol_type = other DNA
gcaccctggctgttttgcaaat

SEQ ID NO: 8306 - DNA, 26 bp, synthetic construct
  misc_feature 1..26: note = Synthetic Construct
  source 1..26: mol_type = other DNA
gctgagttcaagtctaaggaggattg

SEQ ID NO: 8307 - DNA, 25 bp, synthetic construct
  misc_feature 1..25: note = Synthetic Construct
  source 1..25: mol_type = other DNA
ggctgttgacagtctatttttggaa

SEQ ID NO: 8308 - DNA, 23 bp, synthetic construct
  misc_feature 1..23: note = Synthetic Construct
  source 1..23: mol_type = other DNA
gcgtgaaacctaaacaagctcaa

SEQ ID NO: 8309 - DNA, 23 bp, synthetic construct
  misc_feature 1..23: note = Synthetic Construct
  source 1..23: mol_type = other DNA
agttccaggagatgcctttagtg

SEQ ID NO: 8310 - DNA, 22 bp, synthetic construct
  misc_feature 1..22: note = Synthetic Construct
  source 1..22: mol_type = other DNA
tggaagcgtggattttgctaga

SEQ ID NO: 8311 - DNA, 26 bp, synthetic construct
  misc_feature 1..26: note = Synthetic Construct
  source 1..26: mol_type = other DNA
ctggtggttcttccatgttcattatc

SEQ ID NO: 8312 - DNA, 22 bp, synthetic construct
  misc_feature 1..22: note = Synthetic Construct
  source 1..22: mol_type = other DNA
gaggaaccagggagtaccttca

SEQ ID NO: 8313 - DNA, 24 bp, synthetic construct
  misc_feature 1..24: note = Synthetic Construct
  source 1..24: mol_type = other DNA
ggaacactacaacaacccaatcct

SEQ ID NO: 8314 - DNA, 22 bp, synthetic construct
  misc_feature 1..22: note = Synthetic Construct
  source 1..22: mol_type = other DNA
gagagccaggaacttccaagca

SEQ ID NO: 8315 - DNA, 24 bp, synthetic construct
  misc_feature 1..24: note = Synthetic Construct
  source 1..24: mol_type = other DNA
aggatcacatcagtagtgtgcttt

SEQ ID NO: 8316 - DNA, 24 bp, synthetic construct
  misc_feature 1..24: note = Synthetic Construct
  source 1..24: mol_type = other DNA
gcaaaggactgtaggtggatagga

SEQ ID NO: 8317 - DNA, 20 bp, synthetic construct
  misc_feature 1..20: note = Synthetic Construct
  source 1..20: mol_type = other DNA
tgtgcataactggggtgcat

SEQ ID NO: 8318 - DNA, 25 bp, synthetic construct
  misc_feature 1..25: note = Synthetic Construct
  source 1..25: mol_type = other DNA
caatacagtagtgccgagacagatc

SEQ ID NO: 8319 - DNA, 24 bp, synthetic construct
  misc_feature 1..24: note = Synthetic Construct
  source 1..24: mol_type = other DNA
gactaggctggaaactgagttacc

SEQ ID NO: 8320 - DNA, 22 bp, synthetic construct
  misc_feature 1..22: note = Synthetic Construct
  source 1..22: mol_type = other DNA
ggtgccatgttattgcatgcaa

SEQ ID NO: 8321 - DNA, 22 bp, synthetic construct
  misc_feature 1..22: note = Synthetic Construct
  source 1..22: mol_type = other DNA
aggggagtgggatgacctgatt

SEQ ID NO: 8322 - DNA, 21 bp, synthetic construct
  misc_feature 1..21: note = Synthetic Construct
  source 1..21: mol_type = other DNA
cggcaagtctcctgacctctt

SEQ ID NO: 8323 - DNA, 22 bp, synthetic construct
  misc_feature 1..22: note = Synthetic Construct
  source 1..22: mol_type = other DNA
tgctggatggggtctgaaaaat

SEQ ID NO: 8324 - DNA, 25 bp, synthetic construct
  misc_feature 1..25: note = Synthetic Construct
  source 1..25: mol_type = other DNA
gcatgtctcaccttctaaaatgctt

SEQ ID NO: 8325 - DNA, 22 bp, synthetic construct
  misc_feature 1..22: note = Synthetic Construct
  source 1..22: mol_type = other DNA
tcaagatgcggcctatttccat

SEQ ID NO: 8326 - DNA, 20 bp, synthetic construct
  misc_feature 1..20: note = Synthetic Construct
  source 1..20: mol_type = other DNA
ggtccctggggcttcggata

SEQ ID NO: 8327 - DNA, 26 bp, synthetic construct
  misc_feature 1..26: note = Synthetic Construct
  source 1..26: mol_type = other DNA
cctatagacctctgcaggacaatatg

SEQ ID NO: 8328 - DNA, 22 bp, synthetic construct
  misc_feature 1..22: note = Synthetic Construct
  source 1..22: mol_type = other DNA
tcctgggatgtctacagcaaca

SEQ ID NO: 8329 - DNA, 22 bp, synthetic construct
  misc_feature 1..22: note = Synthetic Construct
  source 1..22: mol_type = other DNA
cctccaccgggttactgtttct

SEQ ID NO: 8330 - DNA, 26 bp, synthetic construct
  misc_feature 1..26: note = Synthetic Construct
  source 1..26: mol_type = other DNA
agatgacaactaatgactcggtgtaa

SEQ ID NO: 8331 - DNA, 22 bp, synthetic construct
  misc_feature 1..22: note = Synthetic Construct
  source 1..22: mol_type = other DNA
agagcaagggtcaacacactac

SEQ ID NO: 8332 - DNA, 26 bp, synthetic construct
  misc_feature 1..26: note = Synthetic Construct
  source 1..26: mol_type = other DNA
cgaatgaacagcactctaccccttag

SEQ ID NO: 8333 - DNA, 21 bp, synthetic construct
  misc_feature 1..21: note = Synthetic Construct
  source 1..21: mol_type = other DNA
tgagccagtggttcagtttgg

SEQ ID NO: 8334 - DNA, 20 bp, synthetic construct
  misc_feature 1..20: note = Synthetic Construct
  source 1..20: mol_type = other DNA
ggagacgctgtacccacaaa

SEQ ID NO: 8335 - DNA, 25 bp, synthetic construct
  misc_feature 1..25: note = Synthetic Construct
  source 1..25: mol_type = other DNA
gtgtaagggggcacgaagaaataac

SEQ ID NO: 8336 - DNA, 20 bp, synthetic construct
  misc_feature 1..20: note = Synthetic Construct
  source 1..20: mol_type = other DNA
tcatgcaagggcctgtgttt

SEQ ID NO: 8337 - DNA, 22 bp, synthetic construct
  misc_feature 1..22: note = Synthetic Construct
  source 1..22: mol_type = other DNA
ccttcatccatgcctctggttt

SEQ ID NO: 8338 - DNA, 22 bp, synthetic construct
  misc_feature 1..22: note = Synthetic Construct
  source 1..22: mol_type = other DNA
aggaggccagattgcagtacag

SEQ ID NO: 8339 - DNA, 25 bp, synthetic construct
  misc_feature 1..25: note = Synthetic Construct
  source 1..25: mol_type = other DNA
tcaatttatatcgcctggactacgt

SEQ ID NO: 8340 - DNA, 24 bp, synthetic construct
  misc_feature 1..24: note = Synthetic Construct
  source 1..24: mol_type = other DNA
ggattctccaggcagaagtagtgt

SEQ ID NO: 8341 - DNA, 25 bp, synthetic construct
  misc_feature 1..25: note = Synthetic Construct
  source 1..25: mol_type = other DNA
ggtgagaattaacttggcctaatgc

SEQ ID NO: 8342 - DNA, 22 bp, synthetic construct
  misc_feature 1..22: note = Synthetic Construct
  source 1..22: mol_type = other DNA
ggaaagattccctggtctgcat

SEQ ID NO: 8343 - DNA, 23 bp, synthetic construct
  misc_feature 1..23: note = Synthetic Construct
  source 1..23: mol_type = other DNA
ggaaactctcaaggcatcaaggt

SEQ ID NO: 8344 - DNA, 22 bp, synthetic construct
  misc_feature 1..22: note = Synthetic Construct
  source 1..22: mol_type = other DNA
ccccaaatcctgccaatcctat

SEQ ID NO: 8345 - DNA, 24 bp, synthetic construct
  misc_feature 1..24: note = Synthetic Construct
  source 1..24: mol_type = other DNA
gaggagagacagcagtgtttgtaa

SEQ ID NO: 8346 - DNA, 22 bp, synthetic construct
  misc_feature 1..22: note = Synthetic Construct
  source 1..22: mol_type = other DNA
tgatgaggcaccaaggttacac

SEQ ID NO: 8347 - DNA, 25 bp, synthetic construct
  misc_feature 1..25: note = Synthetic Construct
  source 1..25: mol_type = other DNA
ggcagataatctcaccccattttgg

SEQ ID NO: 8348 - DNA, 22 bp, synthetic construct
  misc_feature 1..22: note = Synthetic Construct
  source 1..22: mol_type = other DNA
tggcgtgctgtcattctacatg

SEQ ID NO: 8349 - DNA, 21 bp, synthetic construct
  misc_feature 1..21: note = Synthetic Construct
  source 1..21: mol_type = other DNA
tctcagagcctccctttgcat

SEQ ID NO: 8350 - DNA, 26 bp, synthetic construct
  misc_feature 1..26: note = Synthetic Construct
  source 1..26: mol_type = other DNA
tggagacagggaaatatgaggagtag

SEQ ID NO: 8351 - DNA, 19 bp, synthetic construct
  misc_feature 1..19: note = Synthetic Construct
  source 1..19: mol_type = other DNA
tccccgaacatgggcagat

SEQ ID NO: 8352 - DNA, 21 bp, synthetic construct
  misc_feature 1..21: note = Synthetic Construct
  source 1..21: mol_type = other DNA
tcccaacctccagccctttaa

SEQ ID NO: 8353 - DNA, 24 bp, synthetic construct
  misc_feature 1..24: note = Synthetic Construct
  source 1..24: mol_type = other DNA
gcactaagaacacagggggaaagt

SEQ ID NO: 8354 - DNA, 24 bp, synthetic construct
  misc_feature 1..24: note = Synthetic Construct
  source 1..24: mol_type = other DNA
ctcaaagcctggaattggaatggt

SEQ ID NO: 8355 - DNA, 23 bp, synthetic construct
  misc_feature 1..23: note = Synthetic Construct
  source 1..23: mol_type = other DNA
ccagctgtaatttgtggccaaaa

SEQ ID NO: 8356 - DNA, 27 bp, synthetic construct
  misc_feature 1..27: note = Synthetic Construct
  source 1..27: mol_type = other DNA
ggcctcaagaactttctactcattcct

SEQ ID NO: 8357 - DNA, 20 bp, synthetic construct
  misc_feature 1..20: note = Synthetic Construct
  source 1..20: mol_type = other DNA
ggtgactgggggtacacagt

SEQ ID NO: 8358 - DNA, 23 bp, synthetic construct
  misc_feature 1..23: note = Synthetic Construct
  source 1..23: mol_type = other DNA
aggccccatcttactcactttcc

SEQ ID NO: 8359 - DNA, 22 bp, synthetic construct
  misc_feature 1..22: note = Synthetic Construct
  source 1..22: mol_type = other DNA
gcttgggtttggctgacatcta

SEQ ID NO: 8360 - DNA, 21 bp, synthetic construct
  misc_feature 1..21: note = Synthetic Construct
  source 1..21: mol_type = other DNA
ccactccaagggtgggtccta

SEQ ID NO: 8361 - DNA, 23 bp, synthetic construct
  misc_feature 1..23: note = Synthetic Construct
  source 1..23: mol_type = other DNA
tgggtcccaatgccaagtaaagg

SEQ ID NO: 8362 - DNA, 23 bp, synthetic construct
  misc_feature 1..23: note = Synthetic Construct
  source 1..23: mol_type = other DNA
tgaaaagctctggagtcacactt

SEQ ID NO: 8363 - DNA, 21 bp, synthetic construct
  misc_feature 1..21: note = Synthetic Construct
  source 1..21: mol_type = other DNA
catttccgctcacaagccatt

SEQ ID NO: 8364 - DNA, 26 bp, synthetic construct
  misc_feature 1..26: note = Synthetic Construct
  source 1..26: mol_type = other DNA
cccatacaaggatccaagtacctgtt

SEQ ID NO: 8365 - DNA, 24 bp, synthetic construct
  misc_feature 1..24: note = Synthetic Construct
  source 1..24: mol_type = other DNA
caaagccatatgacaaaggaagca

SEQ ID NO: 8366 - DNA, 20 bp, synthetic construct
  misc_feature 1..20: note = Synthetic Construct
  source 1..20: mol_type = other DNA
agaagcgagggtgcaaatgc

SEQ ID NO: 8367 - DNA, 22 bp, synthetic construct
  misc_feature 1..22: note = Synthetic Construct
  source 1..22: mol_type = other DNA
agcaggaatcaggcaggaaaaa

SEQ ID NO: 8368 - DNA, 19 bp, synthetic construct
  misc_feature 1..19: note = Synthetic Construct
  source 1..19: mol_type = other DNA
agccacctgccactatcct

SEQ ID NO: 8369 - DNA, 21 bp, synthetic construct
  misc_feature 1..21: note = Synthetic Construct
  source 1..21: mol_type = other DNA
actgcactctggcatcaccat

SEQ ID NO: 8370 - DNA, 24 bp, synthetic construct
  misc_feature 1..24: note = Synthetic Construct
  source 1..24: mol_type = other DNA
acaacatacattgctgggccttaa

SEQ ID NO: 8371 - DNA, 24 bp, synthetic construct
  misc_feature 1..24: note = Synthetic Construct
  source 1..24: mol_type = other DNA
ggctaaccctgctgagaacctttt

SEQ ID NO: 8372 - DNA, 20 bp, synthetic construct
  misc_feature 1..20: note = Synthetic Construct
  source 1..20: mol_type = other DNA
gctggcttcgggtagagaca

SEQ ID NO: 8373 - DNA, 22 bp, synthetic construct
  misc_feature 1..22: note = Synthetic Construct
  source 1..22: mol_type = other DNA
gagaatagctcctgcagttgct

SEQ ID NO: 8374 - DNA, 25 bp, synthetic construct
  misc_feature 1..25: note = Synthetic Construct
  source 1..25: mol_type = other DNA
actagcaaaccaaagctaacgacat

SEQ ID NO: 8375 - DNA, 25 bp, synthetic construct
  misc_feature 1..25: note = Synthetic Construct
  source 1..25: mol_type = other DNA
gagcatgtatgattcacgcttcttg

SEQ ID NO: 8376 - DNA, 25 bp, synthetic construct
  misc_feature 1..25: note = Synthetic Construct
  source 1..25: mol_type = other DNA
caggaaaggcagatgcttctaagtg

SEQ ID NO: 8377 - DNA, 27 bp, synthetic construct
  misc_feature 1..27: note = Synthetic Construct
  source 1..27: mol_type = other DNA
gcagagatttcagctcatgtgtttcag

SEQ ID NO: 8378 - DNA, 22 bp, synthetic construct
  misc_feature 1..22: note = Synthetic Construct
  source 1..22: mol_type = other DNA
tgggaaatgggcagtgcctaga

SEQ ID NO: 8379 - DNA, 22 bp, synthetic construct
  misc_feature 1..22: note = Synthetic Construct
  source 1..22: mol_type = other DNA
caggagcctcagagacaaagac

SEQ ID NO: 8380 - DNA, 21 bp, synthetic construct
  misc_feature 1..21: note = Synthetic Construct
  source 1..21: mol_type = other DNA
agaaggccaggtgcattgtga

SEQ ID NO: 8381 - DNA, 19 bp, synthetic construct
  misc_feature 1..19: note = Synthetic Construct
  source 1..19: mol_type = other DNA
aggcagaggctcgcagtga

SEQ ID NO: 8382 - DNA, 22 bp, synthetic construct
  misc_feature 1..22: note = Synthetic Construct
  source 1..22: mol_type = other DNA
aggaggaacaactgaggccaaa

SEQ ID NO: 8383 - DNA, 26 bp, synthetic construct
  misc_feature 1..26: note = Synthetic Construct
  source 1..26: mol_type = other DNA
gctgactttcaaagcatgaacccttt

SEQ ID NO: 8384 - DNA, 20 bp, synthetic construct
  misc_feature 1..20: note = Synthetic Construct
  source 1..20: mol_type = other DNA
accctcctgtggtggtagac

SEQ ID NO: 8385 - DNA, 29 bp, synthetic construct
  misc_feature 1..29: note = Synthetic Construct
  source 1..29: mol_type = other DNA
gtggtgatatttcctaattccagggaatg

SEQ ID NO: 8386 - DNA, 25 bp, synthetic construct
  misc_feature 1..25: note = Synthetic Construct
  source 1..25: mol_type = other DNA
ggcagaacaaatagttgagcaatgg

SEQ ID NO: 8387 - DNA, 24 bp, synthetic construct
  misc_feature 1..24: note = Synthetic Construct
  source 1..24: mol_type = other DNA
gacaaaggccagcttctcatacag

SEQ ID NO: 8388 - DNA, 23 bp, synthetic construct
  misc_feature 1..23: note = Synthetic Construct
  source 1..23: mol_type = other DNA
tggcaccaacctaataggaagtg

SEQ ID NO: 8389 - DNA, 25 bp, synthetic construct
  misc_feature 1..25: note = Synthetic Construct
  source 1..25: mol_type = other DNA
gatgtttggcttttcttgcttctga

SEQ ID NO: 8390 - DNA, 22 bp, synthetic construct
  misc_feature 1..22: note = Synthetic Construct
  source 1..22: mol_type = other DNA
aggagtgactgctacagctcaa

SEQ ID NO: 8391 - DNA, 25 bp, synthetic construct
  misc_feature 1..25: note = Synthetic Construct
  source 1..25: mol_type = other DNA
gaatgacatttctgagctcctggaa

SEQ ID NO: 8392 - DNA, 22 bp, synthetic construct
  misc_feature 1..22: note = Synthetic Construct
  source 1..22: mol_type = other DNA
cattgcaggagtggctacttca

SEQ ID NO: 8393 - DNA, 21 bp, synthetic construct
  misc_feature 1..21: note = Synthetic Construct
  source 1..21: mol_type = other DNA
agctttggacccagctgtgaa

SEQ ID NO: 8394 - DNA, 24 bp, synthetic construct
  misc_feature 1..24: note = Synthetic Construct
  source 1..24: mol_type = other DNA
ctgtttacagctcaaaccctctca

SEQ ID NO: 8395 - DNA, 24 bp, synthetic construct
  misc_feature 1..24: note = Synthetic Construct
  source 1..24: mol_type = other DNA
tgcccctactaaatgtggtttctg

SEQ ID NO: 8396 - DNA, 27 bp, synthetic construct
  misc_feature 1..27: note = Synthetic Construct
  source 1..27: mol_type = other DNA
ggaaatagctagaggatgagacaagct

SEQ ID NO: 8397 - DNA, 25 bp, synthetic construct
  misc_feature 1..25: note = Synthetic Construct
  source 1..25: mol_type = other DNA
cgtctctaaatttgcctgctgtttg

SEQ ID NO: 8398 - DNA, 21 bp, synthetic construct
  misc_feature 1..21: note = Synthetic Construct
  source 1..21: mol_type = other DNA
acccagagagactgcaaaggt

SEQ ID NO: 8399 - DNA, 28 bp, synthetic construct
  misc_feature 1..28: note = Synthetic Construct
  source 1..28: mol_type = other DNA
gggactactaccagtgttaagtgagatg

SEQ ID NO: 8400 - DNA, 22 bp, synthetic construct
  misc_feature 1..22: note = Synthetic Construct
  source 1..22: mol_type = other DNA
ccctcccctacctctctacaga

SEQ ID NO: 8401 - DNA, 20 bp, synthetic construct
  misc_feature 1..20: note = Synthetic Construct
  source 1..20: mol_type = other DNA
gctgatgcccagatgtctgt

SEQ ID NO: 8402 - DNA, 18 bp, synthetic construct
  misc_feature 1..18: note = Synthetic Construct
  source 1..18: mol_type = other DNA
tgcccagacacgcagcat

SEQ ID NO: 8403 - DNA, 23 bp, synthetic construct
  misc_feature 1..23: note = Synthetic Construct
  source 1..23: mol_type = other DNA
gatctcactgttgctgtcggtat

SEQ ID NO: 8404 - DNA, 22 bp, synthetic construct
  misc_feature 1..22: note = Synthetic Construct
  source 1..22: mol_type = other DNA
gccaccagaccattgctcattt

SEQ ID NO: 8405 - DNA, 26 bp, synthetic construct
  misc_feature 1..26: note = Synthetic Construct
  source 1..26: mol_type = other DNA
catgtcaccttgcctatgagttagag

SEQ ID NO: 8406 - DNA, 24 bp, synthetic construct
  misc_feature 1..24: note = Synthetic Construct
  source 1..24: mol_type = other DNA
ggacttctggctaacactccatgt

SEQ ID NO: 8407 - DNA, 18 bp, synthetic construct
  misc_feature 1..18: note = Synthetic Construct
  source 1..18: mol_type = other DNA
tgcacgcctcctgactca

SEQ ID NO: 8408 - DNA, 22 bp, synthetic construct
  misc_feature 1..22: note = Synthetic Construct
  source 1..22: mol_type = other DNA
gcttccaccaagccaaacaaca

SEQ ID NO: 8409 - DNA, 25 bp, synthetic construct
  misc_feature 1..25: note = Synthetic Construct
  source 1..25: mol_type = other DNA
gagtgtatgccaggtgttaacaaca

SEQ ID NO: 8410 - DNA, 25 bp, synthetic construct
  misc_feature 1..25: note = Synthetic Construct
  source 1..25: mol_type = other DNA
ggacagcagggatctatcttttcag

SEQ ID NO: 8411 - DNA, 20 bp, synthetic construct
  misc_feature 1..20: note = Synthetic Construct
  source 1..20: mol_type = other DNA
atgactggtggctgctgagt

SEQ ID NO: 8412 - DNA, 26 bp, synthetic construct
  misc_feature 1..26: note = Synthetic Construct
  source 1..26: mol_type = other DNA
cacacacactcacagaatgattagca

SEQ ID NO: 8413 - DNA, 22 bp, synthetic construct
  misc_feature 1..22: note = Synthetic Construct
  source 1..22: mol_type = other DNA
tcacaggccttgaacttttcca

SEQ ID NO: 8414 - DNA, 20 bp, synthetic construct
  misc_feature 1..20: note = Synthetic Construct
  source 1..20: mol_type = other DNA
tgtcacagcgtgaggtcact

SEQ ID NO: 8415 - DNA, 25 bp, synthetic construct
  misc_feature 1..25: note = Synthetic Construct
  source 1..25: mol_type = other DNA
gcatatagcctatgccaaagaacag

SEQ ID NO: 8416 - DNA, 24 bp, synthetic construct
  misc_feature 1..24: note = Synthetic Construct
  source 1..24: mol_type = other DNA
gatcaagatgtcacagctgatcct

SEQ ID NO: 8417 - DNA, 20 bp, synthetic construct
  misc_feature 1..20: note = Synthetic Construct
  source 1..20: mol_type = other DNA
tgctcaccacgtaggcctat

SEQ ID NO: 8418 - DNA, 23 bp, synthetic construct
  misc_feature 1..23: note = Synthetic Construct
  source 1..23: mol_type = other DNA
ctgagggagggtagggttacctt

SEQ ID NO: 8419 - DNA, 24 bp, synthetic construct
  misc_feature 1..24: note = Synthetic Construct
  source 1..24: mol_type = other DNA
gagaaggaattggaaccaggacat

SEQ ID NO: 8420 - DNA, 21 bp, synthetic construct
  misc_feature 1..21: note = Synthetic Construct
  source 1..21: mol_type = other DNA
tgcccctgcacagtattggat

SEQ ID NO: 8421 - DNA, 21 bp, synthetic construct
  misc_feature 1..21: note = Synthetic Construct
  source 1..21: mol_type = other DNA
agactggaagcctgaggtcat

SEQ ID NO: 8422 - DNA, 26 bp, synthetic construct
  misc_feature 1..26: note = Synthetic Construct
  source 1..26: mol_type = other DNA
cgcactgagtgttaattttccaagca

SEQ ID NO: 8423 - DNA, 27 bp, synthetic construct
  misc_feature 1..27: note = Synthetic Construct
  source 1..27: mol_type = other DNA
cctctagcctggatgttctctcttttc

SEQ ID NO: 8424 - DNA, 19 bp, synthetic construct
  misc_feature 1..19: note = Synthetic Construct
  source 1..19: mol_type = other DNA
gcagactgcagggtttcca

SEQ ID NO: 8425 - DNA, 23 bp, synthetic construct
  misc_feature 1..23: note = Synthetic Construct
  source 1..23: mol_type = other DNA
ggacagggtcatctcagtgtgaa

SEQ ID NO: 8426 - DNA, 23 bp, synthetic construct
  misc_feature 1..23: note = Synthetic Construct
  source 1..23: mol_type = other DNA
tgcccatgtcttctactcactgt

SEQ ID NO: 8427 - DNA, 25 bp, synthetic construct
  misc_feature 1..25: note = Synthetic Construct
  source 1..25: mol_type = other DNA
ccatggaaggataccacaacaagac

SEQ ID NO: 8428 - DNA, 22 bp, synthetic construct
  misc_feature 1..22: note = Synthetic Construct
  source 1..22: mol_type = other DNA
gggatcttcaagcacagtctga

SEQ ID NO: 8429 - DNA, 22 bp, synthetic construct
  misc_feature 1..22: note = Synthetic Construct
  source 1..22: mol_type = other DNA
acatagtcctccttgggggaaa

SEQ ID NO: 8430 - DNA, 25 bp, synthetic construct
  misc_feature 1..25: note = Synthetic Construct
  source 1..25: mol_type = other DNA
aaccccttgaaggagttgtctattc

SEQ ID NO: 8431 - DNA, 19 bp, synthetic construct
  misc_feature 1..19: note = Synthetic Construct
  source 1..19: mol_type = other DNA
gcaaggggagctcaaaggt

SEQ ID NO: 8432 - DNA, 23 bp, synthetic construct
  misc_feature 1..23: note = Synthetic Construct
  source 1..23: mol_type = other DNA
agagctcagtctgtctctcatct

SEQ ID NO: 8433 - DNA, 22 bp, synthetic construct
  misc_feature 1..22: note = Synthetic Construct
  source 1..22: mol_type = other DNA
acgcttgtaggcccaactacac

SEQ ID NO: 8434 - DNA, 24 bp, synthetic construct
  misc_feature 1..24: note = Synthetic Construct
  source 1..24: mol_type = other DNA
tcagtgtccactctgagagctaag

SEQ ID NO: 8435 - DNA, 23 bp, synthetic construct
  misc_feature 1..23: note = Synthetic Construct
  source 1..23: mol_type = other DNA
tctgagtgtttggaatggacgtt

SEQ ID NO: 8436 - DNA, 28 bp, synthetic construct
  misc_feature 1..28: note = Synthetic Construct
  source 1..28: mol_type = other DNA
ccaatccctgaagtctgtattacaagac

SEQ ID NO: 8437 - DNA, 24 bp, synthetic construct
  misc_feature 1..24: note = Synthetic Construct
  source 1..24: mol_type = other DNA
gggactgggagacacatctattga

SEQ ID NO: 8438 - DNA, 20 bp, synthetic construct
  misc_feature 1..20: note = Synthetic Construct
  source 1..20: mol_type = other DNA
ccctcctccctcaccactag

SEQ ID NO: 8439 - DNA, 22 bp, synthetic construct
  misc_feature 1..22: note = Synthetic Construct
  source 1..22: mol_type = other DNA
agcgtagtgggtgggaaatctg

SEQ ID NO: 8440 - DNA, 21 bp, synthetic construct
  misc_feature 1..21: note = Synthetic Construct
  source 1..21: mol_type = other DNA
gcctgtcatcctcctcgatgt

SEQ ID NO: 8441 - DNA, 24 bp, synthetic construct
  misc_feature 1..24: note = Synthetic Construct
  source 1..24: mol_type = other DNA
gcacagtgattcagagagcagctt

SEQ ID NO: 8442 - DNA, 24 bp, synthetic construct
  misc_feature 1..24: note = Synthetic Construct
  source 1..24: mol_type = other DNA
agctcagtccccaggttattagga

SEQ ID NO: 8443 - DNA, 24 bp, synthetic construct
  misc_feature 1..24: note = Synthetic Construct
  source 1..24: mol_type = other DNA
tgcttgaaccccatcctttatgtc

SEQ ID NO: 8444 - DNA, 24 bp, synthetic construct
  misc_feature 1..24: note = Synthetic Construct
  source 1..24: mol_type = other DNA
cctgaagagagtctacagccaatg

SEQ ID NO: 8445 - DNA, 21 bp, synthetic construct
  misc_feature 1..21: note = Synthetic Construct
  source 1..21: mol_type = other DNA
agctaaccatggcctctgagt

SEQ ID NO: 8446 - DNA, 26 bp, synthetic construct
  misc_feature 1..26: note = Synthetic Construct
  source 1..26: mol_type = other DNA
tgtattactgcatgcctagtccctaa

SEQ ID NO: 8447 - DNA, 19 bp, synthetic construct
  misc_feature 1..19: note = Synthetic Construct
  source 1..19: mol_type = other DNA
tgcccaggggtggctctgt

SEQ ID NO: 8448 - DNA, 21 bp, synthetic construct
  misc_feature 1..21: note = Synthetic Construct
  source 1..21: mol_type = other DNA
tgtgcctgatgtggtgaactt

SEQ ID NO: 8449 - DNA, 23 bp, synthetic construct
  misc_feature 1..23: note = Synthetic Construct
  source 1..23: mol_type = other DNA
tcggaggggttcagtaacactca

SEQ ID NO: 8450 - DNA, 22 bp, synthetic construct
  misc_feature 1..22: note = Synthetic Construct
  source 1..22: mol_type = other DNA
ccaacttcagctgctccactta

SEQ ID NO: 8451 - DNA, 21 bp, synthetic construct
  misc_feature 1..21: note = Synthetic Construct
  source 1..21: mol_type = other DNA
tctcctgcagcccactatgtg

SEQ ID NO: 8452 - DNA, 20 bp, synthetic construct
  misc_feature 1..20: note = Synthetic Construct
  source 1..20: mol_type = other DNA
atcccctgatgcccccactt

SEQ ID NO: 8453 - DNA, 24 bp, synthetic construct
  misc_feature 1..24: note = Synthetic Construct
  source 1..24: mol_type = other DNA
tggaagcctcaagtcctcttcctt

SEQ ID NO: 8454 - DNA, 20 bp, synthetic construct
  misc_feature 1..20: note = Synthetic Construct
  source 1..20: mol_type = other DNA
gcagatgacagccccttgtt

SEQ ID NO: 8455 - DNA, 25 bp, synthetic construct
  misc_feature 1..25: note = Synthetic Construct
  source 1..25: mol_type = other DNA
tcagaccttcagaaacccatcattt

SEQ ID NO: 8456 - DNA, 24 bp, synthetic construct
  misc_feature 1..24: note = Synthetic Construct
  source 1..24: mol_type = other DNA
cccatcctgaacctctagcaacta

SEQ ID NO: 8457 - DNA, 24 bp, synthetic construct
  misc_feature 1..24: note = Synthetic Construct
  source 1..24: mol_type = other DNA
agagagactgaggatatggctgat

SEQ ID NO: 8458 - DNA, 21 bp, synthetic construct
  misc_feature 1..21: note = Synthetic Construct
  source 1..21: mol_type = other DNA
accctgatggtttgcaccttt

SEQ ID NO: 8459 - DNA, 24 bp, synthetic construct
  misc_feature 1..24: note = Synthetic Construct
  source 1..24: mol_type = other DNA
cagatcccacccacataggttaga

SEQ ID NO: 8460 - DNA, 26 bp, synthetic construct
  misc_feature 1..26: note = Synthetic Construct
  source 1..26: mol_type = other DNA
gctcttgccaatgtttctagtgatga

SEQ ID NO: 8461 - DNA, 22 bp, synthetic construct
  misc_feature 1..22: note = Synthetic Construct
  source 1..22: mol_type = other DNA
acagggacttccaagggagaca

SEQ ID NO: 8462 - DNA, 21 bp, synthetic construct
  misc_feature 1..21: note = Synthetic Construct
  source 1..21: mol_type = other DNA
aggctttgtgctcctgtgatt

SEQ ID NO: 8463 - DNA, 24 bp, synthetic construct
  misc_feature 1..24: note = Synthetic Construct
  source 1..24: mol_type = other DNA
acctacagggcattaggtgttacc

SEQ ID NO: 8464 - DNA, 26 bp, synthetic construct
  misc_feature 1..26: note = Synthetic Construct
  source 1..26: mol_type = other DNA
acaagctcataaactcattgcacatt

SEQ ID NO: 8465 - DNA, 24 bp, synthetic construct
  misc_feature 1..24: note = Synthetic Construct
  source 1..24: mol_type = other DNA
gccctgaattctgtgtctgcagat

SEQ ID NO: 8466 - DNA, 22 bp, synthetic construct
  misc_feature 1..22: note = Synthetic Construct
  source 1..22: mol_type = other DNA
gcatatgtgctgtcgacaaagg

SEQ ID NO: 8467 - DNA, 24 bp, synthetic construct
  misc_feature 1..24: note = Synthetic Construct
  source 1..24: mol_type = other DNA
caccacaccagacactgaagatag

SEQ ID NO: 8468 - DNA, 22 bp, synthetic construct
  misc_feature 1..22: note = Synthetic Construct
  source 1..22: mol_type = other DNA
tgcaggtggtctgaggatcaca

SEQ ID NO: 8469 - DNA, 22 bp, synthetic construct
  misc_feature 1..22: note = Synthetic Construct
  source 1..22: mol_type = other DNA
tgcagccttagaggagggagta

SEQ ID NO: 8470 - DNA, 25 bp, synthetic construct
  misc_feature 1..25: note = Synthetic Construct
  source 1..25: mol_type = other DNA
cagtggcttttcatggtgaaatagc

SEQ ID NO: 8471 - DNA, 22 bp, synthetic construct
  misc_feature 1..22: note = Synthetic Construct
  source 1..22: mol_type = other DNA
agctgagtgtcacctgtttctg

SEQ ID NO: 8472 - DNA, 21 bp, synthetic construct
  misc_feature 1..21: note = Synthetic Construct
  source 1..21: mol_type = other DNA
tcctatcagcacccgccagaa

SEQ ID NO: 8473 - DNA, 22 bp, synthetic construct
  misc_feature 1..22: note = Synthetic Construct
  source 1..22: mol_type = other DNA
caccttgcacttctggaagtct

SEQ ID NO: 8474 - DNA, 24 bp, synthetic construct
  misc_feature 1..24: note = Synthetic Construct
  source 1..24: mol_type = other DNA
ctgcccgttgaatacatttaagca

SEQ ID NO: 8475 - DNA, 25 bp, synthetic construct
  misc_feature 1..25: note = Synthetic Construct
  source 1..25: mol_type = other DNA
gagtactgggcacaaacaggtataa

SEQ ID NO: 8476 - DNA, 19 bp, synthetic construct
  misc_feature 1..19: note = Synthetic Construct
  source 1..19: mol_type = other DNA
tgccttggtgacgccactt

SEQ ID NO: 8477 - DNA, 20 bp, synthetic construct
  misc_feature 1..20: note = Synthetic Construct
  source 1..20: mol_type = other DNA
tcgggtctcagcagcccaat

SEQ ID NO: 8478 - DNA, 24 bp, synthetic construct
  misc_feature 1..24: note = Synthetic Construct
  source 1..24: mol_type = other DNA
aaatactgttcacaagcccatgtg

SEQ ID NO: 8479 - DNA, 24 bp, synthetic construct
  misc_feature 1..24: note = Synthetic Construct
  source 1..24: mol_type = other DNA
acattctttcctaactgccacaca

SEQ ID NO: 8480 - DNA, 25 bp, synthetic construct
  misc_feature 1..25: note = Synthetic Construct
  source 1..25: mol_type = other DNA
ctcagcaaaggtaaagtgtgtagca

SEQ ID NO: 8481 - DNA, 27 bp, synthetic construct
  misc_feature 1..27: note = Synthetic Construct
  source 1..27: mol_type = other DNA
ccagcagcaatgagaatgtatctgtag

SEQ ID NO: 8482 - DNA, 25 bp, synthetic construct
  misc_feature 1..25: note = Synthetic Construct
  source 1..25: mol_type = other DNA
ccgtgaacttcctcttctagcaaac

SEQ ID NO: 8483 - DNA, 22 bp, synthetic construct
  misc_feature 1..22: note = Synthetic Construct
  source 1..22: mol_type = other DNA
gcattcctcaagcaaccctaga

SEQ ID NO: 8484 - DNA, 21 bp, synthetic construct
  misc_feature 1..21: note = Synthetic Construct
  source 1..21: mol_type = other DNA
tgtgttccaagccctgtagtg

SEQ ID NO: 8485 - DNA, 22 bp, synthetic construct
  misc_feature 1..22: note = Synthetic Construct
  source 1..22: mol_type = other DNA
atccttgcaggtcattccaaca

SEQ ID NO: 8486 - DNA, 25 bp, synthetic construct
  misc_feature 1..25: note = Synthetic Construct
  source 1..25: mol_type = other DNA
ttgtgactgttcatggctgtatagt

SEQ ID NO: 8487 - DNA, 22 bp, synthetic construct
  misc_feature 1..22: note = Synthetic Construct
  source 1..22: mol_type = other DNA
cctgcagtgcttcattcaaagg

SEQ ID NO: 8488 - DNA, 23 bp, synthetic construct
  misc_feature 1..23: note = Synthetic Construct
  source 1..23: mol_type = other DNA
acacttccctccatgcctctcta

SEQ ID NO: 8489 - DNA, 26 bp, synthetic construct
  misc_feature 1..26: note = Synthetic Construct
  source 1..26: mol_type = other DNA
cccaactgaagataaccgatgcatgt

SEQ ID NO: 8490 - DNA, 28 bp, synthetic construct
  misc_feature 1..28: note = Synthetic Construct
  source 1..28: mol_type = other DNA
caaaagttcccagagtgtatttaatcca

SEQ ID NO: 8491 - DNA, 28 bp, synthetic construct
  misc_feature 1..28: note = Synthetic Construct
  source 1..28: mol_type = other DNA
ggcttattccccaaatggttcaatcatg

SEQ ID NO: 8492 - DNA, 23 bp, synthetic construct
  misc_feature 1..23: note = Synthetic Construct
  source 1..23: mol_type = other DNA
gaaagctctcagggttaccagtt

SEQ ID NO: 8493 - DNA, 24 bp, synthetic construct
  misc_feature 1..24: note = Synthetic Construct
  source 1..24: mol_type = other DNA
gactgagtgaatgaagagcagcta

SEQ ID NO: 8494 - DNA, 23 bp, synthetic construct
  misc_feature 1..23: note = Synthetic Construct
  source 1..23: mol_type = other DNA
tccccctacaggctatggattag

SEQ ID NO: 8495 - DNA, 23 bp, synthetic construct
  misc_feature 1..23: note = Synthetic Construct
  source 1..23: mol_type = other DNA
agtttcatagttgccccctttgt

SEQ ID NO: 8496 - DNA, 20 bp, synthetic construct
  misc_feature 1..20: note = Synthetic Construct
  source 1..20: mol_type = other DNA
gctggctgttggaggacaga

SEQ ID NO: 8497 - DNA, 21 bp, synthetic construct
  misc_feature 1..21: note = Synthetic Construct
  source 1..21: mol_type = other DNA
actgggacctcctctgcagat

SEQ ID NO: 8498 - DNA, 22 bp, synthetic construct
  misc_feature 1..22: note = Synthetic Construct
  source 1..22: mol_type = other DNA
tgctgtctcttctaggcaaagg

SEQ ID NO: 8499 - DNA, 24 bp, synthetic construct
  misc_feature 1..24: note = Synthetic Construct
  source 1..24: mol_type = other DNA
ctctccttcaaggtgcttctgaga

SEQ ID NO: 8500 - DNA, 22 bp, synthetic construct
  misc_feature 1..22: note = Synthetic Construct
  source 1..22: mol_type = other DNA
gagactgcagtgaaccatcagt

SEQ ID NO: 8501 - DNA, 24 bp, synthetic construct
  misc_feature 1..24: note = Synthetic Construct
  source 1..24: mol_type = other DNA
tgcctggcaatgttagataaggat

SEQ ID NO: 8502 - DNA, 24 bp, synthetic construct
  misc_feature 1..24: note = Synthetic Construct
  source 1..24: mol_type = other DNA
gctgctttccctcttgttacacaa

SEQ ID NO: 8503 - DNA, 21 bp, synthetic construct
  misc_feature 1..21: note = Synthetic Construct
  source 1..21: mol_type = other DNA
tgctgaatctgtggtgagctt

SEQ ID NO: 8504 - DNA, 21 bp, synthetic construct
  misc_feature 1..21: note = Synthetic Construct
  source 1..21: mol_type = other DNA
aagtggccactgaagtcgatt

SEQ ID NO: 8505 - DNA, 28 bp, synthetic construct
  misc_feature 1..28: note = Synthetic Construct
  source 1..28: mol_type = other DNA
ggaatcaaagcacctttatttactgctt

SEQ ID NO: 8506 - DNA, 21 bp, synthetic construct
  misc_feature 1..21: note = Synthetic Construct
  source 1..21: mol_type = other DNA
agcccagagatccaagcactt

SEQ ID NO: 8507 - DNA, 26 bp, synthetic construct
  misc_feature 1..26: note = Synthetic Construct
  source 1..26: mol_type = other DNA
agacttggagtaatctttgccttctt

SEQ ID NO: 8508 - DNA, 25 bp, synthetic construct
  misc_feature 1..25: note = Synthetic Construct
  source 1..25: mol_type = other DNA
cctcaattttcaccccactcttctt

SEQ ID NO: 8509 - DNA, 24 bp, synthetic construct
  misc_feature 1..24: note = Synthetic Construct
  source 1..24: mol_type = other DNA
agggtgaaattcctccagattcag

SEQ ID NO: 8510 - DNA, 22 bp, synthetic construct
  misc_feature 1..22: note = Synthetic Construct
  source 1..22: mol_type = other DNA
agctcatcagcacatgagttca

SEQ ID NO: 8511 - DNA, 23 bp, synthetic construct
  misc_feature 1..23: note = Synthetic Construct
  source 1..23: mol_type = other DNA
cctgtcacatgcagctatcaatg

SEQ ID NO: 8512 - DNA, 19 bp, synthetic construct
  misc_feature 1..19: note = Synthetic Construct
  source 1..19: mol_type = other DNA
ggtgatgccagggctcaat

SEQ ID NO: 8513 - DNA, 29 bp, synthetic construct
  misc_feature 1..29: note = Synthetic Construct
  source 1..29: mol_type = other DNA
ccattcttcccatcctctctaataatagg

SEQ ID NO: 8514 - DNA, 19 bp, synthetic construct
  misc_feature 1..19: note = Synthetic Construct
  source 1..19: mol_type = other DNA
gctggggctcttctgcttt

SEQ ID NO: 8515 - DNA, 22 bp, synthetic construct
  misc_feature 1..22: note = Synthetic Construct
  source 1..22: mol_type = other DNA
gagctcacatgccagattccat

SEQ ID NO: 8516 - DNA, 22 bp, synthetic construct
  misc_feature 1..22: note = Synthetic Construct
  source 1..22: mol_type = other DNA
cctgggtagcactgtcttcaat

SEQ ID NO: 8517 - DNA, 25 bp, synthetic construct
  misc_feature 1..25: note = Synthetic Construct
  source 1..25: mol_type = other DNA
tgcacggctaagcagtaagggactt

SEQ ID NO: 8518 - DNA, 27 bp, synthetic construct
  misc_feature 1..27: note = Synthetic Construct
  source 1..27: mol_type = other DNA
gtctctcggggtaatttttctctatcc

SEQ ID NO: 8519 - DNA, 20 bp, synthetic construct
  misc_feature 1..20: note = Synthetic Construct
  source 1..20: mol_type = other DNA
tgcaaacaggatggctgaca

SEQ ID NO: 8520 - DNA, 21 bp, synthetic construct
  misc_feature 1..21: note = Synthetic Construct
  source 1..21: mol_type = other DNA
agccatgtccctgactaacct

SEQ ID NO: 8521 - DNA, 23 bp, synthetic construct
  misc_feature 1..23: note = Synthetic Construct
  source 1..23: mol_type = other DNA
ctgaagggtaaaggcatgggtta

SEQ ID NO: 8522 - DNA, 24 bp, synthetic construct
  misc_feature 1..24: note = Synthetic Construct
  source 1..24: mol_type = other DNA
ccagcagtgatgaccaaagatgac

SEQ ID NO: 8523 - DNA, 24 bp, synthetic construct
  misc_feature 1..24: note = Synthetic Construct
  source 1..24: mol_type = other DNA
caaggtaatttgcctgagctttgg

SEQ ID NO: 8524 - DNA, 25 bp, synthetic construct
  misc_feature 1..25: note = Synthetic Construct
  source 1..25: mol_type = other DNA
gcacattgctagctgagagaaacag

SEQ ID NO: 8525 - DNA, 21 bp, synthetic construct
  misc_feature 1..21: note = Synthetic Construct
  source 1..21: mol_type = other DNA
tgccaagatcgtcgcagtgat

SEQ ID NO: 8526 - DNA, 21 bp, synthetic construct
  misc_feature 1..21: note = Synthetic Construct
  source 1..21: mol_type = other DNA
gggaaccccaaacccttcttg

SEQ ID NO: 8527 - DNA, 21 bp, synthetic construct
  misc_feature 1..21: note = Synthetic Construct
  source 1..21: mol_type = other DNA
agccaggtgcagtatgggaaa

SEQ ID NO: 8528 - DNA, 21 bp, synthetic construct
  misc_feature 1..21: note = Synthetic Construct
  source 1..21: mol_type = other DNA
ctcatgcttgcctctggacaa

SEQ ID NO: 8529 - DNA, 25 bp, synthetic construct
  misc_feature 1..25: note = Synthetic Construct
  source 1..25: mol_type = other DNA
gacccaaaactgaaactgagatgca

SEQ ID NO: 8530 - DNA, 22 bp, synthetic construct
  misc_feature 1..22: note = Synthetic Construct
  source 1..22: mol_type = other DNA
ggccagcatttcttggatcctt

SEQ ID NO: 8531 - DNA, 24 bp, synthetic construct
  misc_feature 1..24: note = Synthetic Construct
  source 1..24: mol_type = other DNA
ccccaggatagacaacatttggat

SEQ ID NO: 8532 - DNA, 22 bp, synthetic construct
  misc_feature 1..22: note = Synthetic Construct
  source 1..22: mol_type = other DNA
tccaattggccacaagcttcgt

SEQ ID NO: 8533 - DNA, 22 bp, synthetic construct
  misc_feature 1..22: note = Synthetic Construct
  source 1..22: mol_type = other DNA
gctcccctgacatcccactttt

SEQ ID NO: 8534 - DNA, 25 bp, synthetic construct
  misc_feature 1..25: note = Synthetic Construct
  source 1..25: mol_type = other DNA
agatgttggggttcataagggaaac

SEQ ID NO: 8535 - DNA, 27 bp, synthetic construct
  misc_feature 1..27: note = Synthetic Construct
  source 1..27: mol_type = other DNA
gccattatctctccaggtgtttactgt

SEQ ID NO: 8536 - DNA, 20 bp, synthetic construct
  misc_feature 1..20: note = Synthetic Construct
  source 1..20: mol_type = other DNA
ccaggttgactgcacacaca

SEQ ID NO: 8537 - DNA, 22 bp, synthetic construct
  misc_feature 1..22: note = Synthetic Construct
  source 1..22: mol_type = other DNA
ctggaccttggttaagcactga

SEQ ID NO: 8538 - DNA, 22 bp, synthetic construct
  misc_feature 1..22: note = Synthetic Construct
  source 1..22: mol_type = other DNA
ctgggttctagtcctggttgtg

SEQ ID NO: 8539 - DNA, 25 bp, synthetic construct
  misc_feature 1..25: note = Synthetic Construct
  source 1..25: mol_type = other DNA
gcaaagaggctgctactcagattca

SEQ ID NO: 8540 - DNA, 21 bp, synthetic construct
  misc_feature 1..21: note = Synthetic Construct
  source 1..21: mol_type = other DNA
agtcaaaaggcaggaggcaaa

SEQ ID NO: 8541 - DNA, 21 bp, synthetic construct
  misc_feature 1..21: note = Synthetic Construct
  source 1..21: mol_type = other DNA
agaaaagggcccactggtctt

SEQ ID NO: 8542 - DNA, 24 bp, synthetic construct
  misc_feature 1..24: note = Synthetic Construct
  source 1..24: mol_type = other DNA
ccaatccactccacataccattgt

SEQ ID NO: 8543 - DNA, 24 bp, synthetic construct
  misc_feature 1..24: note = Synthetic Construct
  source 1..24: mol_type = other DNA
ctgtaaagtctctggtgtcaaggt

SEQ ID NO: 8544 - DNA, 20 bp, synthetic construct
  misc_feature 1..20: note = Synthetic Construct
  source 1..20: mol_type = other DNA
tggtcctggcttctgtgact

SEQ ID NO: 8545 - DNA, 27 bp, synthetic construct
  misc_feature 1..27: note = Synthetic Construct
  source 1..27: mol_type = other DNA
gcattccgaacactgaattgttaagtg

SEQ ID NO: 8546 - DNA, 23 bp, synthetic construct
  misc_feature 1..23: note = Synthetic Construct
  source 1..23: mol_type = other DNA
gactcagcttggggaattctctt

SEQ ID NO: 8547 - DNA, 22 bp, synthetic construct
  misc_feature 1..22: note = Synthetic Construct
  source 1..22: mol_type = other DNA
gaggggctactagaagcaaacc

SEQ ID NO: 8548 - DNA, 27 bp, synthetic construct
  misc_feature 1..27: note = Synthetic Construct
  source 1..27: mol_type = other DNA
gaatgcccctgataagctttaatgatg

SEQ ID NO: 8549 - DNA, 24 bp, synthetic construct
  misc_feature 1..24: note = Synthetic Construct
  source 1..24: mol_type = other DNA
cacaaagagcagcaaatcacatca

SEQ ID NO: 8550 - DNA, 22 bp, synthetic construct
  misc_feature 1..22: note = Synthetic Construct
  source 1..22: mol_type = other DNA
cagcaaatggtcccacaggatt

SEQ ID NO: 8551 - DNA, 26 bp, synthetic construct
  misc_feature 1..26: note = Synthetic Construct
  source 1..26: mol_type = other DNA
gcccaattgcaatatttccgaatgca

SEQ ID NO: 8552 - DNA, 21 bp, synthetic construct
  misc_feature 1..21: note = Synthetic Construct
  source 1..21: mol_type = other DNA
aaaagggatgtggtgcgatct

SEQ ID NO: 8553 - DNA, 21 bp, synthetic construct
  misc_feature 1..21: note = Synthetic Construct
  source 1..21: mol_type = other DNA
aggcaacaggtggtcaaatga

SEQ ID NO: 8554 - DNA, 23 bp, synthetic construct
  misc_feature 1..23: note = Synthetic Construct
  source 1..23: mol_type = other DNA
cgcattacttcccatcctaccaa

SEQ ID NO: 8555 - DNA, 21 bp, synthetic construct
  misc_feature 1..21: note = Synthetic Construct
  source 1..21: mol_type = other DNA
tggctgtcagtctgcatgtgt

SEQ ID NO: 8556 - DNA, 22 bp, synthetic construct
  misc_feature 1..22: note = Synthetic Construct
  source 1..22: mol_type = other DNA
acaagatccagggttgctctgt

SEQ ID NO: 8557 - DNA, 21 bp, synthetic construct
  misc_feature 1..21: note = Synthetic Construct
  source 1..21: mol_type = other DNA
ttggggttgtcacctgttgca

SEQ ID NO: 8558 - DNA, 23 bp, synthetic construct
  misc_feature 1..23: note = Synthetic Construct
  source 1..23: mol_type = other DNA
aagagggtacaagggaggcttct

SEQ ID NO: 8559 - DNA, 26 bp, synthetic construct
  misc_feature 1..26: note = Synthetic Construct
  source 1..26: mol_type = other DNA
agaggagaagtggagactattacagt

SEQ ID NO: 8560 - DNA, 24 bp, synthetic construct
  misc_feature 1..24: note = Synthetic Construct
  source 1..24: mol_type = other DNA
gcacagtaggaaaagtctgttgtg

SEQ ID NO: 8561 - DNA, 25 bp, synthetic construct
  misc_feature 1..25: note = Synthetic Construct
  source 1..25: mol_type = other DNA
aagactcacctctccttctatcctt

SEQ ID NO: 8562 - DNA, 25 bp, synthetic construct
  misc_feature 1..25: note = Synthetic Construct
  source 1..25: mol_type = other DNA
tgaacctagttcctgctcctatgat

SEQ ID NO: 8563 - DNA, 22 bp, synthetic construct
  misc_feature 1..22: note = Synthetic Construct
  source 1..22: mol_type = other DNA
acccctttcaagccaaggatgt

SEQ ID NO: 8564 - DNA, 22 bp, synthetic construct
  misc_feature 1..22: note = Synthetic Construct
  source 1..22: mol_type = other DNA
gggaaacccaacctcctgacta

SEQ ID NO: 8565 - DNA, 24 bp, synthetic construct
  misc_feature 1..24: note = Synthetic Construct
  source 1..24: mol_type = other DNA
cctaacctgctctcaagcttttgc

SEQ ID NO: 8566 - DNA, 21 bp, synthetic construct
  misc_feature 1..21: note = Synthetic Construct
  source 1..21: mol_type = other DNA
aacctggccactccaaccata

SEQ ID NO: 8567 - DNA, 22 bp, synthetic construct
  misc_feature 1..22: note = Synthetic Construct
  source 1..22: mol_type = other DNA
tggtgggtatatggagggtgtt

SEQ ID NO: 8568 - DNA, 19 bp, synthetic construct
  misc_feature 1..19: note = Synthetic Construct
  source 1..19: mol_type = other DNA
tggaagaggggggcatctg

SEQ ID NO: 8569 - DNA, 22 bp, synthetic construct
  misc_feature 1..22: note = Synthetic Construct
  source 1..22: mol_type = other DNA
tgttggttgtgtctcccatgca

SEQ ID NO: 8570 - DNA, 20 bp, synthetic construct
  misc_feature 1..20: note = Synthetic Construct
  source 1..20: mol_type = other DNA
acctgcatcatggcctgaca

SEQ ID NO: 8571 - DNA, 19 bp, synthetic construct
  misc_feature 1..19: note = Synthetic Construct
  source 1..19: mol_type = other DNA
aggagcatgtggcctcaga

SEQ ID NO: 8572 - DNA, 23 bp, synthetic construct
  misc_feature 1..23: note = Synthetic Construct
  source 1..23: mol_type = other DNA
ccttagaggaacaaggcctgact

SEQ ID NO: 8573 - DNA, 23 bp, synthetic construct
  misc_feature 1..23: note = Synthetic Construct
  source 1..23: mol_type = other DNA
caagacagtttcccatcctgaca

SEQ ID NO: 8574 - DNA, 19 bp, synthetic construct
  misc_feature 1..19: note = Synthetic Construct
  source 1..19: mol_type = other DNA
gcgttgtgctgtccattgg

SEQ ID NO: 8575 - DNA, 21 bp, synthetic construct
  misc_feature 1..21: note = Synthetic Construct
  source 1..21: mol_type = other DNA
tttgcaggccttggacatggt

SEQ ID NO: 8576 - DNA, 25 bp, synthetic construct
  misc_feature 1..25: note = Synthetic Construct
  source 1..25: mol_type = other DNA
actggtccaatttagtcaccatgat

SEQ ID NO: 8577 - DNA, 26 bp, synthetic construct
  misc_feature 1..26: note = Synthetic Construct
  source 1..26: mol_type = other DNA
gctcattcttgccctcctgtaagtac

SEQ ID NO: 8578 - DNA, 26 bp, synthetic construct
  misc_feature 1..26: note = Synthetic Construct
  source 1..26: mol_type = other DNA
gctaagaggctcttaggtagcagtag

SEQ ID NO: 8579 - DNA, 21 bp, synthetic construct
  misc_feature 1..21: note = Synthetic Construct
  source 1..21: mol_type = other DNA
gctgtggctgttttcctgcta

SEQ ID NO: 8580 - DNA, 24 bp, synthetic construct
  misc_feature 1..24: note = Synthetic Construct
  source 1..24: mol_type = other DNA
ctcctccctctagttcttctgtgt

SEQ ID NO: 8581 - DNA, 24 bp, synthetic construct
  misc_feature 1..24: note = Synthetic Construct
  source 1..24: mol_type = other DNA
ccttccctcctcctcaaaaactgt

SEQ ID NO: 8582 - DNA, 25 bp, synthetic construct
  misc_feature 1..25: note = Synthetic Construct
  source 1..25: mol_type = other DNA
gactccattgaaacaaaggcaagag

SEQ ID NO: 8583 - DNA, 25 bp, synthetic construct
  misc_feature 1..25: note = Synthetic Construct
  source 1..25: mol_type = other DNA
ccctcttttatggggcatgcattct

SEQ ID NO: 8584 - DNA, 20 bp, synthetic construct
  misc_feature 1..20: note = Synthetic Construct
  source 1..20: mol_type = other DNA
agccacagctctgacaacag

SEQ ID NO: 8585 - DNA, 25 bp, synthetic construct
  misc_feature 1..25: note = Synthetic Construct
  source 1..25: mol_type = other DNA
caagcagacacaaggataagaggaa

SEQ ID NO: 8586 - DNA, 24 bp, synthetic construct
  misc_feature 1..24: note = Synthetic Construct
  source 1..24: mol_type = other DNA
aacttttgtcactgagagggttga

SEQ ID NO: 8587 - DNA, 25 bp, synthetic construct
  misc_feature 1..25: note = Synthetic Construct
  source 1..25: mol_type = other DNA
cacctgtttaccttcctagcctctt

SEQ ID NO: 8588 - DNA, 23 bp, synthetic construct
  misc_feature 1..23: note = Synthetic Construct
  source 1..23: mol_type = other DNA
tccttgtccacctattgcagatg

SEQ ID NO: 8589 - DNA, 20 bp, synthetic construct
  misc_feature 1..20: note = Synthetic Construct
  source 1..20: mol_type = other DNA
ggaggcctttggaccttgga

SEQ ID NO: 8590 - DNA, 23 bp, synthetic construct
  misc_feature 1..23: note = Synthetic Construct
  source 1..23: mol_type = other DNA
accctggaggagatgaatcttga

SEQ ID NO: 8591 - DNA, 20 bp, synthetic construct
  misc_feature 1..20: note = Synthetic Construct
  source 1..20: mol_type = other DNA
ctgcctgcctgaagttctga

SEQ ID NO: 8592 - DNA, 24 bp, synthetic construct
  misc_feature 1..24: note = Synthetic Construct
  source 1..24: mol_type = other DNA
gcacgctcttcaaatcaaaacttc

SEQ ID NO: 8593 - DNA, 25 bp, synthetic construct
  misc_feature 1..25: note = Synthetic Construct
  source 1..25: mol_type = other DNA
gctaccgtttgtttcccacctatct

SEQ ID NO: 8594 - DNA, 23 bp, synthetic construct
  misc_feature 1..23: note = Synthetic Construct
  source 1..23: mol_type = other DNA
tgtaaggggttagtcctccacaa

SEQ ID NO: 8595 - DNA, 21 bp, synthetic construct
  misc_feature 1..21: note = Synthetic Construct
  source 1..21: mol_type = other DNA
aggaaagagagctgggaggaa

SEQ ID NO: 8596 - DNA, 22 bp, synthetic construct
  misc_feature 1..22: note = Synthetic Construct
  source 1..22: mol_type = other DNA
gtctgcttttgggtcaggatga

SEQ ID NO: 8597 - DNA, 21 bp, synthetic construct
  misc_feature 1..21: note = Synthetic Construct
  source 1..21: mol_type = other DNA
atccccctgctttctggacaa

SEQ ID NO: 8598 - DNA, 22 bp, synthetic construct
  misc_feature 1..22: note = Synthetic Construct
  source 1..22: mol_type = other DNA
cctttctcaactcctggttgct

SEQ ID NO: 8599 - DNA, 25 bp, synthetic construct
  misc_feature 1..25: note = Synthetic Construct
  source 1..25: mol_type = other DNA
cccttttcaccacactgatgtttgc

SEQ ID NO: 8600 - DNA, 22 bp, synthetic construct
  misc_feature 1..22: note = Synthetic Construct
  source 1..22: mol_type = other DNA
aggtgaagcctcctgtcattct

SEQ ID NO: 8601 - DNA, 22 bp, synthetic construct
  misc_feature 1..22: note = Synthetic Construct
  source 1..22: mol_type = other DNA
caggtcacagcaggaaaacaac

SEQ ID NO: 8602 - DNA, 21 bp, synthetic construct
  misc_feature 1..21: note = Synthetic Construct
  source 1..21: mol_type = other DNA
agggagtgaatggtggcagaa

SEQ ID NO: 8603 - DNA, 21 bp, synthetic construct
  misc_feature 1..21: note = Synthetic Construct
  source 1..21: mol_type = other DNA
acagtgaggaaggctgagcat

SEQ ID NO: 8604 - DNA, 28 bp, synthetic construct
  misc_feature 1..28: note = Synthetic Construct
  source 1..28: mol_type = other DNA
ggccatgacattaagattgcttgaattc

SEQ ID NO: 8605 - DNA, 21 bp, synthetic construct
  misc_feature 1..21: note = Synthetic Construct
  source 1..21: mol_type = other DNA
aggctgggctactggagatag

SEQ ID NO: 8606 - DNA, 22 bp, synthetic construct
  misc_feature 1..22: note = Synthetic Construct
  source 1..22: mol_type = other DNA
actctgaactcgctgtgtcctt

SEQ ID NO: 8607 - DNA, 27 bp, synthetic construct
  misc_feature 1..27: note = Synthetic Construct
  source 1..27: mol_type = other DNA
ccctctattgatcctgttggagtttgg

SEQ ID NO: 8608 - DNA, 20 bp, synthetic construct
  misc_feature 1..20: note = Synthetic Construct
  source 1..20: mol_type = other DNA
tgaccaggtctccagtgctt

SEQ ID NO: 8609 - DNA, 22 bp, synthetic construct
  misc_feature 1..22: note = Synthetic Construct
  source 1..22: mol_type = other DNA
cctccctccatcctgtgagata

SEQ ID NO: 8610 - DNA, 22 bp, synthetic construct
  misc_feature 1..22: note = Synthetic Construct
  source 1..22: mol_type = other DNA
catcagcaagggccatttctga

SEQ ID NO: 8611 - DNA, 22 bp, synthetic construct
  misc_feature 1..22: note = Synthetic Construct
  source 1..22: mol_type = other DNA
cacaacaatcctgggactgaga

SEQ ID NO: 8612 - DNA, 22 bp, synthetic construct
  misc_feature 1..22: note = Synthetic Construct
  source 1..22: mol_type = other DNA
atgcccagtataccaggagtca

SEQ ID NO: 8613 - DNA, 27 bp, synthetic construct
  misc_feature 1..27: note = Synthetic Construct
  source 1..27: mol_type = other DNA
gccaaaaaggattattcccaggtcttg

SEQ ID NO: 8614 - DNA, 20 bp, synthetic construct
  misc_feature 1..20: note = Synthetic Construct
  source 1..20: mol_type = other DNA
aggctccccatggactgtca

SEQ ID NO: 8615 - DNA, 25 bp, synthetic construct
  misc_feature 1..25: note = Synthetic Construct
  source 1..25: mol_type = other DNA
tgatttcctctgtgctttctacctt

SEQ ID NO: 8616 - DNA, 22 bp, synthetic construct
  misc_feature 1..22: note = Synthetic Construct
  source 1..22: mol_type = other DNA
ctgatgaccacactgtctgcat

SEQ ID NO: 8617 - DNA, 24 bp, synthetic construct
  misc_feature 1..24: note = Synthetic Construct
  source 1..24: mol_type = other DNA
cactcccttaccaagaagcagtct

SEQ ID NO: 8618 - DNA, 22 bp, synthetic construct
  misc_feature 1..22: note = Synthetic Construct
  source 1..22: mol_type = other DNA
aaggtccgtgcaggttacaagt

SEQ ID NO: 8619 - DNA, 24 bp, synthetic construct
  misc_feature 1..24: note = Synthetic Construct
  source 1..24: mol_type = other DNA
gggcatcatacagtgaaggacttg

SEQ ID NO: 8620 - DNA, 25 bp, synthetic construct
  misc_feature 1..25: note = Synthetic Construct
  source 1..25: mol_type = other DNA
aattgagggcaattagctaggatca

SEQ ID NO: 8621 - DNA, 26 bp, synthetic construct
  misc_feature 1..26: note = Synthetic Construct
  source 1..26: mol_type = other DNA
agtaagaaaaagaatgggctctcagt

SEQ ID NO: 8622 - DNA, 24 bp, synthetic construct
  misc_feature 1..24: note = Synthetic Construct
  source 1..24: mol_type = other DNA
tcctagtgccagtatccgtttctg

SEQ ID NO: 8623 - DNA, 23 bp, synthetic construct
  misc_feature 1..23: note = Synthetic Construct
  source 1..23: mol_type = other DNA
gtgccctcaaaaaccacttaagg

SEQ ID NO: 8624 - DNA, 26 bp, synthetic construct
  misc_feature 1..26: note = Synthetic Construct
  source 1..26: mol_type = other DNA
cactttagagcagggtataacatgga

SEQ ID NO: 8625 - DNA, 22 bp, synthetic construct
  misc_feature 1..22: note = Synthetic Construct
  source 1..22: mol_type = other DNA
cccagttgttgtgctgaaatgg

SEQ ID NO: 8626 - DNA, 22 bp, synthetic construct
  misc_feature 1..22: note = Synthetic Construct
  source 1..22: mol_type = other DNA
tgggggttttttggctcatggt

SEQ ID NO: 8627 - DNA, 22 bp, synthetic construct
  misc_feature 1..22: note = Synthetic Construct
  source 1..22: mol_type = other DNA
actttacagtggggaggctaga

SEQ ID NO: 8628 - DNA, 22 bp, synthetic construct
  misc_feature 1..22: note = Synthetic Construct
  source 1..22: mol_type = other DNA
gccctttcccatcttgtacctt

SEQ ID NO: 8629 - DNA, 30 bp, synthetic construct
  misc_feature 1..30: note = Synthetic Construct
  source 1..30: mol_type = other DNA
aaattagttccattttagtgatcgccttaa

SEQ ID NO: 8630 - DNA, 25 bp, synthetic construct
  misc_feature 1..25: note = Synthetic Construct
  source 1..25: mol_type = other DNA
gcacagcactggatatcttaattgc

SEQ ID NO: 8631 - DNA, 26 bp, synthetic construct
  misc_feature 1..26: note = Synthetic Construct
  source 1..26: mol_type = other DNA
ctggaaattacaaagctcacttgact

SEQ ID NO: 8632 - DNA, 22 bp, synthetic construct
  misc_feature 1..22: note = Synthetic Construct
  source 1..22: mol_type = other DNA
ggtcttaccatggcgaaactct

SEQ ID NO: 8633 - DNA, 22 bp, synthetic construct
  misc_feature 1..22: note = Synthetic Construct
  source 1..22: mol_type = other DNA
aagagggactgtggtgaaagtg

SEQ ID NO: 8634 - DNA, 22 bp, synthetic construct
  misc_feature 1..22: note = Synthetic Construct
  source 1..22: mol_type = other DNA
acaactgcaagaacaggaccaa

SEQ ID NO: 8635 - DNA, 20 bp, synthetic construct
  misc_feature 1..20: note = Synthetic Construct
  source 1..20: mol_type = other DNA
cagccccaagactcccaaag

SEQ ID NO: 8636 - DNA, 26 bp, synthetic construct
  misc_feature 1..26: note = Synthetic Construct
  source 1..26: mol_type = other DNA
agccagaaggtgtatattaggattgg

SEQ ID NO: 8637 - DNA, 27 bp, synthetic construct
  misc_feature 1..27: note = Synthetic Construct
  source 1..27: mol_type = other DNA
ggtggggagtgttttacaggaatagat

SEQ ID NO: 8638 - DNA, 23 bp, synthetic construct
  misc_feature 1..23: note = Synthetic Construct
  source 1..23: mol_type = other DNA
gcttgcattgcttcacactatgt

SEQ ID NO: 8639 - DNA, 29 bp, synthetic construct
  misc_feature 1..29: note = Synthetic Construct
  source 1..29: mol_type = other DNA
ggcagagttaaagttctttagatcaacca

SEQ ID NO: 8640 - DNA, 25 bp, synthetic construct
  misc_feature 1..25: note = Synthetic Construct
  source 1..25: mol_type = other DNA
cgacgccactttatccctcttaaac

SEQ ID NO: 8641 - DNA, 21 bp, synthetic construct
  misc_feature 1..21: note = Synthetic Construct
  source 1..21: mol_type = other DNA
acatcctcccagtcagtgcta

SEQ ID NO: 8642 - DNA, 24 bp, synthetic construct
  misc_feature 1..24: note = Synthetic Construct
  source 1..24: mol_type = other DNA
ggtactgtccttccatccacaact

SEQ ID NO: 8643 - DNA, 22 bp, synthetic construct
  misc_feature 1..22: note = Synthetic Construct
  source 1..22: mol_type = other DNA
ctggcacaaccttgcttagttc

SEQ ID NO: 8644 - DNA, 25 bp, synthetic construct
  misc_feature 1..25: note = Synthetic Construct
  source 1..25: mol_type = other DNA
accaactggtcattcaggaacatag

SEQ ID NO: 8645 - DNA, 22 bp, synthetic construct
  misc_feature 1..22: note = Synthetic Construct
  source 1..22: mol_type = other DNA
gctcaagcatcctccactcctt

SEQ ID NO: 8646 - DNA, 23 bp, synthetic construct
  misc_feature 1..23: note = Synthetic Construct
  source 1..23: mol_type = other DNA
gctcacttgagtgccacttacag

SEQ ID NO: 8647 - DNA, 25 bp, synthetic construct
  misc_feature 1..25: note = Synthetic Construct
  source 1..25: mol_type = other DNA
cctcccatttacagcacaattcact

SEQ ID NO: 8648 - DNA, 20 bp, synthetic construct
  misc_feature 1..20: note = Synthetic Construct
  source 1..20: mol_type = other DNA
gccctccatgacttcgctta

SEQ ID NO: 8649 - DNA, 21 bp, synthetic construct
  misc_feature 1..21: note = Synthetic Construct
  source 1..21: mol_type = other DNA
ccttgccactcctctccctat

SEQ ID NO: 8650 - DNA, 24 bp, synthetic construct
  misc_feature 1..24: note = Synthetic Construct
  source 1..24: mol_type = other DNA
gtcctatggctgttctttcccata

SEQ ID NO: 8651 - DNA, 26 bp, synthetic construct
  misc_feature 1..26: note = Synthetic Construct
  source 1..26: mol_type = other DNA
cttctcctatatcctccacagatcct

SEQ ID NO: 8652 - DNA, 22 bp, synthetic construct
  misc_feature 1..22: note = Synthetic Construct
  source 1..22: mol_type = other DNA
ctgctgccatttgaccatatgc

SEQ ID NO: 8653 - DNA, 23 bp, synthetic construct
  misc_feature 1..23: note = Synthetic Construct
  source 1..23: mol_type = other DNA
ccacaaaggcaaggatacaatgg

SEQ ID NO: 8654 - DNA, 24 bp, synthetic construct
  misc_feature 1..24: note = Synthetic Construct
  source 1..24: mol_type = other DNA
caccattcaaggtgctatggagat

SEQ ID NO: 8655 - DNA, 24 bp, synthetic construct
  misc_feature 1..24: note = Synthetic Construct
  source 1..24: mol_type = other DNA
ggtttggagttaaggaaggtttgg

SEQ ID NO: 8656 - DNA, 21 bp, synthetic construct
  misc_feature 1..21: note = Synthetic Construct
  source 1..21: mol_type = other DNA
gccatgcactcacttgctaca

SEQ ID NO: 8657 - DNA, 25 bp, synthetic construct
  misc_feature 1..25: note = Synthetic Construct
  source 1..25: mol_type = other DNA
caaaatgtgccggaaaaggttatgt

SEQ ID NO: 8658 - DNA, 24 bp, synthetic construct
  misc_feature 1..24: note = Synthetic Construct
  source 1..24: mol_type = other DNA
cggctcaggtaggagatcattcta

SEQ ID NO: 8659 - DNA, 21 bp, synthetic construct
  misc_feature 1..21: note = Synthetic Construct
  source 1..21: mol_type = other DNA
tcctgttgcccagttctgctt

SEQ ID NO: 8660 - DNA, 22 bp, synthetic construct
  misc_feature 1..22: note = Synthetic Construct
  source 1..22: mol_type = other DNA
cttcgctgcacttgagtcaaaa

SEQ ID NO: 8661 - DNA, 24 bp, synthetic construct
  misc_feature 1..24: note = Synthetic Construct
  source 1..24: mol_type = other DNA
gcaccctatcatcagctttacaga

SEQ ID NO: 8662 - DNA, 24 bp, synthetic construct
  misc_feature 1..24: note = Synthetic Construct
  source 1..24: mol_type = other DNA
tcctcaccccaatctaaggacaca

SEQ ID NO: 8663 - DNA, 22 bp, synthetic construct
  misc_feature 1..22: note = Synthetic Construct
  source 1..22: mol_type = other DNA
tgtttgtggaccatgtgggaat

SEQ ID NO: 8664 - DNA, 28 bp, synthetic construct
  misc_feature 1..28: note = Synthetic Construct
  source 1..28: mol_type = other DNA
acagaaatatcttgtccttcagagaact

SEQ ID NO: 8665 - DNA, 27 bp, synthetic construct
  misc_feature 1..27: note = Synthetic Construct
  source 1..27: mol_type = other DNA
cacacatgcctcattaccattaacatc

SEQ ID NO: 8666 - DNA, 27 bp, synthetic construct
  misc_feature 1..27: note = Synthetic Construct
  source 1..27: mol_type = other DNA
ccactgattcaaggacttttgcgtaga

SEQ ID NO: 8667 - DNA, 23 bp, synthetic construct
  misc_feature 1..23: note = Synthetic Construct
  source 1..23: mol_type = other DNA
gggcaagtagtcaacgttactga

SEQ ID NO: 8668 - DNA, 25 bp, synthetic construct
  misc_feature 1..25: note = Synthetic Construct
  source 1..25: mol_type = other DNA
ccaagcaagttctatgactgtgaac

SEQ ID NO: 8669 - DNA, 21 bp, synthetic construct
  misc_feature 1..21: note = Synthetic Construct
  source 1..21: mol_type = other DNA
ttccccacgttggttcctttt

SEQ ID NO: 8670 - DNA, 23 bp, synthetic construct
  misc_feature 1..23: note = Synthetic Construct
  source 1..23: mol_type = other DNA
gagggtaggggcattatcttcag

SEQ ID NO: 8671 - DNA, 24 bp, synthetic construct
  misc_feature 1..24: note = Synthetic Construct
  source 1..24: mol_type = other DNA
tgggatccaggccagtattatacg

SEQ ID NO: 8672 - DNA, 23 bp, synthetic construct
  misc_feature 1..23: note = Synthetic Construct
  source 1..23: mol_type = other DNA
ctgcagtttgaccctttctacca

SEQ ID NO: 8673 - DNA, 19 bp, synthetic construct
  misc_feature 1..19: note = Synthetic Construct
  source 1..19: mol_type = other DNA
agctctgggctcaggaagt

SEQ ID NO: 8674 - DNA, 25 bp, synthetic construct
  misc_feature 1..25: note = Synthetic Construct
  source 1..25: mol_type = other DNA
cctcctcacagttagtgtacacctt

SEQ ID NO: 8675 - DNA, 26 bp, synthetic construct
  misc_feature 1..26: note = Synthetic Construct
  source 1..26: mol_type = other DNA
gactgagtgcaaactaatgttgactt

SEQ ID NO: 8676 - DNA, 20 bp, synthetic construct
  misc_feature 1..20: note = Synthetic Construct
  source 1..20: mol_type = other DNA
cagcactgcttggcatgaac

SEQ ID NO: 8677 - DNA, 23 bp, synthetic construct
  misc_feature 1..23: note = Synthetic Construct
  source 1..23: mol_type = other DNA
aggggaagggggagctatactta

SEQ ID NO: 8678 - DNA, 22 bp, synthetic construct
  misc_feature 1..22: note = Synthetic Construct
  source 1..22: mol_type = other DNA
tgcttgccggcttaagtgtcat

SEQ ID NO: 8679 - DNA, 25 bp, synthetic construct
  misc_feature 1..25: note = Synthetic Construct
  source 1..25: mol_type = other DNA
gagtaattcagccatcctgctctag

SEQ ID NO: 8680 - DNA, 22 bp, synthetic construct
  misc_feature 1..22: note = Synthetic Construct
  source 1..22: mol_type = other DNA
caacttcttgcccttgtttcgt

SEQ ID NO: 8681 - DNA, 28 bp, synthetic construct
  misc_feature 1..28: note = Synthetic Construct
  source 1..28: mol_type = other DNA
gagtctgtaaaatggctcagaaatttcc

SEQ ID NO: 8682 - DNA, 22 bp, synthetic construct
  misc_feature 1..22: note = Synthetic Construct
  source 1..22: mol_type = other DNA
tgcacagacagaggccaaattc

SEQ ID NO: 8683 - DNA, 27 bp, synthetic construct
  misc_feature 1..27: note = Synthetic Construct
  source 1..27: mol_type = other DNA
gtgattctcattgcacattctttctct

SEQ ID NO: 8684 - DNA, 26 bp, synthetic construct
  misc_feature 1..26: note = Synthetic Construct
  source 1..26: mol_type = other DNA
cagacttccacttgctctaagtaagg

SEQ ID NO: 8685 - DNA, 22 bp, synthetic construct
  misc_feature 1..22: note = Synthetic Construct
  source 1..22: mol_type = other DNA
tgggacatggttgtgacaagga

SEQ ID NO: 8686 - DNA, 22 bp, synthetic construct
  misc_feature 1..22: note = Synthetic Construct
  source 1..22: mol_type = other DNA
tacttggctcccagacaacatc

SEQ ID NO: 8687 - DNA, 22 bp, synthetic construct
  misc_feature 1..22: note = Synthetic Construct
  source 1..22: mol_type = other DNA
atggcaacccactcctcccttt

SEQ ID NO: 8688 - DNA, 24 bp, synthetic construct
  misc_feature 1..24: note = Synthetic Construct
  source 1..24: mol_type = other DNA
tcggagacacactgtagtttctca

SEQ ID NO: 8689 - DNA, 23 bp, synthetic construct
  misc_feature 1..23: note = Synthetic Construct
  source 1..23: mol_type = other DNA
cttttcctgagtgcgcgttcctt

SEQ ID NO: 8690 - DNA, 19 bp, synthetic construct
  misc_feature 1..19: note = Synthetic Construct
  source 1..19: mol_type = other DNA
tgcctcctcagggaagcat

SEQ ID NO: 8691 - DNA, 19 bp, synthetic construct
  misc_feature 1..19: note = Synthetic Construct
  source 1..19: mol_type = other DNA
ggggagccaatgtgcttct

SEQ ID NO: 8692 - DNA, 24 bp, synthetic construct
  misc_feature 1..24: note = Synthetic Construct
  source 1..24: mol_type = other DNA
gtgctgcagagtgaggagatatga

SEQ ID NO: 8693 - DNA, 21 bp, synthetic construct
  misc_feature 1..21: note = Synthetic Construct
  source 1..21: mol_type = other DNA
cgcagctgctgtacactaacg

SEQ ID NO: 8694 - DNA, 22 bp, synthetic construct
  misc_feature 1..22: note = Synthetic Construct
  source 1..22: mol_type = other DNA
actgcaactccttgaggtcaag

SEQ ID NO: 8695 - DNA, 22 bp, synthetic construct
  misc_feature 1..22: note = Synthetic Construct
  source 1..22: mol_type = other DNA
tccttgacctggggatgatgga

SEQ ID NO: 8696 - DNA, 21 bp, synthetic construct
  misc_feature 1..21: note = Synthetic Construct
  source 1..21: mol_type = other DNA
aagagccaagcttgtcaacca

SEQ ID NO: 8697 - DNA, 24 bp, synthetic construct
  misc_feature 1..24: note = Synthetic Construct
  source 1..24: mol_type = other DNA
catggacccaagacctaggattct

SEQ ID NO: 8698 - DNA, 22 bp, synthetic construct
  misc_feature 1..22: note = Synthetic Construct
  source 1..22: mol_type = other DNA
gtgccatctagggacctaggaa

SEQ ID NO: 8699 - DNA, 24 bp, synthetic construct
  misc_feature 1..24: note = Synthetic Construct
  source 1..24: mol_type = other DNA
agaagaggcagtgagaacctaact

SEQ ID NO: 8700 - DNA, 25 bp, synthetic construct
  misc_feature 1..25: note = Synthetic Construct
  source 1..25: mol_type = other DNA
cctaggtcgctttaagtcacaaagc

SEQ ID NO: 8701 - DNA, 25 bp, synthetic construct
  misc_feature 1..25: note = Synthetic Construct
  source 1..25: mol_type = other DNA
agtgaaggcacagttttatccagtt

SEQ ID NO: 8702 - DNA, 22 bp, synthetic construct
  misc_feature 1..22: note = Synthetic Construct
  source 1..22: mol_type = other DNA
tctctgggcttaaagggaaagc

SEQ ID NO: 8703 - DNA, 22 bp, synthetic construct
  misc_feature 1..22: note = Synthetic Construct
  source 1..22: mol_type = other DNA
gggaagtgggcataaccttgtt

SEQ ID NO: 8704 - DNA, 23 bp, synthetic construct
  misc_feature 1..23: note = Synthetic Construct
  source 1..23: mol_type = other DNA
gcagcaaaaatggttctcatcct

SEQ ID NO: 8705 - DNA, 25 bp, synthetic construct
  misc_feature 1..25: note = Synthetic Construct
  source 1..25: mol_type = other DNA
ccaacctccagtaaagcatcaactc

SEQ ID NO: 8706 - DNA, 22 bp, synthetic construct
  misc_feature 1..22: note = Synthetic Construct
  source 1..22: mol_type = other DNA
acccagcactgaccttcctaat

SEQ ID NO: 8707 - DNA, 24 bp, synthetic construct
  misc_feature 1..24: note = Synthetic Construct
  source 1..24: mol_type = other DNA
cctccttgtcttcccactgctttt

SEQ ID NO: 8708 - DNA, 22 bp, synthetic construct
  misc_feature 1..22: note = Synthetic Construct
  source 1..22: mol_type = other DNA
gggaaaacagactctgccttga

SEQ ID NO: 8709 - DNA, 27 bp, synthetic construct
  misc_feature 1..27: note = Synthetic Construct
  source 1..27: mol_type = other DNA
gtaaagcttcagtcaatcagtgtgatt

SEQ ID NO: 8710 - DNA, 21 bp, synthetic construct
  misc_feature 1..21: note = Synthetic Construct
  source 1..21: mol_type = other DNA
tggaggatttggtgccagaga

SEQ ID NO: 8711 - DNA, 20 bp, synthetic construct
  misc_feature 1..20: note = Synthetic Construct
  source 1..20: mol_type = other DNA
tgacaccctgctgctgtcta

SEQ ID NO: 8712 - DNA, 24 bp, synthetic construct
  misc_feature 1..24: note = Synthetic Construct
  source 1..24: mol_type = other DNA
gtttctgaagggcatatggcttca

SEQ ID NO: 8713 - DNA, 23 bp, synthetic construct
  misc_feature 1..23: note = Synthetic Construct
  source 1..23: mol_type = other DNA
cagcaacccccaaccatgataaa

SEQ ID NO: 8714 - DNA, 22 bp, synthetic construct
  misc_feature 1..22: note = Synthetic Construct
  source 1..22: mol_type = other DNA
ggggccatgtgagaagaaatgt

SEQ ID NO: 8715 - DNA, 22 bp, synthetic construct
  misc_feature 1..22: note = Synthetic Construct
  source 1..22: mol_type = other DNA
tccccaccatgaactctgtcta

SEQ ID NO: 8716 - DNA, 23 bp, synthetic construct
  misc_feature 1..23: note = Synthetic Construct
  source 1..23: mol_type = other DNA
tcctgctacaagtctcagatggt

SEQ ID NO: 8717 - DNA, 24 bp, synthetic construct
  misc_feature 1..24: note = Synthetic Construct
  source 1..24: mol_type = other DNA
gcacccttaatgtccagacataca

SEQ ID NO: 8718 - DNA, 22 bp, synthetic construct
  misc_feature 1..22: note = Synthetic Construct
  source 1..22: mol_type = other DNA
ttcaacagcacggtgatcctaa

SEQ ID NO: 8719 - DNA, 20 bp, synthetic construct
  misc_feature 1..20: note = Synthetic Construct
  source 1..20: mol_type = other DNA
atgtgctggtcttggcagtt

SEQ ID NO: 8720 - DNA, 20 bp, synthetic construct
  misc_feature 1..20: note = Synthetic Construct
  source 1..20: mol_type = other DNA
accctcctcagcacaaagca

SEQ ID NO: 8721 - DNA, 24 bp, synthetic construct
  misc_feature 1..24: note = Synthetic Construct
  source 1..24: mol_type = other DNA
gcccccttctttcttaggataggt

SEQ ID NO: 8722 - DNA, 19 bp, synthetic construct
  misc_feature 1..19: note = Synthetic Construct
  source 1..19: mol_type = other DNA
ccaatggggcagcaagaca

SEQ ID NO: 8723 - DNA, 21 bp, synthetic construct
  misc_feature 1..21: note = Synthetic Construct
  source 1..21: mol_type = other DNA
ctgctgacaccaaaccagttg

SEQ ID NO: 8724 - DNA, 22 bp, synthetic construct
  misc_feature 1..22: note = Synthetic Construct
  source 1..22: mol_type = other DNA
tgagtccaggcctagactctct

SEQ ID NO: 8725 - DNA, 22 bp, synthetic construct
  misc_feature 1..22: note = Synthetic Construct
  source 1..22: mol_type = other DNA
tcctccaaccctgtctttgaac

SEQ ID NO: 8726 - DNA, 23 bp, synthetic construct
  misc_feature 1..23: note = Synthetic Construct
  source 1..23: mol_type = other DNA
cagagaaggcattgacagtggat

SEQ ID NO: 8727 - DNA, 22 bp, synthetic construct
  misc_feature 1..22: note = Synthetic Construct
  source 1..22: mol_type = other DNA
gcccctgctgaaaattctggtt

SEQ ID NO: 8728 - DNA, 21 bp, synthetic construct
  misc_feature 1..21: note = Synthetic Construct
  source 1..21: mol_type = other DNA
agccctgcttcctcctacata

SEQ ID NO: 8729 - DNA, 22 bp, synthetic construct
  misc_feature 1..22: note = Synthetic Construct
  source 1..22: mol_type = other DNA
gagtgcaggtgtctggaagatc

SEQ ID NO: 8730 - DNA, 25 bp, synthetic construct
  misc_feature 1..25: note = Synthetic Construct
  source 1..25: mol_type = other DNA
ctgagtcctatctgtctctggacat

SEQ ID NO: 8731 - DNA, 24 bp, synthetic construct
  misc_feature 1..24: note = Synthetic Construct
  source 1..24: mol_type = other DNA
agccttgaggttaaaggtcatctc

SEQ ID NO: 8732 - DNA, 24 bp, synthetic construct
  misc_feature 1..24: note = Synthetic Construct
  source 1..24: mol_type = other DNA
gggttgatgcacatgcccttaaac

SEQ ID NO: 8733 - DNA, 24 bp, synthetic construct
  misc_feature 1..24: note = Synthetic Construct
  source 1..24: mol_type = other DNA
ttgcaaacatgctctcattgagtt

SEQ ID NO: 8734 - DNA, 22 bp, synthetic construct
  misc_feature 1..22: note = Synthetic Construct
  source 1..22: mol_type = other DNA
gcaaggagaaacagtgcacaag

SEQ ID NO: 8735 - DNA, 24 bp, synthetic construct
  misc_feature 1..24: note = Synthetic Construct
  source 1..24: mol_type = other DNA
gcacttgtgggagagagaacacaa

SEQ ID NO: 8736 - DNA, 24 bp, synthetic construct
  misc_feature 1..24: note = Synthetic Construct
  source 1..24: mol_type = other DNA
ctctgaaccctgtaactacagcaa

SEQ ID NO: 8737 - DNA, 25 bp, synthetic construct
  misc_feature 1..25: note = Synthetic Construct
  source 1..25: mol_type = other DNA
cctgttgtttccgagaaagacaaac

SEQ ID NO: 8738 - DNA, 23 bp, synthetic construct
  misc_feature 1..23: note = Synthetic Construct
  source 1..23: mol_type = other DNA
gaaaacttcagccaaagccatct

SEQ ID NO: 8739 - DNA, 24 bp, synthetic construct
  misc_feature 1..24: note = Synthetic Construct
  source 1..24: mol_type = other DNA
gcccagattcttgcagaaccagaa

SEQ ID NO: 8740 - DNA, 22 bp, synthetic construct
  misc_feature 1..22: note = Synthetic Construct
  source 1..22: mol_type = other DNA
tggccttatactggctcctgtt

SEQ ID NO: 8741 - DNA, 25 bp, synthetic construct
  misc_feature 1..25: note = Synthetic Construct
  source 1..25: mol_type = other DNA
agtcaaccttcttacttccaaagca

SEQ ID NO: 8742 - DNA, 25 bp, synthetic construct
  misc_feature 1..25: note = Synthetic Construct
  source 1..25: mol_type = other DNA
agaggatttctctccccacttttct

SEQ ID NO: 8743 - DNA, 24 bp, synthetic construct
  misc_feature 1..24: note = Synthetic Construct
  source 1..24: mol_type = other DNA
gcaaccagcctagaaatcaatcca

SEQ ID NO: 8744 - DNA, 28 bp, synthetic construct
  misc_feature 1..28: note = Synthetic Construct
  source 1..28: mol_type = other DNA
gcttgcactataggtaaaggcaaaatct

SEQ ID NO: 8745 - DNA, 24 bp, synthetic construct
  misc_feature 1..24: note = Synthetic Construct
  source 1..24: mol_type = other DNA
ctgggaacatgactgtctaggaaa

SEQ ID NO: 8746 - DNA, 21 bp, synthetic construct
  misc_feature 1..21: note = Synthetic Construct
  source 1..21: mol_type = other DNA
acaccctgtggagatgttcga

SEQ ID NO: 8747 - DNA, 25 bp, synthetic construct
  misc_feature 1..25: note = Synthetic Construct
  source 1..25: mol_type = other DNA
caagtgaaaccctaagctcttcttg

SEQ ID NO: 8748 - DNA, 26 bp, synthetic construct
  misc_feature 1..26: note = Synthetic Construct
  source 1..26: mol_type = other DNA
atgcaaagccacacagtagtttatac

SEQ ID NO: 8749 - DNA, 22 bp, synthetic construct
  misc_feature 1..22: note = Synthetic Construct
  source 1..22: mol_type = other DNA
ggaacagaagctggtttgcttt

SEQ ID NO: 8750 - DNA, 25 bp, synthetic construct
  misc_feature 1..25: note = Synthetic Construct
  source 1..25: mol_type = other DNA
atgcagactcacagttctaattgga

SEQ ID NO: 8751 - DNA, 26 bp, synthetic construct
  misc_feature 1..26: note = Synthetic Construct
  source 1..26: mol_type = other DNA
ccctggagctctaagtaaacttgaag

SEQ ID NO: 8752 - DNA, 24 bp, synthetic construct
  misc_feature 1..24: note = Synthetic Construct
  source 1..24: mol_type = other DNA
gacttcaaagctggttccattcaa

SEQ ID NO: 8753 - DNA, 22 bp, synthetic construct
  misc_feature 1..22: note = Synthetic Construct
  source 1..22: mol_type = other DNA
cttcacctttcacttgcttgca

SEQ ID NO: 8754 - DNA, 23 bp, synthetic construct
  misc_feature 1..23: note = Synthetic Construct
  source 1..23: mol_type = other DNA
ggttctgcagagtcattggtctt

SEQ ID NO: 8755 - DNA, 22 bp, synthetic construct
  misc_feature 1..22: note = Synthetic Construct
  source 1..22: mol_type = other DNA
tctcagttcgcaggctaagatc

SEQ ID NO: 8756 - DNA, 20 bp, synthetic construct
  misc_feature 1..20: note = Synthetic Construct
  source 1..20: mol_type = other DNA
agacacacctgggaccagaa

SEQ ID NO: 8757 - DNA, 23 bp, synthetic construct
  misc_feature 1..23: note = Synthetic Construct
  source 1..23: mol_type = other DNA
cagaatggctgactttgcatgag

SEQ ID NO: 8758 - DNA, 26 bp, synthetic construct
  misc_feature 1..26: note = Synthetic Construct
  source 1..26: mol_type = other DNA
cagtatgactgatcacaagaccaagt

SEQ ID NO: 8759 - DNA, 24 bp, synthetic construct
  misc_feature 1..24: note = Synthetic Construct
  source 1..24: mol_type = other DNA
cgatactgcaaggcaagtcctatg

SEQ ID NO: 8760 - DNA, 22 bp, synthetic construct
  misc_feature 1..22: note = Synthetic Construct
  source 1..22: mol_type = other DNA
ttgttcctgtgggtgtgagcta

SEQ ID NO: 8761 - DNA, 21 bp, synthetic construct
  misc_feature 1..21: note = Synthetic Construct
  source 1..21: mol_type = other DNA
tgtgccagtcctctcccttat

SEQ ID NO: 8762 - DNA, 25 bp, synthetic construct
  misc_feature 1..25: note = Synthetic Construct
  source 1..25: mol_type = other DNA
agttcaaaacacacaagtgctaacc

SEQ ID NO: 8763 - DNA, 24 bp, synthetic construct
  misc_feature 1..24: note = Synthetic Construct
  source 1..24: mol_type = other DNA
gttcgtgtttattcagcagagctt

SEQ ID NO: 8764 - DNA, 20 bp, synthetic construct
  misc_feature 1..20: note = Synthetic Construct
  source 1..20: mol_type = other DNA
gctcctgtgcaacccaaaag

SEQ ID NO: 8765 - DNA, 21 bp, synthetic construct
  misc_feature 1..21: note = Synthetic Construct
  source 1..21: mol_type = other DNA
gtgtttgtggccatgtgtcaa

SEQ ID NO: 8766 - DNA, 20 bp, synthetic construct
  misc_feature 1..20: note = Synthetic Construct
  source 1..20: mol_type = other DNA
aagagcaccctccaggttca

SEQ ID NO: 8767 - DNA, 24 bp, synthetic construct
  misc_feature 1..24: note = Synthetic Construct
  source 1..24: mol_type = other DNA
agctctagatgaggctgagactaa

SEQ ID NO: 8768 - DNA, 26 bp, synthetic construct
  misc_feature 1..26: note = Synthetic Construct
  source 1..26: mol_type = other DNA
ccttcatctcttgtgccatcttacct

SEQ ID NO: 8769 - DNA, 24 bp, synthetic construct
  misc_feature 1..24: note = Synthetic Construct
  source 1..24: mol_type = other DNA
acctccaggacagaagtacaatct

SEQ ID NO: 8770 - DNA, 20 bp, synthetic construct
  misc_feature 1..20: note = Synthetic Construct
  source 1..20: mol_type = other DNA
gcccctttcccgtgattctt

SEQ ID NO: 8771 - DNA, 24 bp, synthetic construct
  misc_feature 1..24: note = Synthetic Construct
  source 1..24: mol_type = other DNA
aggtggaggagtcagatggatgta

SEQ ID NO: 8772 - DNA, 25 bp, synthetic construct
  misc_feature 1..25: note = Synthetic Construct
  source 1..25: mol_type = other DNA
ggttagagaaaaacccacccattgt

SEQ ID NO: 8773 - DNA, 24 bp, synthetic construct
  misc_feature 1..24: note = Synthetic Construct
  source 1..24: mol_type = other DNA
cagtgttgacagccaactctttcc

SEQ ID NO: 8774 - DNA, 22 bp, synthetic construct
  misc_feature 1..22: note = Synthetic Construct
  source 1..22: mol_type = other DNA
ccccaatccaatccctgaagac

SEQ ID NO: 8775 - DNA, 24 bp, synthetic construct
  misc_feature 1..24: note = Synthetic Construct
  source 1..24: mol_type = other DNA
gggtgatgtcccttcaggaagaaa

SEQ ID NO: 8776 - DNA, 20 bp, synthetic construct
  misc_feature 1..20: note = Synthetic Construct
  source 1..20: mol_type = other DNA
tggccgtgacatcaacaact

SEQ ID NO: 8777 - DNA, 20 bp, synthetic construct
  misc_feature 1..20: note = Synthetic Construct
  source 1..20: mol_type = other DNA
aggcacccctcctccttatc

SEQ ID NO: 8778 - DNA, 24 bp, synthetic construct
  misc_feature 1..24: note = Synthetic Construct
  source 1..24: mol_type = other DNA
gagcagaggagtggttttaagagt

SEQ ID NO: 8779 - DNA, 19 bp, synthetic construct
  misc_feature 1..19: note = Synthetic Construct
  source 1..19: mol_type = other DNA
aaggtccacccacctttgc

SEQ ID NO: 8780 - DNA, 30 bp, synthetic construct
  misc_feature 1..30: note = Synthetic Construct
  source 1..30: mol_type = other DNA
ctagctactaagtactttcaaggactctac

SEQ ID NO: 8781 - DNA, 26 bp, synthetic construct
  misc_feature 1..26: note = Synthetic Construct
  source 1..26: mol_type = other DNA
gccttggaaggttttctgggacatag

SEQ ID NO: 8782 - DNA, 25 bp, synthetic construct
  misc_feature 1..25: note = Synthetic Construct
  source 1..25: mol_type = other DNA
acacagaggtagaagtggacttaga

SEQ ID NO: 8783 - DNA, 20 bp, synthetic construct
  misc_feature 1..20: note = Synthetic Construct
  source 1..20: mol_type = other DNA
acctggctccctggatacca

SEQ ID NO: 8784 - DNA, 22 bp, synthetic construct
  misc_feature 1..22: note = Synthetic Construct
  source 1..22: mol_type = other DNA
tgtgtctgcacctttcctatcg

SEQ ID NO: 8785 - DNA, 23 bp, synthetic construct
  misc_feature 1..23: note = Synthetic Construct
  source 1..23: mol_type = other DNA
gctgggattgaaaggagatgaca

SEQ ID NO: 8786 - DNA, 27 bp, synthetic construct
  misc_feature 1..27: note = Synthetic Construct
  source 1..27: mol_type = other DNA
tgtttgcagccaataacttatgtagtg

SEQ ID NO: 8787 - DNA, 24 bp, synthetic construct
  misc_feature 1..24: note = Synthetic Construct
  source 1..24: mol_type = other DNA
cagtagggtgagccaagataccat

SEQ ID NO: 8788 - DNA, 22 bp, synthetic construct
  misc_feature 1..22: note = Synthetic Construct
  source 1..22: mol_type = other DNA
aaaaccagtggacacctgtgat

SEQ ID NO: 8789 - DNA, 22 bp, synthetic construct
  misc_feature 1..22: note = Synthetic Construct
  source 1..22: mol_type = other DNA
tgggtagctcctaacagcagtt

SEQ ID NO: 8790 - DNA, 25 bp, synthetic construct
  misc_feature 1..25: note = Synthetic Construct
  source 1..25: mol_type = other DNA
ggcatctagaatggatttggtcaca

SEQ ID NO: 8791 - DNA, 22 bp, synthetic construct
  misc_feature 1..22: note = Synthetic Construct
  source 1..22: mol_type = other DNA
ccttggccagaactcaaccaaa

SEQ ID NO: 8792 - DNA, 24 bp, synthetic construct
  misc_feature 1..24: note = Synthetic Construct
  source 1..24: mol_type = other DNA
ggcagctgaaactgtagctgtaag

SEQ ID NO: 8793 - DNA, 22 bp, synthetic construct
  misc_feature 1..22: note = Synthetic Construct
  source 1..22: mol_type = other DNA
ctggcctggaaagattgacctt

SEQ ID NO: 8794 - DNA, 28 bp, synthetic construct
  misc_feature 1..28: note = Synthetic Construct
  source 1..28: mol_type = other DNA
cataaagtacattccatggtggcatatt

SEQ ID NO: 8795 - DNA, 19 bp, synthetic construct
  misc_feature 1..19: note = Synthetic Construct
  source 1..19: mol_type = other DNA
ccttgggctggcttttgga

SEQ ID NO: 8796 - DNA, 23 bp, synthetic construct
  misc_feature 1..23: note = Synthetic Construct
  source 1..23: mol_type = other DNA
gggtggcagagtttcaagataga

SEQ ID NO: 8797 - DNA, 22 bp, synthetic construct
  misc_feature 1..22: note = Synthetic Construct
  source 1..22: mol_type = other DNA
cacacatgccttccatccatct

SEQ ID NO: 8798 - DNA, 24 bp, synthetic construct
  misc_feature 1..24: note = Synthetic Construct
  source 1..24: mol_type = other DNA
ggtcaccttggatactctgaaacc

SEQ ID NO: 8799 - DNA, 22 bp, synthetic construct
  misc_feature 1..22: note = Synthetic Construct
  source 1..22: mol_type = other DNA
ccgtgatcacacagctggttta

SEQ ID NO: 8800 - DNA, 24 bp, synthetic construct
  misc_feature 1..24: note = Synthetic Construct
  source 1..24: mol_type = other DNA
cctggcaaggaaagcttctttaca

SEQ ID NO: 8801 - DNA, 21 bp, synthetic construct
  misc_feature 1..21: note = Synthetic Construct
  source 1..21: mol_type = other DNA
tgtagtgtcgggccaaatcag

SEQ ID NO: 8802 - DNA, 26 bp, synthetic construct
  misc_feature 1..26: note = Synthetic Construct
  source 1..26: mol_type = other DNA
ctctatctctgtctcgcttcagattc

SEQ ID NO: 8803 - DNA, 23 bp, synthetic construct
  misc_feature 1..23: note = Synthetic Construct
  source 1..23: mol_type = other DNA
accctttgtctctcactcccttt

SEQ ID NO: 8804 - DNA, 22 bp, synthetic construct
  misc_feature 1..22: note = Synthetic Construct
  source 1..22: mol_type = other DNA
caactggcacaaatgaggcatt

SEQ ID NO: 8805 - DNA, 28 bp, synthetic construct
  misc_feature 1..28: note = Synthetic Construct
  source 1..28: mol_type = other DNA
gaaaattacttggaactgtaagggcatt

SEQ ID NO: 8806 - DNA, 21 bp, synthetic construct
  misc_feature 1..21: note = Synthetic Construct
  source 1..21: mol_type = other DNA
ccaaaccctcctcccttttgt

SEQ ID NO: 8807 - DNA, 24 bp, synthetic construct
  misc_feature 1..24: note = Synthetic Construct
  source 1..24: mol_type = other DNA
tcatagctgtggaagttgtagcaa

SEQ ID NO: 8808 - DNA, 24 bp, synthetic construct
  misc_feature 1..24: note = Synthetic Construct
  source 1..24: mol_type = other DNA
ggcactcaaaccacacggaaatac

SEQ ID NO: 8809 - DNA, 21 bp, synthetic construct
  misc_feature 1..21: note = Synthetic Construct
  source 1..21: mol_type = other DNA
agttttgccccagggatacag

SEQ ID NO: 8810 - DNA, 24 bp, synthetic construct
  misc_feature 1..24: note = Synthetic Construct
  source 1..24: mol_type = other DNA
gcaaagtaccctacctaaccaaca

SEQ ID NO: 8811 - DNA, 22 bp, synthetic construct
  misc_feature 1..22: note = Synthetic Construct
  source 1..22: mol_type = other DNA
tcccttctggctcaggatatgt

SEQ ID NO: 8812 - DNA, 24 bp, synthetic construct
  misc_feature 1..24: note = Synthetic Construct
  source 1..24: mol_type = other DNA
gtaagtttgccaaaccctgctaaa

SEQ ID NO: 8813 - DNA, 27 bp, synthetic construct
  misc_feature 1..27: note = Synthetic Construct
  source 1..27: mol_type = other DNA
gccacaaggaaacaaatctgacaacag

SEQ ID NO: 8814 - DNA, 23 bp, synthetic construct
  misc_feature 1..23: note = Synthetic Construct
  source 1..23: mol_type = other DNA
ccacaccaacatagtgcacttga

SEQ ID NO: 8815 - DNA, 22 bp, synthetic construct
  misc_feature 1..22: note = Synthetic Construct
  source 1..22: mol_type = other DNA
tttgggagtctgccttctcctt

SEQ ID NO: 8816 - DNA, 26 bp, synthetic construct
  misc_feature 1..26: note = Synthetic Construct
  source 1..26: mol_type = other DNA
cctcgtggagaaaatacctgtgttag

SEQ ID NO: 8817 - DNA, 25 bp, synthetic construct
  misc_feature 1..25: note = Synthetic Construct
  source 1..25: mol_type = other DNA
gtcaactgctatgtgtcagagtttg

SEQ ID NO: 8818 - DNA, 29 bp, synthetic construct
  misc_feature 1..29: note = Synthetic Construct
  source 1..29: mol_type = other DNA
ccctggaacatgttaacagacttaattag

SEQ ID NO: 8819 - DNA, 25 bp, synthetic construct
  misc_feature 1..25: note = Synthetic Construct
  source 1..25: mol_type = other DNA
actgttccagctcagtttcctaaac

SEQ ID NO: 8820 - DNA, 27 bp, synthetic construct
  misc_feature 1..27: note = Synthetic Construct
  source 1..27: mol_type = other DNA
atacttataaacccaagctctgtcact

SEQ ID NO: 8821 - DNA, 22 bp, synthetic construct
  misc_feature 1..22: note = Synthetic Construct
  source 1..22: mol_type = other DNA
gttccttagcccacatgtggtt

SEQ ID NO: 8822 - DNA, 23 bp, synthetic construct
  misc_feature 1..23: note = Synthetic Construct
  source 1..23: mol_type = other DNA
tgagcttgtgtggaagtgattca

SEQ ID NO: 8823 - DNA, 25 bp, synthetic construct
  misc_feature 1..25: note = Synthetic Construct
  source 1..25: mol_type = other DNA
gggttcccaatgcatacagaaatcc

SEQ ID NO: 8824 - DNA, 26 bp, synthetic construct
  misc_feature 1..26: note = Synthetic Construct
  source 1..26: mol_type = other DNA
gtcacctttgacctgtttcttagtgt

SEQ ID NO: 8825 - DNA, 22 bp, synthetic construct
  misc_feature 1..22: note = Synthetic Construct
  source 1..22: mol_type = other DNA
aggtgtgaacaggtgaccaact

SEQ ID NO: 8826 - DNA, 21 bp, synthetic construct
  misc_feature 1..21: note = Synthetic Construct
  source 1..21: mol_type = other DNA
accctaggagcaaggctgtgt

SEQ ID NO: 8827 - DNA, 27 bp, synthetic construct
  misc_feature 1..27: note = Synthetic Construct
  source 1..27: mol_type = other DNA
acagccctgtaaataccctctgggttt

SEQ ID NO: 8828 - DNA, 27 bp, synthetic construct
  misc_feature 1..27: note = Synthetic Construct
  source 1..27: mol_type = other DNA
agactccaaatatcaagctctcagaat

SEQ ID NO: 8829 - DNA, 27 bp, synthetic construct
  misc_feature 1..27: note = Synthetic Construct
  source 1..27: mol_type = other DNA
ctagaaagatgaagatcctgaggttca

SEQ ID NO: 8830 - DNA, 25 bp, synthetic construct
  misc_feature 1..25: note = Synthetic Construct
  source 1..25: mol_type = other DNA
ggtgagtccatcagacattccttca

SEQ ID NO: 8831 - DNA, 23 bp, synthetic construct
  misc_feature 1..23: note = Synthetic Construct
  source 1..23: mol_type = other DNA
acacattcccatctgcttgagat

SEQ ID NO: 8832 - DNA, 21 bp, synthetic construct
  misc_feature 1..21: note = Synthetic Construct
  source 1..21: mol_type = other DNA
aaagctgcagcagatgagaca

SEQ ID NO: 8833 - DNA, 29 bp, synthetic construct
  misc_feature 1..29: note = Synthetic Construct
  source 1..29: mol_type = other DNA
gattccttatcaccacccttttattcttt

SEQ ID NO: 8834 - DNA, 26 bp, synthetic construct
  misc_feature 1..26: note = Synthetic Construct
  source 1..26: mol_type = other DNA
gctgtacagtcaaggttatccttctc

SEQ ID NO: 8835 - DNA, 23 bp, synthetic construct
  misc_feature 1..23: note = Synthetic Construct
  source 1..23: mol_type = other DNA
gcaccccattcaatgcacacaaa

SEQ ID NO: 8836 - DNA, 22 bp, synthetic construct
  misc_feature 1..22: note = Synthetic Construct
  source 1..22: mol_type = other DNA
acttcttctggcatgccactct

SEQ ID NO: 8837 - DNA, 24 bp, synthetic construct
  misc_feature 1..24: note = Synthetic Construct
  source 1..24: mol_type = other DNA
gtaggggcttcagactcattacac

SEQ ID NO: 8838 - DNA, 24 bp, synthetic construct
  misc_feature 1..24: note = Synthetic Construct
  source 1..24: mol_type = other DNA
gggagatggaggttgtgggattaa

SEQ ID NO: 8839 - DNA, 25 bp, synthetic construct
  misc_feature 1..25: note = Synthetic Construct
  source 1..25: mol_type = other DNA
ggcagagatgattgatacggactac

SEQ ID NO: 8840 - DNA, 24 bp, synthetic construct
  misc_feature 1..24: note = Synthetic Construct
  source 1..24: mol_type = other DNA
gcctactaagaactgctctcaact

SEQ ID NO: 8841 - DNA, 27 bp, synthetic construct
  misc_feature 1..27: note = Synthetic Construct
  source 1..27: mol_type = other DNA
gatagaggaagaaaagtcaaggaccat

SEQ ID NO: 8842 - DNA, 23 bp, synthetic construct
  misc_feature 1..23: note = Synthetic Construct
  source 1..23: mol_type = other DNA
ccctctggaagatgcagttacag

SEQ ID NO: 8843 - DNA, 19 bp, synthetic construct
  misc_feature 1..19: note = Synthetic Construct
  source 1..19: mol_type = other DNA
cgactgcatcgtgcctgta

SEQ ID NO: 8844 - DNA, 27 bp, synthetic construct
  misc_feature 1..27: note = Synthetic Construct
  source 1..27: mol_type = other DNA
ggagaggctgtgtctctagtaattgag

SEQ ID NO: 8845 - DNA, 26 bp, synthetic construct
  misc_feature 1..26: note = Synthetic Construct
  source 1..26: mol_type = other DNA
gcaggtattgaatcacagttgtggtt

SEQ ID NO: 8846 - DNA, 26 bp, synthetic construct
  misc_feature 1..26: note = Synthetic Construct
  source 1..26: mol_type = other DNA
gaaaacaatcaggctctttgtttcct

SEQ ID NO: 8847 - DNA, 21 bp, synthetic construct
  misc_feature 1..21: note = Synthetic Construct
  source 1..21: mol_type = other DNA
caggagaacttgaggcaggtt

SEQ ID NO: 8848 - DNA, 23 bp, synthetic construct
  misc_feature 1..23: note = Synthetic Construct
  source 1..23: mol_type = other DNA
gcagcctagaccataaggactac

SEQ ID NO: 8849 - DNA, 26 bp, synthetic construct
  misc_feature 1..26: note = Synthetic Construct
  source 1..26: mol_type = other DNA
acatatgctgcttcattctgactgaa

SEQ ID NO: 8850 - DNA, 21 bp, synthetic construct
  misc_feature 1..21: note = Synthetic Construct
  source 1..21: mol_type = other DNA
gtcatcagggttgtgcttcct

SEQ ID NO: 8851 - DNA, 25 bp, synthetic construct
  misc_feature 1..25: note = Synthetic Construct
  source 1..25: mol_type = other DNA
cctgagggtcagattccttcacatt

SEQ ID NO: 8852 - DNA, 22 bp, synthetic construct
  misc_feature 1..22: note = Synthetic Construct
  source 1..22: mol_type = other DNA
acaccctagctgcttctagtca

SEQ ID NO: 8853 - DNA, 25 bp, synthetic construct
  misc_feature 1..25: note = Synthetic Construct
  source 1..25: mol_type = other DNA
ccaagctacttgaagacaccatacc

SEQ ID NO: 8854 - DNA, 24 bp, synthetic construct
  misc_feature 1..24: note = Synthetic Construct
  source 1..24: mol_type = other DNA
cccaccccacaatgagatataagg

SEQ ID NO: 8855 - DNA, 21 bp, synthetic construct
  misc_feature 1..21: note = Synthetic Construct
  source 1..21: mol_type = other DNA
gcagcttgctccatcaggtat

SEQ ID NO: 8856 - DNA, 24 bp, synthetic construct
  misc_feature 1..24: note = Synthetic Construct
  source 1..24: mol_type = other DNA
gacctctgagaaacgacacttaca

SEQ ID NO: 8857 - DNA, 24 bp, synthetic construct
  misc_feature 1..24: note = Synthetic Construct
  source 1..24: mol_type = other DNA
agcatgttttcaaggggatttgac

SEQ ID NO: 8858 - DNA, 24 bp, synthetic construct
  misc_feature 1..24: note = Synthetic Construct
  source 1..24: mol_type = other DNA
cctgaacctggagttaaggtacca

SEQ ID NO: 8859 - DNA, 24 bp, synthetic construct
  misc_feature 1..24: note = Synthetic Construct
  source 1..24: mol_type = other DNA
gggaatctggtgaagacaatgaga

SEQ ID NO: 8860 - DNA, 24 bp, synthetic construct
  misc_feature 1..24: note = Synthetic Construct
  source 1..24: mol_type = other DNA
gttttgtcagcattgcatttggtt

SEQ ID NO: 8861 - DNA, 24 bp, synthetic construct
  misc_feature 1..24: note = Synthetic Construct
  source 1..24: mol_type = other DNA
gactcaactcaaagcaaccaagga

SEQ ID NO: 8862 - DNA, 26 bp, synthetic construct
  misc_feature 1..26: note = Synthetic Construct
  source 1..26: mol_type = other DNA
gagccaggattttagattgagcaatc

SEQ ID NO: 8863 - DNA, 27 bp, synthetic construct
  misc_feature 1..27: note = Synthetic Construct
  source 1..27: mol_type = other DNA
ccaagtacctgatattgctccctcttt

SEQ ID NO: 8864 - DNA, 23 bp, synthetic construct
  misc_feature 1..23: note = Synthetic Construct
  source 1..23: mol_type = other DNA
tttggtgctgaaaccaggtatga

SEQ ID NO: 8865 - DNA, 27 bp, synthetic construct
  misc_feature 1..27: note = Synthetic Construct
  source 1..27: mol_type = other DNA
gagtgtaaacatactgggactaagtca

SEQ ID NO: 8866 - DNA, 25 bp, synthetic construct
  misc_feature 1..25: note = Synthetic Construct
  source 1..25: mol_type = other DNA
ctgattcagtctgtgcaaaccatag

SEQ ID NO: 8867 - DNA, 23 bp, synthetic construct
  misc_feature 1..23: note = Synthetic Construct
  source 1..23: mol_type = other DNA
cagttcaaactgtgttggctgaa

SEQ ID NO: 8868 - DNA, 22 bp, synthetic construct
  misc_feature 1..22: note = Synthetic Construct
  source 1..22: mol_type = other DNA
tgctgcagggtggtagagtgta

SEQ ID NO: 8869 - DNA, 25 bp, synthetic construct
  misc_feature 1..25: note = Synthetic Construct
  source 1..25: mol_type = other DNA
tgtcaagactgtttgttgggaaaag

SEQ ID NO: 8870 - DNA, 22 bp, synthetic construct
  misc_feature 1..22: note = Synthetic Construct
  source 1..22: mol_type = other DNA
gagacaccagcagtgatacaca

SEQ ID NO: 8871 - DNA, 23 bp, synthetic construct
  misc_feature 1..23: note = Synthetic Construct
  source 1..23: mol_type = other DNA
tgctgatcttccagtctgttcag

SEQ ID NO: 8872 - DNA, 25 bp, synthetic construct
  misc_feature 1..25: note = Synthetic Construct
  source 1..25: mol_type = other DNA
ccctgatcaagtcctgactattctg

SEQ ID NO: 8873 - DNA, 24 bp, synthetic construct
  misc_feature 1..24: note = Synthetic Construct
  source 1..24: mol_type = other DNA
agtggtccccagaaggtaatactc

SEQ ID NO: 8874 - DNA, 30 bp, synthetic construct
  misc_feature 1..30: note = Synthetic Construct
  source 1..30: mol_type = other DNA
gacaggaaaggttctaagaagagaaagaag

SEQ ID NO: 8875 - DNA, 22 bp, synthetic construct
  misc_feature 1..22: note = Synthetic Construct
  source 1..22: mol_type = other DNA
aagagaccaggaggaccactag

SEQ ID NO: 8876 - DNA, 19 bp, synthetic construct
  misc_feature 1..19: note = Synthetic Construct
  source 1..19: mol_type = other DNA
aggtcccaaggtgctctga

SEQ ID NO: 8877 - DNA, 26 bp, synthetic construct
  misc_feature 1..26: note = Synthetic Construct
  source 1..26: mol_type = other DNA
cctaccgactgtgctatgaggataag

SEQ ID NO: 8878 - DNA, 27 bp, synthetic construct
  misc_feature 1..27: note = Synthetic Construct
  source 1..27: mol_type = other DNA
ccaaaaaaaggggcacaatatctagtg

SEQ ID NO: 8879 - DNA, 26 bp, synthetic construct
  misc_feature 1..26: note = Synthetic Construct
  source 1..26: mol_type = other DNA
cctcacagcattctgaacaactatgg

SEQ ID NO: 8880 - DNA, 24 bp, synthetic construct
  misc_feature 1..24: note = Synthetic Construct
  source 1..24: mol_type = other DNA
tgtgtttttgtggtagtgggtgtt

SEQ ID NO: 8881 - DNA, 22 bp, synthetic construct
  misc_feature 1..22: note = Synthetic Construct
  source 1..22: mol_type = other DNA
gccctgcagttggatgtcatat

SEQ ID NO: 8882 - DNA, 25 bp, synthetic construct
  misc_feature 1..25: note = Synthetic Construct
  source 1..25: mol_type = other DNA
aaataggcagagaatgaagctacca

SEQ ID NO: 8883 - DNA, 26 bp, synthetic construct
  misc_feature 1..26: note = Synthetic Construct
  source 1..26: mol_type = other DNA
gggaagtggtaatcctatgccttatt

SEQ ID NO: 8884 - DNA, 27 bp, synthetic construct
  misc_feature 1..27: note = Synthetic Construct
  source 1..27: mol_type = other DNA
acgcaccttaattagttcgtagttttg

SEQ ID NO: 8885 - DNA, 24 bp, synthetic construct
  misc_feature 1..24: note = Synthetic Construct
  source 1..24: mol_type = other DNA
cagcaaaaggtgtttccagaaaga

SEQ ID NO: 8886 - DNA, 26 bp, synthetic construct
  misc_feature 1..26: note = Synthetic Construct
  source 1..26: mol_type = other DNA
ggtaagaaaccagatttgggaaaagg

SEQ ID NO: 8887 - DNA, 22 bp, synthetic construct
  misc_feature 1..22: note = Synthetic Construct
  source 1..22: mol_type = other DNA
tggaagttttgtcccagcaagt

SEQ ID NO: 8888 - DNA, 24 bp, synthetic construct
  misc_feature 1..24: note = Synthetic Construct
  source 1..24: mol_type = other DNA
gccctttcaaatacctggaaagca

SEQ ID NO: 8889 - DNA, 24 bp, synthetic construct
  misc_feature 1..24: note = Synthetic Construct
  source 1..24: mol_type = other DNA
ggaaggggcatggtcatactcata

SEQ ID NO: 8890 - DNA, 30 bp, synthetic construct
  misc_feature 1..30: note = Synthetic Construct
  source 1..30: mol_type = other DNA
gcttacaagagccagataatttagtttgag

SEQ ID NO: 8891 - DNA, 22 bp, synthetic construct
  misc_feature 1..22: note = Synthetic Construct
  source 1..22: mol_type = other DNA
gggagaatcctctgggtttgtg

SEQ ID NO: 8892 - DNA, 23 bp, synthetic construct
  misc_feature 1..23: note = Synthetic Construct
  source 1..23: mol_type = other DNA
acggtgatcccagtctctttaac

SEQ ID NO: 8893 - DNA, 29 bp, synthetic construct
  misc_feature 1..29: note = Synthetic Construct
  source 1..29: mol_type = other DNA
ttcgacatatgttaaaaaggggtttcttt

SEQ ID NO: 8894 - DNA, 28 bp, synthetic construct
  misc_feature 1..28: note = Synthetic Construct
  source 1..28: mol_type = other DNA
gtcagagcttattggagaagaaactcat

SEQ ID NO: 8895 - DNA, 25 bp, synthetic construct
  misc_feature 1..25: note = Synthetic Construct
  source 1..25: mol_type = other DNA
gagaatctgtgcactttgggaagaa

SEQ ID NO: 8896 - DNA, 20 bp, synthetic construct
  misc_feature 1..20: note = Synthetic Construct
  source 1..20: mol_type = other DNA
aacaacaggcctgcccagaa

SEQ ID NO: 8897 - DNA, 25 bp, synthetic construct
  misc_feature 1..25: note = Synthetic Construct
  source 1..25: mol_type = other DNA
caggtatttgatggcaccaattcat

SEQ ID NO: 8898 - DNA, 23 bp, synthetic construct
  misc_feature 1..23: note = Synthetic Construct
  source 1..23: mol_type = other DNA
acatgctttcaagagcctcagat

SEQ ID NO: 8899 - DNA, 24 bp, synthetic construct
  misc_feature 1..24: note = Synthetic Construct
  source 1..24: mol_type = other DNA
cagtcctccttctaactgcattcc

SEQ ID NO: 8900 - DNA, 27 bp, synthetic construct
  misc_feature 1..27: note = Synthetic Construct
  source 1..27: mol_type = other DNA
gcaagccaaaaatgaaagagtgaatcc

SEQ ID NO: 8901 - DNA, 25 bp, synthetic construct
  misc_feature 1..25: note = Synthetic Construct
  source 1..25: mol_type = other DNA
tgcactctttttcccagttgaaaaa

SEQ ID NO: 8902 - DNA, 24 bp, synthetic construct
  misc_feature 1..24: note = Synthetic Construct
  source 1..24: mol_type = other DNA
gcccagacactgatgaatgtccat

SEQ ID NO: 8903 - DNA, 26 bp, synthetic construct
  misc_feature 1..26: note = Synthetic Construct
  source 1..26: mol_type = other DNA
tcctaccaatgtcatctcatctccta

SEQ ID NO: 8904 - DNA, 29 bp, synthetic construct
  misc_feature 1..29: note = Synthetic Construct
  source 1..29: mol_type = other DNA
tgatgttatcaagtcattcattccaagtg

SEQ ID NO: 8905 - DNA, 23 bp, synthetic construct
  misc_feature 1..23: note = Synthetic Construct
  source 1..23: mol_type = other DNA
attcctcttggttgagggacaag

SEQ ID NO: 8906 - DNA, 30 bp, synthetic construct
  misc_feature 1..30: note = Synthetic Construct
  source 1..30: mol_type = other DNA
cccagagacatattctatagaggagatgag

SEQ ID NO: 8907 - DNA, 24 bp, synthetic construct
  misc_feature 1..24: note = Synthetic Construct
  source 1..24: mol_type = other DNA
ggctggagtgagggtttttagagt

SEQ ID NO: 8908 - DNA, 26 bp, synthetic construct
  misc_feature 1..26: note = Synthetic Construct
  source 1..26: mol_type = other DNA
agtactctgcatgatcattgaaaggt

SEQ ID NO: 8909 - DNA, 30 bp, synthetic construct
  misc_feature 1..30: note = Synthetic Construct
  source 1..30: mol_type = other DNA
ctgattagtggtgcagttttagaatacatc

SEQ ID NO: 8910 - DNA, 28 bp, synthetic construct
  misc_feature 1..28: note = Synthetic Construct
  source 1..28: mol_type = other DNA
agggattcaacaattaatcaaacatggt

SEQ ID NO: 8911 - DNA, 23 bp, synthetic construct
  misc_feature 1..23: note = Synthetic Construct
  source 1..23: mol_type = other DNA
ctgaaacctcagtgcaaactgtt

SEQ ID NO: 8912 - DNA, 24 bp, synthetic construct
  misc_feature 1..24: note = Synthetic Construct
  source 1..24: mol_type = other DNA
gcagggacacatgacctattgaga

SEQ ID NO: 8913 - DNA, 29 bp, synthetic construct
  misc_feature 1..29: note = Synthetic Construct
  source 1..29: mol_type = other DNA
ggtctggatatgtcgatagtaagaaagca

SEQ ID NO: 8914 - DNA, 22 bp, synthetic construct
  misc_feature 1..22: note = Synthetic Construct
  source 1..22: mol_type = other DNA
gcagaaagagcaaagccatagc

SEQ ID NO: 8915 - DNA, 25 bp, synthetic construct
  misc_feature 1..25: note = Synthetic Construct
  source 1..25: mol_type = other DNA
ggtgactcctaaattgccagacatg

SEQ ID NO: 8916 - DNA, 27 bp, synthetic construct
  misc_feature 1..27: note = Synthetic Construct
  source 1..27: mol_type = other DNA
ccctgggttaaattttctggcttacac

SEQ ID NO: 8917 - DNA, 22 bp, synthetic construct
  misc_feature 1..22: note = Synthetic Construct
  source 1..22: mol_type = other DNA
acctcaaccccttgtgagacaa

SEQ ID NO: 8918 - DNA, 27 bp, synthetic construct
  misc_feature 1..27: note = Synthetic Construct
  source 1..27: mol_type = other DNA
gcctcatgctcgctgaaagtatttttg

SEQ ID NO: 8919 - DNA, 24 bp, synthetic construct
  misc_feature 1..24: note = Synthetic Construct
  source 1..24: mol_type = other DNA
tggttggatggtcagagatttgaa

SEQ ID NO: 8920 - DNA, 20 bp, synthetic construct
  misc_feature 1..20: note = Synthetic Construct
  source 1..20: mol_type = other DNA
tgtgcctaagcctggaactg

SEQ ID NO: 8921 - DNA, 25 bp, synthetic construct
  misc_feature 1..25: note = Synthetic Construct
  source 1..25: mol_type = other DNA
ggctctggtttctatgaaccacctt

SEQ ID NO: 8922 - DNA, 21 bp, synthetic construct
  misc_feature 1..21: note = Synthetic Construct
  source 1..21: mol_type = other DNA
tgacagcagcatgggaaatcc

SEQ ID NO: 8923 - DNA, 23 bp, synthetic construct
  misc_feature 1..23: note = Synthetic Construct
  source 1..23: mol_type = other DNA
gtggcctagacagctcttaaagt

SEQ ID NO: 8924 - DNA, 22 bp, synthetic construct
  misc_feature 1..22: note = Synthetic Construct
  source 1..22: mol_type = other DNA
tggcggaaagtgtttagctgaa

SEQ ID NO: 8925 - DNA, 26 bp, synthetic construct
  misc_feature 1..26: note = Synthetic Construct
  source 1..26: mol_type = other DNA
tgcaatcatgtcttcatttgtttcca

SEQ ID NO: 8926 - DNA, 24 bp, synthetic construct
  misc_feature 1..24: note = Synthetic Construct
  source 1..24: mol_type = other DNA
gtgatgccctttatcagcaagaca

SEQ ID NO: 8927 - DNA, 21 bp, synthetic construct
  misc_feature 1..21: note = Synthetic Construct
  source 1..21: mol_type = other DNA
aggggcggagagacacaatga

SEQ ID NO: 8928 - DNA, 30 bp, synthetic construct
  misc_feature 1..30: note = Synthetic Construct
  source 1..30: mol_type = other DNA
caagtattattttacctcccagacatcaga

SEQ ID NO: 8929 - DNA, 25 bp, synthetic construct
  misc_feature 1..25: note = Synthetic Construct
  source 1..25: mol_type = other DNA
ggcagagattctgagccttatttgt

SEQ ID NO: 8930 - DNA, 27 bp, synthetic construct
  misc_feature 1..27: note = Synthetic Construct
  source 1..27: mol_type = other DNA
agctcttttcacatgcaatagtgtatc

SEQ ID NO: 8931 - DNA, 29 bp, synthetic construct
  misc_feature 1..29: note = Synthetic Construct
  source 1..29: mol_type = other DNA
tgaacatatgaaaaccatctgagtcaaga

SEQ ID NO: 8932 - DNA, 22 bp, synthetic construct
  misc_feature 1..22: note = Synthetic Construct
  source 1..22: mol_type = other DNA
tgctctcacagctgaggaaatc

SEQ ID NO: 8933 - DNA, 26 bp, synthetic construct
  misc_feature 1..26: note = Synthetic Construct
  source 1..26: mol_type = other DNA
aattatatggaggctgcactattcca

SEQ ID NO: 8934 - DNA, 23 bp, synthetic construct
  misc_feature 1..23: note = Synthetic Construct
  source 1..23: mol_type = other DNA
accaggaaaaaagacaccccaaa

SEQ ID NO: 8935 - DNA, 25 bp, synthetic construct
  misc_feature 1..25: note = Synthetic Construct
  source 1..25: mol_type = other DNA
ggtctttggtctctcctagtcattt

SEQ ID NO: 8936 - DNA, 30 bp, synthetic construct
  misc_feature 1..30: note = Synthetic Construct
  source 1..30: mol_type = other DNA
aatctatttcacaacttgagagttttccaa

SEQ ID NO: 8937 - DNA, 24 bp, synthetic construct
  misc_feature 1..24: note = Synthetic Construct
  source 1..24: mol_type = other DNA
tgcctctaccactgctatgattca

SEQ ID NO: 8938 - DNA, 28 bp, synthetic construct
  misc_feature 1..28: note = Synthetic Construct
  source 1..28: mol_type = other DNA
tcagcagtttgataaaaatcaggtccta

SEQ ID NO: 8939 - DNA, 28 bp, synthetic construct
  misc_feature 1..28: note = Synthetic Construct
  source 1..28: mol_type = other DNA
cctgatcaattccacctgctttaaatag

SEQ ID NO: 8940 - DNA, 22 bp, synthetic construct
  misc_feature 1..22: note = Synthetic Construct
  source 1..22: mol_type = other DNA
agtctgacctccctgcttaacc

SEQ ID NO: 8941 - DNA, 21 bp, synthetic construct
  misc_feature 1..21: note = Synthetic Construct
  source 1..21: mol_type = other DNA
aggaggcccctttctgtgtta

SEQ ID NO: 8942 - DNA, 29 bp, synthetic construct
  misc_feature 1..29: note = Synthetic Construct
  source 1..29: mol_type = other DNA
cccttaatatcttcacttaacccctacat

SEQ ID NO: 8943 - DNA, 22 bp, synthetic construct
  misc_feature 1..22: note = Synthetic Construct
  source 1..22: mol_type = other DNA
agcttctgcaaaaccccattcc

SEQ ID NO: 8944 - DNA, 23 bp, synthetic construct
  misc_feature 1..23: note = Synthetic Construct
  source 1..23: mol_type = other DNA
agggaaggctaccagctctatga

SEQ ID NO: 8945 - DNA, 25 bp, synthetic construct
  misc_feature 1..25: note = Synthetic Construct
  source 1..25: mol_type = other DNA
gacataatctgaaccagcaggtagt

SEQ ID NO: 8946 - DNA, 25 bp, synthetic construct
  misc_feature 1..25: note = Synthetic Construct
  source 1..25: mol_type = other DNA
gcagttacaactcaggtgtctacca

SEQ ID NO: 8947 - DNA, 25 bp, synthetic construct
  misc_feature 1..25: note = Synthetic Construct
  source 1..25: mol_type = other DNA
tcctttgacacaagaagatgaggtt

SEQ ID NO: 8948 - DNA, 25 bp, synthetic construct
  misc_feature 1..25: note = Synthetic Construct
  source 1..25: mol_type = other DNA
tgttctttcttgccttgttccttga

SEQ ID NO: 8949 - DNA, 25 bp, synthetic construct
  misc_feature 1..25: note = Synthetic Construct
  source 1..25: mol_type = other DNA
gtccagtctgccatcaaaaagaact

SEQ ID NO: 8950 - DNA, 22 bp, synthetic construct
  misc_feature 1..22: note = Synthetic Construct
  source 1..22: mol_type = other DNA
gacaggcaatgtgatgcttcca

SEQ ID NO: 8951 - DNA, 26 bp, synthetic construct
  misc_feature 1..26: note = Synthetic Construct
  source 1..26: mol_type = other DNA
tggtgtcttttgagtccattttcttg

SEQ ID NO: 8952 - DNA, 19 bp, synthetic construct
  misc_feature 1..19: note = Synthetic Construct
  source 1..19: mol_type = other DNA
tggcccactgtgacagctt

SEQ ID NO: 8953 - DNA, 26 bp, synthetic construct
  misc_feature 1..26: note = Synthetic Construct
  source 1..26: mol_type = other DNA
ctgttgcctaaatccctttctacatc

SEQ ID NO: 8954 - DNA, 26 bp, synthetic construct
  misc_feature 1..26: note = Synthetic Construct
  source 1..26: mol_type = other DNA
acatttgccttcaggaagatccttag

SEQ ID NO: 8955 - DNA, 28 bp, synthetic construct
  misc_feature 1..28: note = Synthetic Construct
  source 1..28: mol_type = other DNA
acaagtggatttctatgtgactctatca

SEQ ID NO: 8956 - DNA, 20 bp, synthetic construct
  misc_feature 1..20: note = Synthetic Construct
  source 1..20: mol_type = other DNA
tggcctcaaacgcacactgt

SEQ ID NO: 8957 - DNA, 24 bp, synthetic construct
  misc_feature 1..24: note = Synthetic Construct
  source 1..24: mol_type = other DNA
cggtgatcctgtacatggctaatc

SEQ ID NO: 8958 - DNA, 20 bp, synthetic construct
  misc_feature 1..20: note = Synthetic Construct
  source 1..20: mol_type = other DNA
gccccatggagaggcctata

SEQ ID NO: 8959 - DNA, 26 bp, synthetic construct
  misc_feature 1..26: note = Synthetic Construct
  source 1..26: mol_type = other DNA
caagtaaggtttaagccagtgatcag

SEQ ID NO: 8960 - DNA, 23 bp, synthetic construct
  misc_feature 1..23: note = Synthetic Construct
  source 1..23: mol_type = other DNA
gcaggaatgttcaatcgcttcct

SEQ ID NO: 8961 - DNA, 26 bp, synthetic construct
  misc_feature 1..26: note = Synthetic Construct
  source 1..26: mol_type = other DNA
gctttgttacccatatggtctagttg

SEQ ID NO: 8962 - DNA, 29 bp, synthetic construct
  misc_feature 1..29: note = Synthetic Construct
  source 1..29: mol_type = other DNA
cagtatttcaagtgactgcagttatacag

SEQ ID NO: 8963 - DNA, 22 bp, synthetic construct
  misc_feature 1..22: note = Synthetic Construct
  source 1..22: mol_type = other DNA
tgtagccatgactgaggcctat

SEQ ID NO: 8964 - DNA, 28 bp, synthetic construct
  misc_feature 1..28: note = Synthetic Construct
  source 1..28: mol_type = other DNA
actgattactgaatactggccttaatct

SEQ ID NO: 8965 - DNA, 26 bp, synthetic construct
  misc_feature 1..26: note = Synthetic Construct
  source 1..26: mol_type = other DNA
aggaagggatatgaaacatggcttaa

SEQ ID NO: 8966 - DNA, 22 bp, synthetic construct
  misc_feature 1..22: note = Synthetic Construct
  source 1..22: mol_type = other DNA
cagggttccaatatggccaaca

SEQ ID NO: 8967 - DNA, 26 bp, synthetic construct
  misc_feature 1..26: note = Synthetic Construct
  source 1..26: mol_type = other DNA
ccaacatatggtttcagaagcacaaa

SEQ ID NO: 8968 - DNA, 20 bp, synthetic construct
  misc_feature 1..20: note = Synthetic Construct
  source 1..20: mol_type = other DNA
acatgttggtgggcacagaa

SEQ ID NO: 8969 - DNA, 20 bp, synthetic construct
  misc_feature 1..20: note = Synthetic Construct
  source 1..20: mol_type = other DNA
ccctggccatcaaggagcta

SEQ ID NO: 8970 - DNA, 28 bp, synthetic construct
  misc_feature 1..28: note = Synthetic Construct
  source 1..28: mol_type = other DNA
ggatattggcctgtagttttctctcctt

SEQ ID NO: 8971 - DNA, 28 bp, synthetic construct
  misc_feature 1..28: note = Synthetic Construct
  source 1..28: mol_type = other DNA
gcaattgctggaccatataatgagacaa

SEQ ID NO: 8972 - DNA, 27 bp, synthetic construct
  misc_feature 1..27: note = Synthetic Construct
  source 1..27: mol_type = other DNA
ggcagagtgatcattgattgataacca

SEQ ID NO: 8973 - DNA, 20 bp, synthetic construct
  misc_feature 1..20: note = Synthetic Construct
  source 1..20: mol_type = other DNA
cctctgctgagctcctgtgt

SEQ ID NO: 8974 - DNA, 20 bp, synthetic construct
  misc_feature 1..20: note = Synthetic Construct
  source 1..20: mol_type = other DNA
gcctccaccaccactacaca

SEQ ID NO: 8975 - DNA, 27 bp, synthetic construct
  misc_feature 1..27: note = Synthetic Construct
  source 1..27: mol_type = other DNA
gtggaggaaattagatgtctgcttctg

SEQ ID NO: 8976 - DNA, 26 bp, synthetic construct
  misc_feature 1..26: note = Synthetic Construct
  source 1..26: mol_type = other DNA
gacacacacaaaaggaactgtcagat

SEQ ID NO: 8977 - DNA, 20 bp, synthetic construct
  misc_feature 1..20: note = Synthetic Construct
  source 1..20: mol_type = other DNA
agggcctgctgactcgttct

SEQ ID NO: 8978 - DNA, 22 bp, synthetic construct
  misc_feature 1..22: note = Synthetic Construct
  source 1..22: mol_type = other DNA
agttctgtcccaatcccacaca

SEQ ID NO: 8979 - DNA, 23 bp, synthetic construct
  misc_feature 1..23: note = Synthetic Construct
  source 1..23: mol_type = other DNA
gcttgaaagaagggcaaggaaac

SEQ ID NO: 8980 - DNA, 19 bp, synthetic construct
  misc_feature 1..19: note = Synthetic Construct
  source 1..19: mol_type = other DNA
tccccactcctggcccttt

SEQ ID NO: 8981 - DNA, 24 bp, synthetic construct
  misc_feature 1..24: note = Synthetic Construct
  source 1..24: mol_type = other DNA
actgggatttgactctggaacttg

SEQ ID NO: 8982 - DNA, 22 bp, synthetic construct
  misc_feature 1..22: note = Synthetic Construct
  source 1..22: mol_type = other DNA
cagctagagcaaccacgatgaa

SEQ ID NO: 8983 - DNA, 23 bp, synthetic construct
  misc_feature 1..23: note = Synthetic Construct
  source 1..23: mol_type = other DNA
gcctgaaaggtaggttgcaaacc

SEQ ID NO: 8984 - DNA, 24 bp, synthetic construct
  misc_feature 1..24: note = Synthetic Construct
  source 1..24: mol_type = other DNA
agagtgataaaccaagcaccaaca

SEQ ID NO: 8985 - DNA, 22 bp, synthetic construct
  misc_feature 1..22: note = Synthetic Construct
  source 1..22: mol_type = other DNA
acagcccttgtgtgcataaagg

SEQ ID NO: 8986 - DNA, 22 bp, synthetic construct
  misc_feature 1..22: note = Synthetic Construct
  source 1..22: mol_type = other DNA
tctgcaccagtctcaggtcttc

SEQ ID NO: 8987 - DNA, 21 bp, synthetic construct
  misc_feature 1..21: note = Synthetic Construct
  source 1..21: mol_type = other DNA
tttgcagaaagggctcaaacg

SEQ ID NO: 8988 - DNA, 18 bp, synthetic construct
  misc_feature 1..18: note = Synthetic Construct
  source 1..18: mol_type = other DNA
gccaggcagcctcatggt

SEQ ID NO: 8989 - DNA, 19 bp, synthetic construct
  misc_feature 1..19: note = Synthetic Construct
  source 1..19: mol_type = other DNA
tgcctccaagccacagaac

SEQ ID NO: 8990 - DNA, 19 bp, synthetic construct
  misc_feature 1..19: note = Synthetic Construct
  source 1..19: mol_type = other DNA
ggtaccaggggcagaaggt

SEQ ID NO: 8991 - DNA, 22 bp, synthetic construct
  misc_feature 1..22: note = Synthetic Construct
  source 1..22: mol_type = other DNA
aaagcccaagctcctcaacaag

SEQ ID NO: 8992 - DNA, 26 bp, synthetic construct
  misc_feature 1..26: note = Synthetic Construct
  source 1..26: mol_type = other DNA
tgaaaacctaaacccttcatcaacct

SEQ ID NO: 8993 - DNA, 21 bp, synthetic construct
  misc_feature 1..21: note = Synthetic Construct
  source 1..21: mol_type = other DNA
aagcccagagtagtgcatgca

SEQ ID NO: 8994 - DNA, 29 bp, synthetic construct
  misc_feature 1..29: note = Synthetic Construct
  source 1..29: mol_type = other DNA
gttgacaaagtctagataacaaggagtca

SEQ ID NO: 8995 - DNA, 23 bp, synthetic construct
  misc_feature 1..23: note = Synthetic Construct
  source 1..23: mol_type = other DNA
tcagtggcttctgcagaataaca

SEQ ID NO: 8996 - DNA, 28 bp, synthetic construct
  misc_feature 1..28: note = Synthetic Construct
  source 1..28: mol_type = other DNA
ggagtcagacacaaataaatgggttcag

SEQ ID NO: 8997 - DNA, 21 bp, synthetic construct
  misc_feature 1..21: note = Synthetic Construct
  source 1..21: mol_type = other DNA
ggctgggaaactgctatgcat

SEQ ID NO: 8998 - DNA, 26 bp, synthetic construct
  misc_feature 1..26: note = Synthetic Construct
  source 1..26: mol_type = other DNA
cagatacatggaggtgaaagttgtgt

SEQ ID NO: 8999 - DNA, 24 bp, synthetic construct
  misc_feature 1..24: note = Synthetic Construct
  source 1..24: mol_type = other DNA
cactgtgtatgactccccttaagg

SEQ ID NO: 9000 - DNA, 26 bp, synthetic construct
  misc_feature 1..26: note = Synthetic Construct
  source 1..26: mol_type = other DNA
gctccaaaataactagcagcatgatg

SEQ ID NO: 9001 - DNA, 26 bp, synthetic construct
  misc_feature 1..26: note = Synthetic Construct
  source 1..26: mol_type = other DNA
acaagactacaaagaggcattgaact

SEQ ID NO: 9002 - DNA, 22 bp, synthetic construct
  misc_feature 1..22: note = Synthetic Construct
  source 1..22: mol_type = other DNA
aatgtgaggatggcaggcattg

SEQ ID NO: 9003 - DNA, 25 bp, synthetic construct
  misc_feature 1..25: note = Synthetic Construct
  source 1..25: mol_type = other DNA
ggctgaaactaaaaatggcccagtt

SEQ ID NO: 9004 - DNA, 22 bp, synthetic construct
  misc_feature 1..22: note = Synthetic Construct
  source 1..22: mol_type = other DNA
aggtcagggatgacaacaatcc

SEQ ID NO: 9005 - DNA, 19 bp, synthetic construct
  misc_feature 1..19: note = Synthetic Construct
  source 1..19: mol_type = other DNA
tgcctggcacacatgatgt

SEQ ID NO: 9006 - DNA, 22 bp, synthetic construct
  misc_feature 1..22: note = Synthetic Construct
  source 1..22: mol_type = other DNA
tgttcccatctcttgccatctc

SEQ ID NO: 9007 - DNA, 19 bp, synthetic construct
  misc_feature 1..19: note = Synthetic Construct
  source 1..19: mol_type = other DNA
tgccagggtgggacagaca

SEQ ID NO: 9008 - DNA, 28 bp, synthetic construct
  misc_feature 1..28: note = Synthetic Construct
  source 1..28: mol_type = other DNA
ctggtgaaccacaaacaattaaatgttt

SEQ ID NO: 9009 - DNA, 27 bp, synthetic construct
  misc_feature 1..27: note = Synthetic Construct
  source 1..27: mol_type = other DNA
ggttgcctgagagctatacagaattgt

SEQ ID NO: 9010 - DNA, 19 bp, synthetic construct
  misc_feature 1..19: note = Synthetic Construct
  source 1..19: mol_type = other DNA
aggcacccgcagtgattcc

SEQ ID NO: 9011 - DNA, 21 bp, synthetic construct
  misc_feature 1..21: note = Synthetic Construct
  source 1..21: mol_type = other DNA
actggcagcaaaactcaacct

SEQ ID NO: 9012 - DNA, 23 bp, synthetic construct
  misc_feature 1..23: note = Synthetic Construct
  source 1..23: mol_type = other DNA
tcctctaccctggaggcagtaaa

SEQ ID NO: 9013 - DNA, 18 bp, synthetic construct
  misc_feature 1..18: note = Synthetic Construct
  source 1..18: mol_type = other DNA
gctgcaaggcccaactgt

SEQ ID NO: 9014 - DNA, 27 bp, synthetic construct
  misc_feature 1..27: note = Synthetic Construct
  source 1..27: mol_type = other DNA
gaggactgacaggagatgttagtaaga

SEQ ID NO: 9015 - DNA, 25 bp, synthetic construct
  misc_feature 1..25: note = Synthetic Construct
  source 1..25: mol_type = other DNA
agtacgtattcaacaggctaccatt

SEQ ID NO: 9016 - DNA, 22 bp, synthetic construct
  misc_feature 1..22: note = Synthetic Construct
  source 1..22: mol_type = other DNA
actggaggcattttcacacctt

SEQ ID NO: 9017 - DNA, 20 bp, synthetic construct
  misc_feature 1..20: note = Synthetic Construct
  source 1..20: mol_type = other DNA
tgtgctagcgtacccaatgg

SEQ ID NO: 9018 - DNA, 24 bp, synthetic construct
  misc_feature 1..24: note = Synthetic Construct
  source 1..24: mol_type = other DNA
ggagaggaccacacaaagaaatgt

SEQ ID NO: 9019 - DNA, 21 bp, synthetic construct
  misc_feature 1..21: note = Synthetic Construct
  source 1..21: mol_type = other DNA
cctaaagtgggtgggctactg

SEQ ID NO: 9020 - DNA, 27 bp, synthetic construct
  misc_feature 1..27: note = Synthetic Construct
  source 1..27: mol_type = other DNA
tgtctcagataatgtcacggttaagtt

SEQ ID NO: 9021 - DNA, 23 bp, synthetic construct
  misc_feature 1..23: note = Synthetic Construct
  source 1..23: mol_type = other DNA
agacccctggtttcatagagctt

SEQ ID NO: 9022 - DNA, 19 bp, synthetic construct
  misc_feature 1..19: note = Synthetic Construct
  source 1..19: mol_type = other DNA
agcacacaggcaggaaggt

SEQ ID NO: 9023 - DNA, 21 bp, synthetic construct
  misc_feature 1..21: note = Synthetic Construct
  source 1..21: mol_type = other DNA
aaccaccctgggagtaggaat

SEQ ID NO: 9024 - DNA, 20 bp, synthetic construct
  misc_feature 1..20: note = Synthetic Construct
  source 1..20: mol_type = other DNA
catgagtccgaggccaccta

SEQ ID NO: 9025 - DNA, 18 bp, synthetic construct
  misc_feature 1..18: note = Synthetic Construct
  source 1..18: mol_type = other DNA
aggggttgggtgccagtt

SEQ ID NO: 9026 - DNA, 18 bp, synthetic construct
  misc_feature 1..18: note = Synthetic Construct
  source 1..18: mol_type = other DNA
tgatggccccagctgtct

SEQ ID NO: 9027 - DNA, 18 bp, synthetic construct
  misc_feature 1..18: note = Synthetic Construct
  source 1..18: mol_type = other DNA
gccccaggtgtgctcagt

SEQ ID NO: 9028 - DNA, 18 bp, synthetic construct
  misc_feature 1..18: note = Synthetic Construct
  source 1..18: mol_type = other DNA
gtggaggcctcgggagat

SEQ ID NO: 9029 - DNA, 24 bp, synthetic construct
  misc_feature 1..24: note = Synthetic Construct
  source 1..24: mol_type = other DNA
actcgagatggaaccacttatcca

SEQ ID NO: 9030 - DNA, 20 bp, synthetic construct
  misc_feature 1..20: note = Synthetic Construct
  source 1..20: mol_type = other DNA
ttggtgtgactgccgctttt

SEQ ID NO: 9031 - DNA, 30 bp, synthetic construct
  misc_feature 1..30: note = Synthetic Construct
  source 1..30: mol_type = other DNA
cagactttaagaatggaaagctacattcaa

SEQ ID NO: 9032 - DNA, 21 bp, synthetic construct
  misc_feature 1..21: note = Synthetic Construct
  source 1..21: mol_type = other DNA
aaccggggtgtccttggaatt

SEQ ID NO: 9033 - DNA, 24 bp, synthetic construct
  misc_feature 1..24: note = Synthetic Construct
  source 1..24: mol_type = other DNA
ccacacttgccccaacttgataag

SEQ ID NO: 9034 - DNA, 25 bp, synthetic construct
  misc_feature 1..25: note = Synthetic Construct
  source 1..25: mol_type = other DNA
gcagttgtagataccgagtgggttt

SEQ ID NO: 9035 - DNA, 23 bp, synthetic construct
  misc_feature 1..23: note = Synthetic Construct
  source 1..23: mol_type = other DNA
ccaagatgtttccccatccatca

SEQ ID NO: 9036 - DNA, 21 bp, synthetic construct
  misc_feature 1..21: note = Synthetic Construct
  source 1..21: mol_type = other DNA
tcacctgctcccttcctttct

SEQ ID NO: 9037 - DNA, 19 bp, synthetic construct
  misc_feature 1..19: note = Synthetic Construct
  source 1..19: mol_type = other DNA
ggctgcaggctatgaacca

SEQ ID NO: 9038 - DNA, 26 bp, synthetic construct
  misc_feature 1..26: note = Synthetic Construct
  source 1..26: mol_type = other DNA
agtcctgaaagacaaactaccaacat

SEQ ID NO: 9039 - DNA, 29 bp, synthetic construct
  misc_feature 1..29: note = Synthetic Construct
  source 1..29: mol_type = other DNA
caagtgttcagtgtgaatttaaggaaatc

SEQ ID NO: 9040 - DNA, 25 bp, synthetic construct
  misc_feature 1..25: note = Synthetic Construct
  source 1..25: mol_type = other DNA
gcacattcaagatcagagcaaagat

SEQ ID NO: 9041 - DNA, 24 bp, synthetic construct
  misc_feature 1..24: note = Synthetic Construct
  source 1..24: mol_type = other DNA
ttgtcctcagaccactctcttttg

SEQ ID NO: 9042 - DNA, 22 bp, synthetic construct
  misc_feature 1..22: note = Synthetic Construct
  source 1..22: mol_type = other DNA
gcccagcccatatctcattgaa

SEQ ID NO: 9043 - DNA, 24 bp, synthetic construct
  misc_feature 1..24: note = Synthetic Construct
  source 1..24: mol_type = other DNA
tgtcacccaccattctaggttagg

SEQ ID NO: 9044 - DNA, 20 bp, synthetic construct
  misc_feature 1..20: note = Synthetic Construct
  source 1..20: mol_type = other DNA
aaggatcccagcacctacca

SEQ ID NO: 9045 - DNA, 27 bp, synthetic construct
  misc_feature 1..27: note = Synthetic Construct
  source 1..27: mol_type = other DNA
cctgatacttccttctagcaacacctt

SEQ ID NO: 9046 - DNA, 27 bp, synthetic construct
  misc_feature 1..27: note = Synthetic Construct
  source 1..27: mol_type = other DNA
gctttttgattcaaactgttcccaagt

SEQ ID NO: 9047 - DNA, 19 bp, synthetic construct
  misc_feature 1..19: note = Synthetic Construct
  source 1..19: mol_type = other DNA
atgcagctcagggcactgt

SEQ ID NO: 9048 - DNA, 22 bp, synthetic construct
  misc_feature 1..22: note = Synthetic Construct
  source 1..22: mol_type = other DNA
ttgctgcccagacttcttagtc

SEQ ID NO: 9049 - DNA, 22 bp, synthetic construct
  misc_feature 1..22: note = Synthetic Construct
  source 1..22: mol_type = other DNA
tgctctgccagagaaagcacaa

SEQ ID NO: 9050 - DNA, 21 bp, synthetic construct
  misc_feature 1..21: note = Synthetic Construct
  source 1..21: mol_type = other DNA
atgtgcctcaacgccctatgg

SEQ ID NO: 9051 - DNA, 19 bp, synthetic construct
  misc_feature 1..19: note = Synthetic Construct
  source 1..19: mol_type = other DNA
aggccctctgtccctagct

SEQ ID NO: 9052 - DNA, 21 bp, synthetic construct
  misc_feature 1..21: note = Synthetic Construct
  source 1..21: mol_type = other DNA
caatctgtcagccaccatgct

SEQ ID NO: 9053 - DNA, 27 bp, synthetic construct
  misc_feature 1..27: note = Synthetic Construct
  source 1..27: mol_type = other DNA
cccctttagcctcatcttatgctactg

SEQ ID NO: 9054 - DNA, 24 bp, synthetic construct
  misc_feature 1..24: note = Synthetic Construct
  source 1..24: mol_type = other DNA
aggtgaggtctgttgggatttcag

SEQ ID NO: 9055 - DNA, 19 bp, synthetic construct
  misc_feature 1..19: note = Synthetic Construct
  source 1..19: mol_type = other DNA
agggagcggaggccacact

SEQ ID NO: 9056 - DNA, 22 bp, synthetic construct
  misc_feature 1..22: note = Synthetic Construct
  source 1..22: mol_type = other DNA
ccacactccccttccattatgg

SEQ ID NO: 9057 - DNA, 23 bp, synthetic construct
  misc_feature 1..23: note = Synthetic Construct
  source 1..23: mol_type = other DNA
tgataaggcagctgagacacaaa

SEQ ID NO: 9058 - DNA, 25 bp, synthetic construct
  misc_feature 1..25: note = Synthetic Construct
  source 1..25: mol_type = other DNA
ccatcccctcaaatcccatttctct

SEQ ID NO: 9059 - DNA, 21 bp, synthetic construct
  misc_feature 1..21: note = Synthetic Construct
  source 1..21: mol_type = other DNA
agctccatgaggccagaaggt

SEQ ID NO: 9060 - DNA, 19 bp, synthetic construct
  misc_feature 1..19: note = Synthetic Construct
  source 1..19: mol_type = other DNA
tgagggccagttgctgttc

SEQ ID NO: 9061 - DNA, 23 bp, synthetic construct
  misc_feature 1..23: note = Synthetic Construct
  source 1..23: mol_type = other DNA
agctgtcctccaatccagactct

SEQ ID NO: 9062 - DNA, 20 bp, synthetic construct
  misc_feature 1..20: note = Synthetic Construct
  source 1..20: mol_type = other DNA
tgcagcagctgaaacaacac

SEQ ID NO: 9063 - DNA, 26 bp, synthetic construct
  misc_feature 1..26: note = Synthetic Construct
  source 1..26: mol_type = other DNA
tgagtgtactgaagcagaagttaact

SEQ ID NO: 9064 - DNA, 26 bp, synthetic construct
  misc_feature 1..26: note = Synthetic Construct
  source 1..26: mol_type = other DNA
ctcaaatggttcagtggttcctttct

SEQ ID NO: 9065 - DNA, 19 bp, synthetic construct
  misc_feature 1..19: note = Synthetic Construct
  source 1..19: mol_type = other DNA
acagccctgcaccaggtaa

SEQ ID NO: 9066 - DNA, 24 bp, synthetic construct
  misc_feature 1..24: note = Synthetic Construct
  source 1..24: mol_type = other DNA
gtgtgtagtaggggtctgtagagt

SEQ ID NO: 9067 - DNA, 20 bp, synthetic construct
  misc_feature 1..20: note = Synthetic Construct
  source 1..20: mol_type = other DNA
agagcagcgaagaggagaga

SEQ ID NO: 9068 - DNA, 23 bp, synthetic construct
  misc_feature 1..23: note = Synthetic Construct
  source 1..23: mol_type = other DNA
cctgactccaaaaccttcactct

SEQ ID NO: 9069 - DNA, 22 bp, synthetic construct
  misc_feature 1..22: note = Synthetic Construct
  source 1..22: mol_type = other DNA
aggctggagtaatgcccaacta

SEQ ID NO: 9070 - DNA, 30 bp, synthetic construct
  misc_feature 1..30: note = Synthetic Construct
  source 1..30: mol_type = other DNA
cagaatacctggctatatttgtaccttgac

SEQ ID NO: 9071 - DNA, 20 bp, synthetic construct
  misc_feature 1..20: note = Synthetic Construct
  source 1..20: mol_type = other DNA
ggcatccaccaggctaggat

SEQ ID NO: 9072 - DNA, 21 bp, synthetic construct
  misc_feature 1..21: note = Synthetic Construct
  source 1..21: mol_type = other DNA
gttgagtttccagcccatcct

SEQ ID NO: 9073 - DNA, 23 bp, synthetic construct
  misc_feature 1..23: note = Synthetic Construct
  source 1..23: mol_type = other DNA
ggggatagaggtttcggctttag

SEQ ID NO: 9074 - DNA, 24 bp, synthetic construct
  misc_feature 1..24: note = Synthetic Construct
  source 1..24: mol_type = other DNA
ggcaccagcaaagagacatctaac

SEQ ID NO: 9075 - DNA, 22 bp, synthetic construct
  misc_feature 1..22: note = Synthetic Construct
  source 1..22: mol_type = other DNA
ccatgaaggaggcttgtgttct

SEQ ID NO: 9076 - DNA, 25 bp, synthetic construct
  misc_feature 1..25: note = Synthetic Construct
  source 1..25: mol_type = other DNA
agttctaaaaactggatgcctgttg

SEQ ID NO: 9077 - DNA, 22 bp, synthetic construct
  misc_feature 1..22: note = Synthetic Construct
  source 1..22: mol_type = other DNA
tgtggtagccctgattcacaga

SEQ ID NO: 9078 - DNA, 30 bp, synthetic construct
  misc_feature 1..30: note = Synthetic Construct
  source 1..30: mol_type = other DNA
cagctattctctctagaccttcctattaca

SEQ ID NO: 9079 - DNA, 24 bp, synthetic construct
  misc_feature 1..24: note = Synthetic Construct
  source 1..24: mol_type = other DNA
caaaattctttggcactccttcca

SEQ ID NO: 9080 - DNA, 27 bp, synthetic construct
  misc_feature 1..27: note = Synthetic Construct
  source 1..27: mol_type = other DNA
ggctgtaatgatagcctttgtgtttac

SEQ ID NO: 9081 - DNA, 28 bp, synthetic construct
  misc_feature 1..28: note = Synthetic Construct
  source 1..28: mol_type = other DNA
gccctagcaatagtctgactatatttcc

SEQ ID NO: 9082 - DNA, 30 bp, synthetic construct
  misc_feature 1..30: note = Synthetic Construct
  source 1..30: mol_type = other DNA
gcctttttcttcttaggaggagatttctca

SEQ ID NO: 9083 - DNA, 22 bp, synthetic construct
  misc_feature 1..22: note = Synthetic Construct
  source 1..22: mol_type = other DNA
ccttccaacctggcagaaatgt

SEQ ID NO: 9084 - DNA, 25 bp, synthetic construct
  misc_feature 1..25: note = Synthetic Construct
  source 1..25: mol_type = other DNA
cccacatcaacctagcaaggattct

SEQ ID NO: 9085 - DNA, 25 bp, synthetic construct
  misc_feature 1..25: note = Synthetic Construct
  source 1..25: mol_type = other DNA
ctcactcacaccactatagcttcac

SEQ ID NO: 9086 - DNA, 22 bp, synthetic construct
  misc_feature 1..22: note = Synthetic Construct
  source 1..22: mol_type = other DNA
aaggtgtcgtgggagaaatgag

SEQ ID NO: 9087 - DNA, 20 bp, synthetic construct
  misc_feature 1..20: note = Synthetic Construct
  source 1..20: mol_type = other DNA
ggtcctggccagtttgactt

SEQ ID NO: 9088 - DNA, 25 bp, synthetic construct
  misc_feature 1..25: note = Synthetic Construct
  source 1..25: mol_type = other DNA
gggtaaacagaacaaggtgattggt

SEQ ID NO: 9089 - DNA, 23 bp, synthetic construct
  misc_feature 1..23: note = Synthetic Construct
  source 1..23: mol_type = other DNA
gtcctccatgaagaccacattgt

SEQ ID NO: 9090 - DNA, 19 bp, synthetic construct
  misc_feature 1..19: note = Synthetic Construct
  source 1..19: mol_type = other DNA
agtgcgtgggtcctgatct

SEQ ID NO: 9091 - DNA, 20 bp, synthetic construct
  misc_feature 1..20: note = Synthetic Construct
  source 1..20: mol_type = other DNA
aagcccaggatccctttgga

SEQ ID NO: 9092 - DNA, 28 bp, synthetic construct
  misc_feature 1..28: note = Synthetic Construct
  source 1..28: mol_type = other DNA
ggtgttttgttattcagcaatccagact

SEQ ID NO: 9093 - DNA, 22 bp, synthetic construct
  misc_feature 1..22: note = Synthetic Construct
  source 1..22: mol_type = other DNA
ttgtgccaacctttccattgtc

SEQ ID NO: 9094 - DNA, 21 bp, synthetic construct
  misc_feature 1..21: note = Synthetic Construct
  source 1..21: mol_type = other DNA
tgggctgagttatgcctctca

SEQ ID NO: 9095 - DNA, 22 bp, synthetic construct
  misc_feature 1..22: note = Synthetic Construct
  source 1..22: mol_type = other DNA
gcctacagcttgtctgcaaagt

SEQ ID NO: 9096 - DNA, 30 bp, synthetic construct
  misc_feature 1..30: note = Synthetic Construct
  source 1..30: mol_type = other DNA
gagcagcatatttagcttttagagttagtg

SEQ ID NO: 9097 - DNA, 29 bp, synthetic construct
  misc_feature 1..29: note = Synthetic Construct
  source 1..29: mol_type = other DNA
tccaggaaaaaaagagaggatacattttg

SEQ ID NO: 9098 - DNA, 26 bp, synthetic construct
  misc_feature 1..26: note = Synthetic Construct
  source 1..26: mol_type = other DNA
gaaatgtagatgctgcttctgaagtt

SEQ ID NO: 9099 - DNA, 18 bp, synthetic construct
  misc_feature 1..18: note = Synthetic Construct
  source 1..18: mol_type = other DNA
cagccctgggaccaacac

SEQ ID NO: 9100 - DNA, 22 bp, synthetic construct
  misc_feature 1..22: note = Synthetic Construct
  source 1..22: mol_type = other DNA
ggcctcagagagtctttttcca

SEQ ID NO: 9101 - DNA, 26 bp, synthetic construct
  misc_feature 1..26: note = Synthetic Construct
  source 1..26: mol_type = other DNA
gcagaaccccatttaagacaagttga

SEQ ID NO: 9102 - DNA, 20 bp, synthetic construct
  misc_feature 1..20: note = Synthetic Construct
  source 1..20: mol_type = other DNA
ttggcagcaaccacaaagca

SEQ ID NO: 9103 - DNA, 27 bp, synthetic construct
  misc_feature 1..27: note = Synthetic Construct
  source 1..27: mol_type = other DNA
ggaggttctactatctctagcctgtag

SEQ ID NO: 9104 - DNA, 27 bp, synthetic construct
  misc_feature 1..27: note = Synthetic Construct
  source 1..27: mol_type = other DNA
ccacaaggaggaggttcagtattctct

SEQ ID NO: 9105 - DNA, 22 bp, synthetic construct
  misc_feature 1..22: note = Synthetic Construct
  source 1..22: mol_type = other DNA
aagttggttcccacagtcttgt

SEQ ID NO: 9106 - DNA, 21 bp, synthetic construct
  misc_feature 1..21: note = Synthetic Construct
  source 1..21: mol_type = other DNA
tggaacacagcccctttacac

SEQ ID NO: 9107 - DNA, 26 bp, synthetic construct
  misc_feature 1..26: note = Synthetic Construct
  source 1..26: mol_type = other DNA
cctatgctttgtttcaggcttagtac

SEQ ID NO: 9108 - DNA, 30 bp, synthetic construct
  misc_feature 1..30: note = Synthetic Construct
  source 1..30: mol_type = other DNA
gtatgcatatattgaaggagtgtggattag

SEQ ID NO: 9109 - DNA, 29 bp, synthetic construct
  misc_feature 1..29: note = Synthetic Construct
  source 1..29: mol_type = other DNA
ggctttgctaagatattccaaatggaaca

SEQ ID NO: 9110 - DNA, 25 bp, synthetic construct
  misc_feature 1..25: note = Synthetic Construct
  source 1..25: mol_type = other DNA
attaaaatctgaggccgatgtgttg

SEQ ID NO: 9111 - DNA, 22 bp, synthetic construct
  misc_feature 1..22: note = Synthetic Construct
  source 1..22: mol_type = other DNA
aagagaaaccaggccacacctt

SEQ ID NO: 9112 - DNA, 26 bp, synthetic construct
  misc_feature 1..26: note = Synthetic Construct
  source 1..26: mol_type = other DNA
ggaaaacttaaatgcaacgggagtaa

SEQ ID NO: 9113 - DNA, 27 bp, synthetic construct
  misc_feature 1..27: note = Synthetic Construct
  source 1..27: mol_type = other DNA
acttctatatggaaagaggcagattgc

SEQ ID NO: 9114 - DNA, 22 bp, synthetic construct
  misc_feature 1..22: note = Synthetic Construct
  source 1..22: mol_type = other DNA
aggccaactgctcctctaccta

SEQ ID NO: 9115 - DNA, 30 bp, synthetic construct
  misc_feature 1..30: note = Synthetic Construct
  source 1..30: mol_type = other DNA
tgataacactctctcagaagtattacaaca

SEQ ID NO: 9116 - DNA, 21 bp, synthetic construct
  misc_feature 1..21: note = Synthetic Construct
  source 1..21: mol_type = other DNA
tccagccgatgtccacctaca

SEQ ID NO: 9117 - DNA, 26 bp, synthetic construct
  misc_feature 1..26: note = Synthetic Construct
  source 1..26: mol_type = other DNA
ccaaacgttaaggtaggaaggtgatc

SEQ ID NO: 9118 - DNA, 21 bp, synthetic construct
  misc_feature 1..21: note = Synthetic Construct
  source 1..21: mol_type = other DNA
gggagagtccttgaggtgact

SEQ ID NO: 9119 - DNA, 21 bp, synthetic construct
  misc_feature 1..21: note = Synthetic Construct
  source 1..21: mol_type = other DNA
agcaaggctgtgatcccagat

SEQ ID NO: 9120 - DNA, 22 bp, synthetic construct
  misc_feature 1..22: note = Synthetic Construct
  source 1..22: mol_type = other DNA
agctcaagtccttgggttcaaa

SEQ ID NO: 9121 - DNA, 22 bp, synthetic construct
  misc_feature 1..22: note = Synthetic Construct
  source 1..22: mol_type = other DNA
tggggaaaatgaggctccagtt

SEQ ID NO: 9122 - DNA, 24 bp, synthetic construct
  misc_feature 1..24: note = Synthetic Construct
  source 1..24: mol_type = other DNA
acccccaccatcttgcatatacac

SEQ ID NO: 9123 - DNA, 25 bp, synthetic construct
  misc_feature 1..25: note = Synthetic Construct
  source 1..25: mol_type = other DNA
ggaggtgcacagctacatttactct

SEQ ID NO: 9124 - DNA, 19 bp, synthetic construct
  misc_feature 1..19: note = Synthetic Construct
  source 1..19: mol_type = other DNA
actgggcatgggtgaagca

SEQ ID NO: 9125 - DNA, 24 bp, synthetic construct
  misc_feature 1..24: note = Synthetic Construct
  source 1..24: mol_type = other DNA
gcagagaatagctgaaccttgaga

SEQ ID NO: 9126 - DNA, 20 bp, synthetic construct
  misc_feature 1..20: note = Synthetic Construct
  source 1..20: mol_type = other DNA
agaggctccagcacatacca

SEQ ID NO: 9127 - DNA, 21 bp, synthetic construct
  misc_feature 1..21: note = Synthetic Construct
  source 1..21: mol_type = other DNA
agaagaaggtgagcccaatgg

SEQ ID NO: 9128 - DNA, 26 bp, synthetic construct
  misc_feature 1..26: note = Synthetic Construct
  source 1..26: mol_type = other DNA
ggatgagaagggagtggttactatgc

SEQ ID NO: 9129 - DNA, 22 bp, synthetic construct
  misc_feature 1..22: note = Synthetic Construct
  source 1..22: mol_type = other DNA
agggagcggagtctccaaaact

SEQ ID NO: 9130 - DNA, 29 bp, synthetic construct
  misc_feature 1..29: note = Synthetic Construct
  source 1..29: mol_type = other DNA
gaatagaatgggttagggttagctaagta

SEQ ID NO: 9131 - DNA, 28 bp, synthetic construct
  misc_feature 1..28: note = Synthetic Construct
  source 1..28: mol_type = other DNA
gctacagagattagtctgtgaatatcct

SEQ ID NO: 9132 - DNA, 21 bp, synthetic construct
  misc_feature 1..21: note = Synthetic Construct
  source 1..21: mol_type = other DNA
aaggaggagggtgaggacaga

SEQ ID NO: 9133 - DNA, 23 bp, synthetic construct
  misc_feature 1..23: note = Synthetic Construct
  source 1..23: mol_type = other DNA
tgacctgtccctcctgattctct

SEQ ID NO: 9134 - DNA, 20 bp, synthetic construct
  misc_feature 1..20: note = Synthetic Construct
  source 1..20: mol_type = other DNA
actggggcttccatgaacac

SEQ ID NO: 9135 - DNA, 26 bp, synthetic construct
  misc_feature 1..26: note = Synthetic Construct
  source 1..26: mol_type = other DNA
ggtttctgttctgtgggggttaagag

SEQ ID NO: 9136 - DNA, 24 bp, synthetic construct
  misc_feature 1..24: note = Synthetic Construct
  source 1..24: mol_type = other DNA
tctttcacttgaggagaggagaga

SEQ ID NO: 9137 - DNA, 30 bp, synthetic construct
  misc_feature 1..30: note = Synthetic Construct
  source 1..30: mol_type = other DNA
tgaaatgttttgtactcagcagctataatc

SEQ ID NO: 9138 - DNA, 30 bp, synthetic construct
  misc_feature 1..30: note = Synthetic Construct
  source 1..30: mol_type = other DNA
gacacagtgctattattctgatgaacacta

SEQ ID NO: 9139 - DNA, 30 bp, synthetic construct
  misc_feature 1..30: note = Synthetic Construct
  source 1..30: mol_type = other DNA
cactccagagtaagttatattgcatttgac

SEQ ID NO: 9140 - DNA, 29 bp, synthetic construct
  misc_feature 1..29: note = Synthetic Construct
  source 1..29: mol_type = other DNA
tgtacttgagactcaatacattcctttca

SEQ ID NO: 9141 - DNA, 19 bp, synthetic construct
  misc_feature 1..19: note = Synthetic Construct
  source 1..19: mol_type = other DNA
gccgtctcccaggttccat

SEQ ID NO: 9142 - DNA, 26 bp, synthetic construct
  misc_feature 1..26: note = Synthetic Construct
  source 1..26: mol_type = other DNA
ctgggtagaaaaaaacaggtgatgag

SEQ ID NO: 9143 - DNA, 22 bp, synthetic construct
  misc_feature 1..22: note = Synthetic Construct
  source 1..22: mol_type = other DNA
aaggcttccacagtcgatttgc

SEQ ID NO: 9144 - DNA, 24 bp, synthetic construct
  misc_feature 1..24: note = Synthetic Construct
  source 1..24: mol_type = other DNA
tgcactacgtcttcagagagtttg

SEQ ID NO: 9145 - DNA, 24 bp, synthetic construct
  misc_feature 1..24: note = Synthetic Construct
  source 1..24: mol_type = other DNA
cccttagggatgcagcagaagtaa

SEQ ID NO: 9146 - DNA, 19 bp, synthetic construct
  misc_feature 1..19: note = Synthetic Construct
  source 1..19: mol_type = other DNA
tgtgcggccttgaacaagt

SEQ ID NO: 9147 - DNA, 23 bp, synthetic construct
  misc_feature 1..23: note = Synthetic Construct
  source 1..23: mol_type = other DNA
agttgacttctgtgggttgatgt

SEQ ID NO: 9148 - DNA, 21 bp, synthetic construct
  misc_feature 1..21: note = Synthetic Construct
  source 1..21: mol_type = other DNA
tgcctcagaccctcagaccaa

SEQ ID NO: 9149 - DNA, 23 bp, synthetic construct
  misc_feature 1..23: note = Synthetic Construct
  source 1..23: mol_type = other DNA
caggtgccactaatcaacagtga

SEQ ID NO: 9150 - DNA, 19 bp, synthetic construct
  misc_feature 1..19: note = Synthetic Construct
  source 1..19: mol_type = other DNA
cgaggcagcaaggagttca

SEQ ID NO: 9151 - DNA, 30 bp, synthetic construct
  misc_feature 1..30: note = Synthetic Construct
  source 1..30: mol_type = other DNA
gcattggtattgtattacatcacccctctt

SEQ ID NO: 9152 - DNA, 27 bp, synthetic construct
  misc_feature 1..27: note = Synthetic Construct
  source 1..27: mol_type = other DNA
ctcattgtagtctttgtgacgctattg

SEQ ID NO: 9153 - DNA, 27 bp, synthetic construct
  misc_feature 1..27: note = Synthetic Construct
  source 1..27: mol_type = other DNA
cagtatctttctatctacagccacctt

SEQ ID NO: 9154 - DNA, 22 bp, synthetic construct
  misc_feature 1..22: note = Synthetic Construct
  source 1..22: mol_type = other DNA
acctctctgctgattggacact

SEQ ID NO: 9155 - DNA, 29 bp, synthetic construct
  misc_feature 1..29: note = Synthetic Construct
  source 1..29: mol_type = other DNA
ggcttgtgattgtcccttaatactatttg

SEQ ID NO: 9156 - DNA, 28 bp, synthetic construct
  misc_feature 1..28: note = Synthetic Construct
  source 1..28: mol_type = other DNA
cctacatttcctcacatactgaccatac

SEQ ID NO: 9157 - DNA, 25 bp, synthetic construct
  misc_feature 1..25: note = Synthetic Construct
  source 1..25: mol_type = other DNA
gccctgatttccttacagtgagctt

SEQ ID NO: 9158 - DNA, 22 bp, synthetic construct
  misc_feature 1..22: note = Synthetic Construct
  source 1..22: mol_type = other DNA
ggctgcttcatcattccagttg

SEQ ID NO: 9159 - DNA, 26 bp, synthetic construct
  misc_feature 1..26: note = Synthetic Construct
  source 1..26: mol_type = other DNA
cgagccaaaggaaacgattctaacag

SEQ ID NO: 9160 - DNA, 27 bp, synthetic construct
  misc_feature 1..27: note = Synthetic Construct
  source 1..27: mol_type = other DNA
ggaagaagggagttaaaggataaaggt

SEQ ID NO: 9161 - DNA, 21 bp, synthetic construct
  misc_feature 1..21: note = Synthetic Construct
  source 1..21: mol_type = other DNA
ttgctcatccctctgcaactc

SEQ ID NO: 9162 - DNA, 23 bp, synthetic construct
  misc_feature 1..23: note = Synthetic Construct
  source 1..23: mol_type = other DNA
gccaaggaggttgagctaatttg

SEQ ID NO: 9163 - DNA, 22 bp, synthetic construct
  misc_feature 1..22: note = Synthetic Construct
  source 1..22: mol_type = other DNA
acacttcttctccacccttggt

SEQ ID NO: 9164 - DNA, 22 bp, synthetic construct
  misc_feature 1..22: note = Synthetic Construct
  source 1..22: mol_type = other DNA
tggtgttcccagagacccatct

SEQ ID NO: 9165 - DNA, 21 bp, synthetic construct
  misc_feature 1..21: note = Synthetic Construct
  source 1..21: mol_type = other DNA
atggatggcagacaggctaca

SEQ ID NO: 9166 - DNA, 22 bp, synthetic construct
  misc_feature 1..22: note = Synthetic Construct
  source 1..22: mol_type = other DNA
tccttggcatgggctctagaga

SEQ ID NO: 9167 - DNA, 24 bp, synthetic construct
  misc_feature 1..24: note = Synthetic Construct
  source 1..24: mol_type = other DNA
ccactgaatctccagcatctagag

SEQ ID NO: 9168 - DNA, 22 bp, synthetic construct
  misc_feature 1..22: note = Synthetic Construct
  source 1..22: mol_type = other DNA
acccaagacaagttgcggagta

SEQ ID NO: 9169 - DNA, 28 bp, synthetic construct
  misc_feature 1..28: note = Synthetic Construct
  source 1..28: mol_type = other DNA
aatatatctatctccagagcccgttttt

SEQ ID NO: 9170 - DNA, 23 bp, synthetic construct
  misc_feature 1..23: note = Synthetic Construct
  source 1..23: mol_type = other DNA
gtggagaggaaaaagtgctctca

SEQ ID NO: 9171 - DNA, 22 bp, synthetic construct
  misc_feature 1..22: note = Synthetic Construct
  source 1..22: mol_type = other DNA
tgtgatcgggctgtctacatgt

SEQ ID NO: 9172 - DNA, 22 bp, synthetic construct
  misc_feature 1..22: note = Synthetic Construct
  source 1..22: mol_type = other DNA
aggagaagactctgcagctgaa

SEQ ID NO: 9173 - DNA, 25 bp, synthetic construct
  misc_feature 1..25: note = Synthetic Construct
  source 1..25: mol_type = other DNA
gatattcactgagatgggacacaca

SEQ ID NO: 9174 - DNA, 18 bp, synthetic construct
  misc_feature 1..18: note = Synthetic Construct
  source 1..18: mol_type = other DNA
agggacccccgacctact

SEQ ID NO: 9175 - DNA, 22 bp, synthetic construct
  misc_feature 1..22: note = Synthetic Construct
  source 1..22: mol_type = other DNA
tggtcccactctcacaattggt

SEQ ID NO: 9176 - DNA, 24 bp, synthetic construct
  misc_feature 1..24: note = Synthetic Construct
  source 1..24: mol_type = other DNA
ccacgcctgaaataattccaacat

SEQ ID NO: 9177 - DNA, 21 bp, synthetic construct
  misc_feature 1..21: note = Synthetic Construct
  source 1..21: mol_type = other DNA
gccccagctgatgatttgact

SEQ ID NO: 9178 - DNA, 29 bp, synthetic construct
  misc_feature 1..29: note = Synthetic Construct
  source 1..29: mol_type = other DNA
cagacaatcttctgaaattctgcttctat

SEQ ID NO: 9179 - DNA, 22 bp, synthetic construct
  misc_feature 1..22: note = Synthetic Construct
  source 1..22: mol_type = other DNA
gtgattgcgatggggagacaat

SEQ ID NO: 9180 - DNA, 25 bp, synthetic construct
  misc_feature 1..25: note = Synthetic Construct
  source 1..25: mol_type = other DNA
tgtttagggaatgtgactggactag

SEQ ID NO: 9181 - DNA, 22 bp, synthetic construct
  misc_feature 1..22: note = Synthetic Construct
  source 1..22: mol_type = other DNA
tgtggctgaggttgagaaatgg

SEQ ID NO: 9182 - DNA, 25 bp, synthetic construct
  misc_feature 1..25: note = Synthetic Construct
  source 1..25: mol_type = other DNA
gggactgatgaagtagccttctgaa

SEQ ID NO: 9183 - DNA, 28 bp, synthetic construct
  misc_feature 1..28: note = Synthetic Construct
  source 1..28: mol_type = other DNA
cgtgattttagcctccctaagtctacag

SEQ ID NO: 9184 - DNA, 22 bp, synthetic construct
  misc_feature 1..22: note = Synthetic Construct
  source 1..22: mol_type = other DNA
tcactgtcactccaaggtctct

SEQ ID NO: 9185 - DNA, 22 bp, synthetic construct
  misc_feature 1..22: note = Synthetic Construct
  source 1..22: mol_type = other DNA
aaagaatcccaggtcccgttct

SEQ ID NO: 9186 - DNA, 20 bp, synthetic construct
  misc_feature 1..20: note = Synthetic Construct
  source 1..20: mol_type = other DNA
atccggggctgactcttagc

SEQ ID NO: 9187 - DNA, 24 bp, synthetic construct
  misc_feature 1..24: note = Synthetic Construct
  source 1..24: mol_type = other DNA
gccaatgctctttcttacctctgt

SEQ ID NO: 9188 - DNA, 23 bp, synthetic construct
  misc_feature 1..23: note = Synthetic Construct
  source 1..23: mol_type = other DNA
tctcttgcctttgggacatcttg

SEQ ID NO: 9189 - DNA, 26 bp, synthetic construct
  misc_feature 1..26: note = Synthetic Construct
  source 1..26: mol_type = other DNA
gctttgtgagttcttccttgttgatg

SEQ ID NO: 9190 - DNA, 19 bp, synthetic construct
  misc_feature 1..19: note = Synthetic Construct
  source 1..19: mol_type = other DNA
tggcagattgcacgtggat

SEQ ID NO: 9191 - DNA, 29 bp, synthetic construct
  misc_feature 1..29: note = Synthetic Construct
  source 1..29: mol_type = other DNA
gccaagaactatctttccaattgtctttc

SEQ ID NO: 9192 - DNA, 22 bp, synthetic construct
  misc_feature 1..22: note = Synthetic Construct
  source 1..22: mol_type = other DNA
gaaacaacggcgacagagttag

SEQ ID NO: 9193 - DNA, 24 bp, synthetic construct
  misc_feature 1..24: note = Synthetic Construct
  source 1..24: mol_type = other DNA
gggtctcatggcaagtaactgaag

SEQ ID NO: 9194 - DNA, 22 bp, synthetic construct
  misc_feature 1..22: note = Synthetic Construct
  source 1..22: mol_type = other DNA
gtgtaggtatgtggggcgattt

SEQ ID NO: 9195 - DNA, 26 bp, synthetic construct
  misc_feature 1..26: note = Synthetic Construct
  source 1..26: mol_type = other DNA
cagtgactgctcagtgaatagttagc

SEQ ID NO: 9196 - DNA, 21 bp, synthetic construct
  misc_feature 1..21: note = Synthetic Construct
  source 1..21: mol_type = other DNA
gccaggcttggtctcagatag

SEQ ID NO: 9197 - DNA, 24 bp, synthetic construct
  misc_feature 1..24: note = Synthetic Construct
  source 1..24: mol_type = other DNA
ctctgtgccactatacctgtccta

SEQ ID NO: 9198 - DNA, 27 bp, synthetic construct
  misc_feature 1..27: note = Synthetic Construct
  source 1..27: mol_type = other DNA
ggagtacagctttcccagaagtaaaat

SEQ ID NO: 9199 - DNA, 27 bp, synthetic construct
  misc_feature 1..27: note = Synthetic Construct
  source 1..27: mol_type = other DNA
ggcaaaatagctaggcaaacaggttag

SEQ ID NO: 9200 - DNA, 25 bp, synthetic construct
  misc_feature 1..25: note = Synthetic Construct
  source 1..25: mol_type = other DNA
ggagaagagatgaggggattactga

SEQ ID NO: 9201 - DNA, 27 bp, synthetic construct
  misc_feature 1..27: note = Synthetic Construct
  source 1..27: mol_type = other DNA
aaataagctttggttttgtagggacaa

SEQ ID NO: 9202 - DNA, 25 bp, synthetic construct
  misc_feature 1..25: note = Synthetic Construct
  source 1..25: mol_type = other DNA
ggaagcctcacaaaccacatgaaac

SEQ ID NO: 9203 - DNA, 20 bp, synthetic construct
  misc_feature 1..20: note = Synthetic Construct
  source 1..20: mol_type = other DNA
gttcgacactgaggccagaa

SEQ ID NO: 9204 - DNA, 25 bp, synthetic construct
  misc_feature 1..25: note = Synthetic Construct
  source 1..25: mol_type = other DNA
gagggtagaaaggctgctattatcc

SEQ ID NO: 9205 - DNA, 22 bp, synthetic construct
  misc_feature 1..22: note = Synthetic Construct
  source 1..22: mol_type = other DNA
tggggttgctaaatggcacgtt

SEQ ID NO: 9206 - DNA, 22 bp, synthetic construct
  misc_feature 1..22: note = Synthetic Construct
  source 1..22: mol_type = other DNA
tcaactgatgttgggccaaggt

SEQ ID NO: 9207 - DNA, 21 bp, synthetic construct
  misc_feature 1..21: note = Synthetic Construct
  source 1..21: mol_type = other DNA
agggaagctgggtctggaaca

SEQ ID NO: 9208 - DNA, 22 bp, synthetic construct
  misc_feature 1..22: note = Synthetic Construct
  source 1..22: mol_type = other DNA
tgcttgatttgtccgtgagctt

SEQ ID NO: 9209 - DNA, 30 bp, synthetic construct
  misc_feature 1..30: note = Synthetic Construct
  source 1..30: mol_type = other DNA
ggaaagattcaaacacacatttgactgatg

SEQ ID NO: 9210 - DNA, 28 bp, synthetic construct
  misc_feature 1..28: note = Synthetic Construct
  source 1..28: mol_type = other DNA
ggggtttggaccagatattctctaatgc

SEQ ID NO: 9211 - DNA, 26 bp, synthetic construct
  misc_feature 1..26: note = Synthetic Construct
  source 1..26: mol_type = other DNA
gatatcactgccatgaaacagagaag

SEQ ID NO: 9212 - DNA, 25 bp, synthetic construct
  misc_feature 1..25: note = Synthetic Construct
  source 1..25: mol_type = other DNA
ccatctatacaaggctcctctaagc

SEQ ID NO: 9213 - DNA, 21 bp, synthetic construct
  misc_feature 1..21: note = Synthetic Construct
  source 1..21: mol_type = other DNA
tgcaatccgtgacctaatgct

SEQ ID NO: 9214 - DNA, 26 bp, synthetic construct
  misc_feature 1..26: note = Synthetic Construct
  source 1..26: mol_type = other DNA
gggaatatggagaacagcaagatcca

SEQ ID NO: 9215 - DNA, 23 bp, synthetic construct
  misc_feature 1..23: note = Synthetic Construct
  source 1..23: mol_type = other DNA
actttgccccttcctttaaacca

SEQ ID NO: 9216 - DNA, 21 bp, synthetic construct
  misc_feature 1..21: note = Synthetic Construct
  source 1..21: mol_type = other DNA
atccagccactccgggtatgt

SEQ ID NO: 9217 - DNA, 22 bp, synthetic construct
  misc_feature 1..22: note = Synthetic Construct
  source 1..22: mol_type = other DNA
gcccttgcaccagagacaaatt

SEQ ID NO: 9218 - DNA, 26 bp, synthetic construct
  misc_feature 1..26: note = Synthetic Construct
  source 1..26: mol_type = other DNA
gggaactgtctcacaatcaaattgag

SEQ ID NO: 9219 - DNA, 20 bp, synthetic construct
  misc_feature 1..20: note = Synthetic Construct
  source 1..20: mol_type = other DNA
atctggctctgggcatctct

SEQ ID NO: 9220 - DNA, 21 bp, synthetic construct
  misc_feature 1..21: note = Synthetic Construct
  source 1..21: mol_type = other DNA
aggagttcgaggctgtagtgt

SEQ ID NO: 9221 - DNA, 27 bp, synthetic construct
  misc_feature 1..27: note = Synthetic Construct
  source 1..27: mol_type = other DNA
caccaaaacagcagtcccataatattc

SEQ ID NO: 9222 - DNA, 18 bp, synthetic construct
  misc_feature 1..18: note = Synthetic Construct
  source 1..18: mol_type = other DNA
cggcctggctccaatgtc

SEQ ID NO: 9223 - DNA, 27 bp, synthetic construct
  misc_feature 1..27: note = Synthetic Construct
  source 1..27: mol_type = other DNA
cagccaaaccatagcaatatctctact

SEQ ID NO: 9224 - DNA, 27 bp, synthetic construct
  misc_feature 1..27: note = Synthetic Construct
  source 1..27: mol_type = other DNA
cctaaccaaaaaagagaggccatgtac

SEQ ID NO: 9225 - DNA, 27 bp, synthetic construct
  misc_feature 1..27: note = Synthetic Construct
  source 1..27: mol_type = other DNA
ccagataaagaggacaaaggcattagc

SEQ ID NO: 9226 - DNA, 22 bp, synthetic construct
  misc_feature 1..22: note = Synthetic Construct
  source 1..22: mol_type = other DNA
agccggtaagtccttgcaaact

SEQ ID NO: 9227 - DNA, 21 bp, synthetic construct
  misc_feature 1..21: note = Synthetic Construct
  source 1..21: mol_type = other DNA
ttccctgcatgccaagttcag

SEQ ID NO: 9228 - DNA, 22 bp, synthetic construct
  misc_feature 1..22: note = Synthetic Construct
  source 1..22: mol_type = other DNA
ttggtactgcctccaaaaccat

SEQ ID NO: 9229 - DNA, 27 bp, synthetic construct
  misc_feature 1..27: note = Synthetic Construct
  source 1..27: mol_type = other DNA
tgctgataagagaaatgacagatgtgt

SEQ ID NO: 9230 - DNA, 18 bp, synthetic construct
  misc_feature 1..18: note = Synthetic Construct
  source 1..18: mol_type = other DNA
ccccggtgttccctctct

SEQ ID NO: 9231 - DNA, 26 bp, synthetic construct
  misc_feature 1..26: note = Synthetic Construct
  source 1..26: mol_type = other DNA
aggaaaacaggctcagaaaagttaac

SEQ ID NO: 9232 - DNA, 22 bp, synthetic construct
  misc_feature 1..22: note = Synthetic Construct
  source 1..22: mol_type = other DNA
ggaatggacttcactgcctctt

SEQ ID NO: 9233 - DNA, 28 bp, synthetic construct
  misc_feature 1..28: note = Synthetic Construct
  source 1..28: mol_type = other DNA
ttgaccctgggatgagattaattcaata

SEQ ID NO: 9234 - DNA, 19 bp, synthetic construct
  misc_feature 1..19: note = Synthetic Construct
  source 1..19: mol_type = other DNA
tggctcacggctggagtgt

SEQ ID NO: 9235 - DNA, 20 bp, synthetic construct
  misc_feature 1..20: note = Synthetic Construct
  source 1..20: mol_type = other DNA
ccgcatctccaaggcctagt

SEQ ID NO: 9236 - DNA, 21 bp, synthetic construct
  misc_feature 1..21: note = Synthetic Construct
  source 1..21: mol_type = other DNA
aaaggttgggcccctttcttc

SEQ ID NO: 9237 - DNA, 24 bp, synthetic construct
  misc_feature 1..24: note = Synthetic Construct
  source 1..24: mol_type = other DNA
tcccatcctgaggagaaaggtact

SEQ ID NO: 9238 - DNA, 24 bp, synthetic construct
  misc_feature 1..24: note = Synthetic Construct
  source 1..24: mol_type = other DNA
ctgacaggtgagatgaggagtttc

SEQ ID NO: 9239 - DNA, 21 bp, synthetic construct
  misc_feature 1..21: note = Synthetic Construct
  source 1..21: mol_type = other DNA
tcaggctcagtggtgtgaaca

SEQ ID NO: 9240 - DNA, 23 bp, synthetic construct
  misc_feature 1..23: note = Synthetic Construct
  source 1..23: mol_type = other DNA
cccaagaatgagactgtcaccaa

SEQ ID NO: 9241 - DNA, 22 bp, synthetic construct
  misc_feature 1..22: note = Synthetic Construct
  source 1..22: mol_type = other DNA
tgtgtacggttcccaagccaaa

SEQ ID NO: 9242 - DNA, 21 bp, synthetic construct
  misc_feature 1..21: note = Synthetic Construct
  source 1..21: mol_type = other DNA
cttgcaaccaccccagagatt

SEQ ID NO: 9243 - DNA, 26 bp, synthetic construct
  misc_feature 1..26: note = Synthetic Construct
  source 1..26: mol_type = other DNA
tgatattcacaaagttgcaagtgctt

SEQ ID NO: 9244 - DNA, 24 bp, synthetic construct
  misc_feature 1..24: note = Synthetic Construct
  source 1..24: mol_type = other DNA
tgaaggagatagacctcccagtct

SEQ ID NO: 9245 - DNA, 24 bp, synthetic construct
  misc_feature 1..24: note = Synthetic Construct
  source 1..24: mol_type = other DNA
acggtggttattgaagtccttgtc

SEQ ID NO: 9246 - DNA, 28 bp, synthetic construct
  misc_feature 1..28: note = Synthetic Construct
  source 1..28: mol_type = other DNA
gctgaaaagttgtacctctttactagga

SEQ ID NO: 9247 - DNA, 29 bp, synthetic construct
  misc_feature 1..29: note = Synthetic Construct
  source 1..29: mol_type = other DNA
ctgtttatctcattgcttagaatgagcat

SEQ ID NO: 9248 - DNA, 21 bp, synthetic construct
  misc_feature 1..21: note = Synthetic Construct
  source 1..21: mol_type = other DNA
aagcgaccacccacctgtttt

SEQ ID NO: 9249 - DNA, 20 bp, synthetic construct
  misc_feature 1..20: note = Synthetic Construct
  source 1..20: mol_type = other DNA
tttccatggacggcctggaa

SEQ ID NO: 9250 - DNA, 19 bp, synthetic construct
  misc_feature 1..19: note = Synthetic Construct
  source 1..19: mol_type = other DNA
agccagcatctgcaactgt

SEQ ID NO: 9251 - DNA, 28 bp, synthetic construct
  misc_feature 1..28: note = Synthetic Construct
  source 1..28: mol_type = other DNA
cctgaactaaactacctccctgtaatgg

SEQ ID NO: 9252 - DNA, 22 bp, synthetic construct
  misc_feature 1..22: note = Synthetic Construct
  source 1..22: mol_type = other DNA
tcccccttgctggcacatctat

SEQ ID NO: 9253 - DNA, 25 bp, synthetic construct
  misc_feature 1..25: note = Synthetic Construct
  source 1..25: mol_type = other DNA
gtgaggtatcacttcccaaaaaggt

SEQ ID NO: 9254 - DNA, 23 bp, synthetic construct
  misc_feature 1..23: note = Synthetic Construct
  source 1..23: mol_type = other DNA
gagagctttcatcccttctgctt

SEQ ID NO: 9255 - DNA, 21 bp, synthetic construct
  misc_feature 1..21: note = Synthetic Construct
  source 1..21: mol_type = other DNA
tggtcacccggatggtctcta

SEQ ID NO: 9256 - DNA, 22 bp, synthetic construct
  misc_feature 1..22: note = Synthetic Construct
  source 1..22: mol_type = other DNA
ttgggaaaaggcctgcttttcc

SEQ ID NO: 9257 - DNA, 25 bp, synthetic construct
  misc_feature 1..25: note = Synthetic Construct
  source 1..25: mol_type = other DNA
actaaaccaagtgtccttccatgag

SEQ ID NO: 9258 - DNA, 28 bp, synthetic construct
  misc_feature 1..28: note = Synthetic Construct
  source 1..28: mol_type = other DNA
gaagttccctaaggagagtaaaatctca

SEQ ID NO: 9259 - DNA, 21 bp, synthetic construct
  misc_feature 1..21: note = Synthetic Construct
  source 1..21: mol_type = other DNA
ttggtctctccgttcctcagt

SEQ ID NO: 9260 - DNA, 20 bp, synthetic construct
  misc_feature 1..20: note = Synthetic Construct
  source 1..20: mol_type = other DNA
tctgagtccaggcctgaaca

SEQ ID NO: 9261 - DNA, 24 bp, synthetic construct
  misc_feature 1..24: note = Synthetic Construct
  source 1..24: mol_type = other DNA
ccaggcacaaaagagaccttagac

SEQ ID NO: 9262 - DNA, 27 bp, synthetic construct
  misc_feature 1..27: note = Synthetic Construct
  source 1..27: mol_type = other DNA
caattgaaagggagttcaagacttctt

SEQ ID NO: 9263 - DNA, 23 bp, synthetic construct
  misc_feature 1..23: note = Synthetic Construct
  source 1..23: mol_type = other DNA
gacttccagattggttgccaaag

SEQ ID NO: 9264 - DNA, 21 bp, synthetic construct
  misc_feature 1..21: note = Synthetic Construct
  source 1..21: mol_type = other DNA
cacctacccctgtgtcttcct

SEQ ID NO: 9265 - DNA, 22 bp, synthetic construct
  misc_feature 1..22: note = Synthetic Construct
  source 1..22: mol_type = other DNA
tccagcctcaatttccctgtgt

SEQ ID NO: 9266 - DNA, 20 bp, synthetic construct
  misc_feature 1..20: note = Synthetic Construct
  source 1..20: mol_type = other DNA
aattggccagccaggaacag

SEQ ID NO: 9267 - DNA, 23 bp, synthetic construct
  misc_feature 1..23: note = Synthetic Construct
  source 1..23: mol_type = other DNA
ctaatgcaactggtccactgact

SEQ ID NO: 9268 - DNA, 24 bp, synthetic construct
  misc_feature 1..24: note = Synthetic Construct
  source 1..24: mol_type = other DNA
ccttcaggatgcttgatgaacaag

SEQ ID NO: 9269 - DNA, 21 bp, synthetic construct
  misc_feature 1..21: note = Synthetic Construct
  source 1..21: mol_type = other DNA
aggtcactccccaagaccttt

SEQ ID NO: 9270 - DNA, 21 bp, synthetic construct
  misc_feature 1..21: note = Synthetic Construct
  source 1..21: mol_type = other DNA
agcgcatgaacagcacagtct

SEQ ID NO: 9271 - DNA, 24 bp, synthetic construct
  misc_feature 1..24: note = Synthetic Construct
  source 1..24: mol_type = other DNA
ccaacaccagaactctctgtttca

SEQ ID NO: 9272 - DNA, 25 bp, synthetic construct
  misc_feature 1..25: note = Synthetic Construct
  source 1..25: mol_type = other DNA
gaagaacctctgattcatgcatgag

SEQ ID NO: 9273 - DNA, 22 bp, synthetic construct
  misc_feature 1..22: note = Synthetic Construct
  source 1..22: mol_type = other DNA
tctcttagcaggtccagcactt

SEQ ID NO: 9274 - DNA, 30 bp, synthetic construct
  misc_feature 1..30: note = Synthetic Construct
  source 1..30: mol_type = other DNA
ctgctgaaagatgaatcactatgaatttgg

SEQ ID NO: 9275 - DNA, 25 bp, synthetic construct
  misc_feature 1..25: note = Synthetic Construct
  source 1..25: mol_type = other DNA
ggcctttaaaggatttctggcacaa

SEQ ID NO: 9276 - DNA, 25 bp, synthetic construct
  misc_feature 1..25: note = Synthetic Construct
  source 1..25: mol_type = other DNA
tcgtagcacaaggagaaaatcatgt

SEQ ID NO: 9277 - DNA, 23 bp, synthetic construct
  misc_feature 1..23: note = Synthetic Construct
  source 1..23: mol_type = other DNA
gggccctacctatgctgctttat

SEQ ID NO: 9278 - DNA, 23 bp, synthetic construct
  misc_feature 1..23: note = Synthetic Construct
  source 1..23: mol_type = other DNA
agaataaggcaggagaggtggtt

SEQ ID NO: 9279 - DNA, 28 bp, synthetic construct
  misc_feature 1..28: note = Synthetic Construct
  source 1..28: mol_type = other DNA
gcataaattatatcacctgctgctcttg

SEQ ID NO: 9280 - DNA, 24 bp, synthetic construct
  misc_feature 1..24: note = Synthetic Construct
  source 1..24: mol_type = other DNA
cccactgctaggctagatggaatt

SEQ ID NO: 9281 - DNA, 20 bp, synthetic construct
  misc_feature 1..20: note = Synthetic Construct
  source 1..20: mol_type = other DNA
ttgccaaggtgacgcaaggt

SEQ ID NO: 9282 - DNA, 26 bp, synthetic construct
  misc_feature 1..26: note = Synthetic Construct
  source 1..26: mol_type = other DNA
aagaccttccccacaaatcattaaga

SEQ ID NO: 9283 - DNA, 27 bp, synthetic construct
  misc_feature 1..27: note = Synthetic Construct
  source 1..27: mol_type = other DNA
aatacaaccctgatgcactttattagc

SEQ ID NO: 9284 - DNA, 26 bp, synthetic construct
  misc_feature 1..26: note = Synthetic Construct
  source 1..26: mol_type = other DNA
gctttaaggaggagacagttcttcct

SEQ ID NO: 9285 - DNA, 29 bp, synthetic construct
  misc_feature 1..29: note = Synthetic Construct
  source 1..29: mol_type = other DNA
gccaacccagttgttaaagtattgaaatg

SEQ ID NO: 9286 - DNA, 24 bp, synthetic construct
  misc_feature 1..24: note = Synthetic Construct
  source 1..24: mol_type = other DNA
agattggacagggacagtctgaag

SEQ ID NO: 9287 - DNA, 25 bp, synthetic construct
  misc_feature 1..25: note = Synthetic Construct
  source 1..25: mol_type = other DNA
cccctcttccagctttgtaaaacag

SEQ ID NO: 9288 - DNA, 24 bp, synthetic construct
  misc_feature 1..24: note = Synthetic Construct
  source 1..24: mol_type = other DNA
ccttcataagcccagtctttcaga

SEQ ID NO: 9289 - DNA, 20 bp, synthetic construct
  misc_feature 1..20: note = Synthetic Construct
  source 1..20: mol_type = other DNA
atggccgtccctgcctctca

SEQ ID NO: 9290 - DNA, 24 bp, synthetic construct
  misc_feature 1..24: note = Synthetic Construct
  source 1..24: mol_type = other DNA
ccttgaacttcacaggcagaagag

SEQ ID NO: 9291 - DNA, 24 bp, synthetic construct
  misc_feature 1..24: note = Synthetic Construct
  source 1..24: mol_type = other DNA
ggcaaagaactgtaggtggtttgt

SEQ ID NO: 9292 - DNA, 23 bp, synthetic construct
  misc_feature 1..23: note = Synthetic Construct
  source 1..23: mol_type = other DNA
tctacacctgtaccccagcctat

SEQ ID NO: 9293 - DNA, 23 bp, synthetic construct
  misc_feature 1..23: note = Synthetic Construct
  source 1..23: mol_type = other DNA
tgcaattagcccattcacactgt

SEQ ID NO: 9294 - DNA, 24 bp, synthetic construct
  misc_feature 1..24: note = Synthetic Construct
  source 1..24: mol_type = other DNA
ccttcaggccttcaatgacctttg

SEQ ID NO: 9295 - DNA, 21 bp, synthetic construct
  misc_feature 1..21: note = Synthetic Construct
  source 1..21: mol_type = other DNA
tgctgtccaccctcacatggt

SEQ ID NO: 9296 - DNA, 24 bp, synthetic construct
  misc_feature 1..24: note = Synthetic Construct
  source 1..24: mol_type = other DNA
ggtctcctttttcttgtgctgctt

SEQ ID NO: 9297 - DNA, 21 bp, synthetic construct
  misc_feature 1..21: note = Synthetic Construct
  source 1..21: mol_type = other DNA
tggaatggggagggaaagtct

SEQ ID NO: 9298 - DNA, 22 bp, synthetic construct
  misc_feature 1..22: note = Synthetic Construct
  source 1..22: mol_type = other DNA
tggttgcaggtagatggcttct

SEQ ID NO: 9299 - DNA, 26 bp, synthetic construct
  misc_feature 1..26: note = Synthetic Construct
  source 1..26: mol_type = other DNA
gcattaatggtcattgtcatcgtcat

SEQ ID NO: 9300 - DNA, 24 bp, synthetic construct
  misc_feature 1..24: note = Synthetic Construct
  source 1..24: mol_type = other DNA
gggggtttgctttggaaagttctc

SEQ ID NO: 9301 - DNA, 21 bp, synthetic construct
  misc_feature 1..21: note = Synthetic Construct
  source 1..21: mol_type = other DNA
tggggcttgtctgagaccttt

SEQ ID NO: 9302 - DNA, 22 bp, synthetic construct
  misc_feature 1..22: note = Synthetic Construct
  source 1..22: mol_type = other DNA
gtccctgcagaggtcaaacata

SEQ ID NO: 9303 - DNA, 24 bp, synthetic construct
  misc_feature 1..24: note = Synthetic Construct
  source 1..24: mol_type = other DNA
cagatacctgctccagtagttgtg

SEQ ID NO: 9304 - DNA, 20 bp, synthetic construct
  misc_feature 1..20: note = Synthetic Construct
  source 1..20: mol_type = other DNA
aagcccctcccctgctagac

SEQ ID NO: 9305 - DNA, 24 bp, synthetic construct
  misc_feature 1..24: note = Synthetic Construct
  source 1..24: mol_type = other DNA
ccctgtgattatgacttgctttgg

SEQ ID NO: 9306 - DNA, 26 bp, synthetic construct
  misc_feature 1..26: note = Synthetic Construct
  source 1..26: mol_type = other DNA
ggctttctaaacaaacagcacagctt

SEQ ID NO: 9307 - DNA, 27 bp, synthetic construct
  misc_feature 1..27: note = Synthetic Construct
  source 1..27: mol_type = other DNA
ccacgtagatatcaatacatggtggtt

SEQ ID NO: 9308 - DNA, 20 bp, synthetic construct
  misc_feature 1..20: note = Synthetic Construct
  source 1..20: mol_type = other DNA
cgccgctctaaagcccacta

SEQ ID NO: 9309 - DNA, 22 bp, synthetic construct
  misc_feature 1..22: note = Synthetic Construct
  source 1..22: mol_type = other DNA
gatgcagtacccgctaatgtga

SEQ ID NO: 9310 - DNA, 30 bp, synthetic construct
  misc_feature 1..30: note = Synthetic Construct
  source 1..30: mol_type = other DNA
ccaggaatcatctacttaaactatcttcct

SEQ ID NO: 9311 - DNA, 27 bp, synthetic construct
  misc_feature 1..27: note = Synthetic Construct
  source 1..27: mol_type = other DNA
gcaacatcattctgctgataacttttg

SEQ ID NO: 9312 - DNA, 26 bp, synthetic construct
  misc_feature 1..26: note = Synthetic Construct
  source 1..26: mol_type = other DNA
gctctctttaccactgcacttactac

SEQ ID NO: 9313 - DNA, 23 bp, synthetic construct
  misc_feature 1..23: note = Synthetic Construct
  source 1..23: mol_type = other DNA
tggtatcctccccagacaaaggt

SEQ ID NO: 9314 - DNA, 22 bp, synthetic construct
  misc_feature 1..22: note = Synthetic Construct
  source 1..22: mol_type = other DNA
cctcctctgaatccacgtctgt

SEQ ID NO: 9315 - DNA, 22 bp, synthetic construct
  misc_feature 1..22: note = Synthetic Construct
  source 1..22: mol_type = other DNA
cccttcacctgtttcctgacaa

SEQ ID NO: 9316 - DNA, 25 bp, synthetic construct
  misc_feature 1..25: note = Synthetic Construct
  source 1..25: mol_type = other DNA
acagagaaagaccacctttgttagc

SEQ ID NO: 9317 - DNA, 23 bp, synthetic construct
  misc_feature 1..23: note = Synthetic Construct
  source 1..23: mol_type = other DNA
cccaatactgtctcactggcaat

SEQ ID NO: 9318 - DNA, 20 bp, synthetic construct
  misc_feature 1..20: note = Synthetic Construct
  source 1..20: mol_type = other DNA
tgtgtgtctgccagcaccat

SEQ ID NO: 9319 - DNA, 29 bp, synthetic construct
  misc_feature 1..29: note = Synthetic Construct
  source 1..29: mol_type = other DNA
gtgtatttgagatttacttgttgctgaag

SEQ ID NO: 9320 - DNA, 30 bp, synthetic construct
  misc_feature 1..30: note = Synthetic Construct
  source 1..30: mol_type = other DNA
gtgcatactatatccttcattacctctgaa

SEQ ID NO: 9321 - DNA, 29 bp, synthetic construct
  misc_feature 1..29: note = Synthetic Construct
  source 1..29: mol_type = other DNA
gtgtcttatcaggtgaagtgaatttcttg

SEQ ID NO: 9322 - DNA, 20 bp, synthetic construct
  misc_feature 1..20: note = Synthetic Construct
  source 1..20: mol_type = other DNA
tgggaccccagcatttgcat

SEQ ID NO: 9323 - DNA, 30 bp, synthetic construct
  misc_feature 1..30: note = Synthetic Construct
  source 1..30: mol_type = other DNA
ccaaacacatatgttaagtttagcatttgg

SEQ ID NO: 9324 - DNA, 29 bp, synthetic construct
  misc_feature 1..29: note = Synthetic Construct
  source 1..29: mol_type = other DNA
ggttcacaaaacaatcatggaatggtatc

SEQ ID NO: 9325 - DNA, 28 bp, synthetic construct
  misc_feature 1..28: note = Synthetic Construct
  source 1..28: mol_type = other DNA
gctgtacaactgaataggaaacaacagt

SEQ ID NO: 9326 - DNA, 19 bp, synthetic construct
  misc_feature 1..19: note = Synthetic Construct
  source 1..19: mol_type = other DNA
aggctggctgaggattggt

SEQ ID NO: 9327 - DNA, 20 bp, synthetic construct
  misc_feature 1..20: note = Synthetic Construct
  source 1..20: mol_type = other DNA
gagggccctctttgccatct

SEQ ID NO: 9328 - DNA, 23 bp, synthetic construct
  misc_feature 1..23: note = Synthetic Construct
  source 1..23: mol_type = other DNA
tgtgtttccctttggcttttcag

SEQ ID NO: 9329 - DNA, 28 bp, synthetic construct
  misc_feature 1..28: note = Synthetic Construct
  source 1..28: mol_type = other DNA
ccatgtatcacctataaactgcagtttg

SEQ ID NO: 9330 - DNA, 23 bp, synthetic construct
  misc_feature 1..23: note = Synthetic Construct
  source 1..23: mol_type = other DNA
ggcaagtggcagcaatatttacc

SEQ ID NO: 9331 - DNA, 19 bp, synthetic construct
  misc_feature 1..19: note = Synthetic Construct
  source 1..19: mol_type = other DNA
cggtccccagctgtgttct

SEQ ID NO: 9332 - DNA, 30 bp, synthetic construct
  misc_feature 1..30: note = Synthetic Construct
  source 1..30: mol_type = other DNA
gacaattcacagattagtagttgacttcca

SEQ ID NO: 9333 - DNA, 26 bp, synthetic construct
  misc_feature 1..26: note = Synthetic Construct
  source 1..26: mol_type = other DNA
ccgtttttctctgtcagtcctatctc

SEQ ID NO: 9334 - DNA, 21 bp, synthetic construct
  misc_feature 1..21: note = Synthetic Construct
  source 1..21: mol_type = other DNA
tgggcagggaaagggtacaca

SEQ ID NO: 9335 - DNA, 24 bp, synthetic construct
  misc_feature 1..24: note = Synthetic Construct
  source 1..24: mol_type = other DNA
gggggccatttcaagtttttttgc

SEQ ID NO: 9336 - DNA, 18 bp, synthetic construct
  misc_feature 1..18: note = Synthetic Construct
  source 1..18: mol_type = other DNA
cagggaaggcggcctaga

SEQ ID NO: 9337 - DNA, 21 bp, synthetic construct
  misc_feature 1..21: note = Synthetic Construct
  source 1..21: mol_type = other DNA
cgcatgcactcccagaggtat

SEQ ID NO: 9338 - DNA, 28 bp, synthetic construct
  misc_feature 1..28: note = Synthetic Construct
  source 1..28: mol_type = other DNA
gcacctcataaaaagatgctctgagcta

SEQ ID NO: 9339 - DNA, 21 bp, synthetic construct
  misc_feature 1..21: note = Synthetic Construct
  source 1..21: mol_type = other DNA
agaaggggacaggacagtgat

SEQ ID NO: 9340 - DNA, 22 bp, synthetic construct
  misc_feature 1..22: note = Synthetic Construct
  source 1..22: mol_type = other DNA
gagactgaagggtgtggaggta

SEQ ID NO: 9341 - DNA, 20 bp, synthetic construct
  misc_feature 1..20: note = Synthetic Construct
  source 1..20: mol_type = other DNA
cctccacagagccctaggaa

SEQ ID NO: 9342 - DNA, 28 bp, synthetic construct
  misc_feature 1..28: note = Synthetic Construct
  source 1..28: mol_type = other DNA
cagctacatccttgtagattagcatgag

SEQ ID NO: 9343 - DNA, 23 bp, synthetic construct
  misc_feature 1..23: note = Synthetic Construct
  source 1..23: mol_type = other DNA
ccagcttgagagaggactggatt

SEQ ID NO: 9344 - DNA, 24 bp, synthetic construct
  misc_feature 1..24: note = Synthetic Construct
  source 1..24: mol_type = other DNA
gtttttgggagttcagtcaaagct

SEQ ID NO: 9345 - DNA, 26 bp, synthetic construct
  misc_feature 1..26: note = Synthetic Construct
  source 1..26: mol_type = other DNA
ggaaactgataacccctagccttctg

SEQ ID NO: 9346 - DNA, 18 bp, synthetic construct
  misc_feature 1..18: note = Synthetic Construct
  source 1..18: mol_type = other DNA
gctggcggagacctctct

SEQ ID NO: 9347 - DNA, 26 bp, synthetic construct
  misc_feature 1..26: note = Synthetic Construct
  source 1..26: mol_type = other DNA
ccctagagaaagtagtgcctcccaaa

SEQ ID NO: 9348 - DNA, 24 bp, synthetic construct
  misc_feature 1..24: note = Synthetic Construct
  source 1..24: mol_type = other DNA
ggagaaactgacttgccccaaatc

SEQ ID NO: 9349 - DNA, 23 bp, synthetic construct
  misc_feature 1..23: note = Synthetic Construct
  source 1..23: mol_type = other DNA
gctcagaatgctcttcccagtca

SEQ ID NO: 9350 - DNA, 22 bp, synthetic construct
  misc_feature 1..22: note = Synthetic Construct
  source 1..22: mol_type = other DNA
ggttgaggagctgagcagtttc

SEQ ID NO: 9351 - DNA, 21 bp, synthetic construct
  misc_feature 1..21: note = Synthetic Construct
  source 1..21: mol_type = other DNA
cgcaggacacagaatgggaaa

SEQ ID NO: 9352 - DNA, 27 bp, synthetic construct
  misc_feature 1..27: note = Synthetic Construct
  source 1..27: mol_type = other DNA
tcttctcatcgaatcttcatggaatcc

SEQ ID NO: 9353 - DNA, 23 bp, synthetic construct
  misc_feature 1..23: note = Synthetic Construct
  source 1..23: mol_type = other DNA
caaccaaacccattttgcagtga

SEQ ID NO: 9354 - DNA, 22 bp, synthetic construct
  misc_feature 1..22: note = Synthetic Construct
  source 1..22: mol_type = other DNA
acggacactctggcctttttat

SEQ ID NO: 9355 - DNA, 26 bp, synthetic construct
  misc_feature 1..26: note = Synthetic Construct
  source 1..26: mol_type = other DNA
ccacagctcctgacttcataaaacct

SEQ ID NO: 9356 - DNA, 29 bp, synthetic construct
  misc_feature 1..29: note = Synthetic Construct
  source 1..29: mol_type = other DNA
gtgggtagattattgctgagggatatttg

SEQ ID NO: 9357 - DNA, 27 bp, synthetic construct
  misc_feature 1..27: note = Synthetic Construct
  source 1..27: mol_type = other DNA
ggtctatttccctaacccttgaatctg

SEQ ID NO: 9358 - DNA, 21 bp, synthetic construct
  misc_feature 1..21: note = Synthetic Construct
  source 1..21: mol_type = other DNA
ccaaccctcttccaccccata

SEQ ID NO: 9359 - DNA, 20 bp, synthetic construct
  misc_feature 1..20: note = Synthetic Construct
  source 1..20: mol_type = other DNA
tgggggcttcctaggaggta

SEQ ID NO: 9360 - DNA, 21 bp, synthetic construct
  misc_feature 1..21: note = Synthetic Construct
  source 1..21: mol_type = other DNA
agagcccccctctttaaacgt

SEQ ID NO: 9361 - DNA, 22 bp, synthetic construct
  misc_feature 1..22: note = Synthetic Construct
  source 1..22: mol_type = other DNA
acagcttggatgaaggcagatc

SEQ ID NO: 9362 - DNA, 21 bp, synthetic construct
  misc_feature 1..21: note = Synthetic Construct
  source 1..21: mol_type = other DNA
agggcagtggtggtgagatct

SEQ ID NO: 9363 - DNA, 21 bp, synthetic construct
  misc_feature 1..21: note = Synthetic Construct
  source 1..21: mol_type = other DNA
ttccaggcagagggcaatgaa

SEQ ID NO: 9364 - DNA, 21 bp, synthetic construct
  misc_feature 1..21: note = Synthetic Construct
  source 1..21: mol_type = other DNA
tgaaagacatccggcccacat

SEQ ID NO: 9365 - DNA, 24 bp, synthetic construct
  misc_feature 1..24: note = Synthetic Construct
  source 1..24: mol_type = other DNA
aggagtgagaagggagactcaatc

SEQ ID NO: 9366 - DNA, 24 bp, synthetic construct
  misc_feature 1..24: note = Synthetic Construct
  source 1..24: mol_type = other DNA
ctgagagaatcaggtgacattgga

SEQ ID NO: 9367 - DNA, 24 bp, synthetic construct
  misc_feature 1..24: note = Synthetic Construct
  source 1..24: mol_type = other DNA
aggtaggcctgactgagaagttga

SEQ ID NO: 9368 - DNA, 27 bp, synthetic construct
  misc_feature 1..27: note = Synthetic Construct
  source 1..27: mol_type = other DNA
gggggttggagaaatgatggaaatacc

SEQ ID NO: 9369 - DNA, 26 bp, synthetic construct
  misc_feature 1..26: note = Synthetic Construct
  source 1..26: mol_type = other DNA
gctcagacccagcaacaaatattcac

SEQ ID NO: 9370 - DNA, 28 bp, synthetic construct
  misc_feature 1..28: note = Synthetic Construct
  source 1..28: mol_type = other DNA
ggaatgtaggaggataacttggtatcat

SEQ ID NO: 9371 - DNA, 21 bp, synthetic construct
  misc_feature 1..21: note = Synthetic Construct
  source 1..21: mol_type = other DNA
tcccaaagcccctgattctga

SEQ ID NO: 9372 - DNA, 26 bp, synthetic construct
  misc_feature 1..26: note = Synthetic Construct
  source 1..26: mol_type = other DNA
cctctaagcagtgacttagagatcct

SEQ ID NO: 9373 - DNA, 22 bp, synthetic construct
  misc_feature 1..22: note = Synthetic Construct
  source 1..22: mol_type = other DNA
tgctcctggatgacacaacttc

SEQ ID NO: 9374 - DNA, 21 bp, synthetic construct
  misc_feature 1..21: note = Synthetic Construct
  source 1..21: mol_type = other DNA
tcccagtgcagcacttcttgt

SEQ ID NO: 9375 - DNA, 26 bp, synthetic construct
  misc_feature 1..26: note = Synthetic Construct
  source 1..26: mol_type = other DNA
ctcacagcatggaagttctactcaag

SEQ ID NO: 9376 - DNA, 24 bp, synthetic construct
  misc_feature 1..24: note = Synthetic Construct
  source 1..24: mol_type = other DNA
ccattccccattggcccatattag

SEQ ID NO: 9377 - DNA, 24 bp, synthetic construct
  misc_feature 1..24: note = Synthetic Construct
  source 1..24: mol_type = other DNA
tgatagggaggtgaaggctttctc

SEQ ID NO: 9378 - DNA, 22 bp, synthetic construct
  misc_feature 1..22: note = Synthetic Construct
  source 1..22: mol_type = other DNA
ctcaagaacagtgggcaaaagc

SEQ ID NO: 9379 - DNA, 20 bp, synthetic construct
  misc_feature 1..20: note = Synthetic Construct
  source 1..20: mol_type = other DNA
tggttcctgctgagggtttg

SEQ ID NO: 9380 - DNA, 25 bp, synthetic construct
  misc_feature 1..25: note = Synthetic Construct
  source 1..25: mol_type = other DNA
cgatccaactgcatactgctagatg

SEQ ID NO: 9381 - DNA, 23 bp, synthetic construct
  misc_feature 1..23: note = Synthetic Construct
  source 1..23: mol_type = other DNA
gcccggcctgctcaattttttta

SEQ ID NO: 9382 - DNA, 26 bp, synthetic construct
  misc_feature 1..26: note = Synthetic Construct
  source 1..26: mol_type = other DNA
ctccacataagactatgctcctcttc

SEQ ID NO: 9383 - DNA, 22 bp, synthetic construct
  misc_feature 1..22: note = Synthetic Construct
  source 1..22: mol_type = other DNA
ggccaacaaaatgtgccattcc

SEQ ID NO: 9384 - DNA, 19 bp, synthetic construct
  misc_feature 1..19: note = Synthetic Construct
  source 1..19: mol_type = other DNA
tccctgacccagcccgaat

SEQ ID NO: 9385 - DNA, 24 bp, synthetic construct
  misc_feature 1..24: note = Synthetic Construct
  source 1..24: mol_type = other DNA
tcagcacccaggtttttactacag

SEQ ID NO: 9386 - DNA, 22 bp, synthetic construct
  misc_feature 1..22: note = Synthetic Construct
  source 1..22: mol_type = other DNA
agatgccttgtctaccgcaaag

SEQ ID NO: 9387 - DNA, 26 bp, synthetic construct
  misc_feature 1..26: note = Synthetic Construct
  source 1..26: mol_type = other DNA
tgcccaacatagactggaatattctg

SEQ ID NO: 9388 - DNA, 21 bp, synthetic construct
  misc_feature 1..21: note = Synthetic Construct
  source 1..21: mol_type = other DNA
atgtctgccagggtcacaaaa

SEQ ID NO: 9389 - DNA, 22 bp, synthetic construct
  misc_feature 1..22: note = Synthetic Construct
  source 1..22: mol_type = other DNA
tccccagggcagatcaaaggaa

SEQ ID NO: 9390 - DNA, 22 bp, synthetic construct
  misc_feature 1..22: note = Synthetic Construct
  source 1..22: mol_type = other DNA
ctgtgtccatcctctgtgcttt

SEQ ID NO: 9391 - DNA, 28 bp, synthetic construct
  misc_feature 1..28: note = Synthetic Construct
  source 1..28: mol_type = other DNA
tcaggccaattattacatactgactcaa

SEQ ID NO: 9392 - DNA, 21 bp, synthetic construct
  misc_feature 1..21: note = Synthetic Construct
  source 1..21: mol_type = other DNA
agagccatcacttgccatcct

SEQ ID NO: 9393 - DNA, 28 bp, synthetic construct
  misc_feature 1..28: note = Synthetic Construct
  source 1..28: mol_type = other DNA
tctcggatccagggattatatacagtag

SEQ ID NO: 9394 - DNA, 27 bp, synthetic construct
  misc_feature 1..27: note = Synthetic Construct
  source 1..27: mol_type = other DNA
ccttgggagtaatacatctttctttgc

SEQ ID NO: 9395 - DNA, 23 bp, synthetic construct
  misc_feature 1..23: note = Synthetic Construct
  source 1..23: mol_type = other DNA
ccaaaacaaaccatgggctcttt

SEQ ID NO: 9396 - DNA, 26 bp, synthetic construct
  misc_feature 1..26: note = Synthetic Construct
  source 1..26: mol_type = other DNA
gctcatgctcccatctagcctttatc

SEQ ID NO: 9397 - DNA, 24 bp, synthetic construct
  misc_feature 1..24: note = Synthetic Construct
  source 1..24: mol_type = other DNA
ccctgcctcacaattcaattagga

SEQ ID NO: 9398 - DNA, 27 bp, synthetic construct
  misc_feature 1..27: note = Synthetic Construct
  source 1..27: mol_type = other DNA
gggatcttaaacctctctgagatagac

SEQ ID NO: 9399 - DNA, 26 bp, synthetic construct
  misc_feature 1..26: note = Synthetic Construct
  source 1..26: mol_type = other DNA
gcaaaagagttaggtgctgactcaca

SEQ ID NO: 9400 - DNA, 21 bp, synthetic construct
  misc_feature 1..21: note = Synthetic Construct
  source 1..21: mol_type = other DNA
tgccttgtccaagagcttcag

SEQ ID NO: 9401 - DNA, 29 bp, synthetic construct
  misc_feature 1..29: note = Synthetic Construct
  source 1..29: mol_type = other DNA
ccaaacacatttcatatcagagcacaagt

SEQ ID NO: 9402 - DNA, 24 bp, synthetic construct
  misc_feature 1..24: note = Synthetic Construct
  source 1..24: mol_type = other DNA
gcaaccaagcaagattctgtctca

SEQ ID NO: 9403 - DNA, 19 bp, synthetic construct
  misc_feature 1..19: note = Synthetic Construct
  source 1..19: mol_type = other DNA
cagaggtggccacacaaca

SEQ ID NO: 9404 - DNA, 20 bp, synthetic construct
  misc_feature 1..20: note = Synthetic Construct
  source 1..20: mol_type = other DNA
tcctcgctctgccagttagt

SEQ ID NO: 9405 - DNA, 20 bp, synthetic construct
  misc_feature 1..20: note = Synthetic Construct
  source 1..20: mol_type = other DNA
gccagaggtgccctttacag

SEQ ID NO: 9406 - DNA, 23 bp, synthetic construct
  misc_feature 1..23: note = Synthetic Construct
  source 1..23: mol_type = other DNA
gacagtaattctggcgctttctc

SEQ ID NO: 9407 - DNA, 30 bp, synthetic construct
  misc_feature 1..30: note = Synthetic Construct
  source 1..30: mol_type = other DNA
gggtcttctaaaagtcttctagaaaagtct

SEQ ID NO: 9408 - DNA, 25 bp, synthetic construct
  misc_feature 1..25: note = Synthetic Construct
  source 1..25: mol_type = other DNA
accctgagatcttaaggtgtcattg

SEQ ID NO: 9409 - DNA, 25 bp, synthetic construct
  misc_feature 1..25: note = Synthetic Construct
  source 1..25: mol_type = other DNA
ctgcatgacagaaggggtagaaaac

SEQ ID NO: 9410 - DNA, 26 bp, synthetic construct
  misc_feature 1..26: note = Synthetic Construct
  source 1..26: mol_type = other DNA
ctctatccctgagacacacttagtca

SEQ ID NO: 9411 - DNA, 19 bp, synthetic construct
  misc_feature 1..19: note = Synthetic Construct
  source 1..19: mol_type = other DNA
agggggccctcctgtcaaa

SEQ ID NO: 9412 - DNA, 18 bp, synthetic construct
  misc_feature 1..18: note = Synthetic Construct
  source 1..18: mol_type = other DNA
cgccagccccttcttcag

SEQ ID NO: 9413 - DNA, 23 bp, synthetic construct
  misc_feature 1..23: note = Synthetic Construct
  source 1..23: mol_type = other DNA
tgtgaaggactgatggctacaga

SEQ ID NO: 9414 - DNA, 27 bp, synthetic construct
  misc_feature 1..27: note = Synthetic Construct
  source 1..27: mol_type = other DNA
ccaagctatttttggcttcaggtacag

SEQ ID NO: 9415 - DNA, 19 bp, synthetic construct
  misc_feature 1..19: note = Synthetic Construct
  source 1..19: mol_type = other DNA
gctgttggggctgccaaaa

SEQ ID NO: 9416 - DNA, 22 bp, synthetic construct
  misc_feature 1..22: note = Synthetic Construct
  source 1..22: mol_type = other DNA
tcccctgccaactgttctttga

SEQ ID NO: 9417 - DNA, 20 bp, synthetic construct
  misc_feature 1..20: note = Synthetic Construct
  source 1..20: mol_type = other DNA
tggcttttgagcagcaagca

SEQ ID NO: 9418 - DNA, 20 bp, synthetic construct
  misc_feature 1..20: note = Synthetic Construct
  source 1..20: mol_type = other DNA
tgtggtgagcagggatcaca

SEQ ID NO: 9419 - DNA, 20 bp, synthetic construct
  misc_feature 1..20: note = Synthetic Construct
  source 1..20: mol_type = other DNA
tggctgagaccctggcatct

SEQ ID NO: 9420 - DNA, 29 bp, synthetic construct
  misc_feature 1..29: note = Synthetic Construct
  source 1..29: mol_type = other DNA
ggtgacaacacatgattactaatgctctt

SEQ ID NO: 9421 - DNA, 23 bp, synthetic construct
  misc_feature 1..23: note = Synthetic Construct
  source 1..23: mol_type = other DNA
ctctgagagccttcatctttggt

SEQ ID NO: 9422 - DNA, 24 bp, synthetic construct
  misc_feature 1..24: note = Synthetic Construct
  source 1..24: mol_type = other DNA
gcttgaatccttgttgtggagtga

SEQ ID NO: 9423 - DNA, 25 bp, synthetic construct
  misc_feature 1..25: note = Synthetic Construct
  source 1..25: mol_type = other DNA
ccaaatgacagaaacactggtctct

SEQ ID NO: 9424 - DNA, 22 bp, synthetic construct
  misc_feature 1..22: note = Synthetic Construct
  source 1..22: mol_type = other DNA
tgatgaggtgaggctctgtgat

SEQ ID NO: 9425 - DNA, 19 bp, synthetic construct
  misc_feature 1..19: note = Synthetic Construct
  source 1..19: mol_type = other DNA
tggccacgacagtgcagaa

SEQ ID NO: 9426 - DNA, 22 bp, synthetic construct
  misc_feature 1..22: note = Synthetic Construct
  source 1..22: mol_type = other DNA
tgctgtgtcctgtcgttcatct

SEQ ID NO: 9427 - DNA, 25 bp, synthetic construct
  misc_feature 1..25: note = Synthetic Construct
  source 1..25: mol_type = other DNA
gctgacaaagagcctgacatacatc

SEQ ID NO: 9428 - DNA, 20 bp, synthetic construct
  misc_feature 1..20: note = Synthetic Construct
  source 1..20: mol_type = other DNA
ggtccaaggagggaggaaga

SEQ ID NO: 9429 - DNA, 27 bp, synthetic construct
  misc_feature 1..27: note = Synthetic Construct
  source 1..27: mol_type = other DNA
cgaatggtacttttagcaggctacact

SEQ ID NO: 9430 - DNA, 28 bp, synthetic construct
  misc_feature 1..28: note = Synthetic Construct
  source 1..28: mol_type = other DNA
ccataagccaattcagcctctttataaa

SEQ ID NO: 9431 - DNA, 21 bp, synthetic construct
  misc_feature 1..21: note = Synthetic Construct
  source 1..21: mol_type = other DNA
tgctgtcaccttgcctggtat

SEQ ID NO: 9432 - DNA, 21 bp, synthetic construct
  misc_feature 1..21: note = Synthetic Construct
  source 1..21: mol_type = other DNA
aggtacagggcagaggatcag

SEQ ID NO: 9433 - DNA, 24 bp, synthetic construct
  misc_feature 1..24: note = Synthetic Construct
  source 1..24: mol_type = other DNA
accaggtttcctcttccctttcct

SEQ ID NO: 9434 - DNA, 23 bp, synthetic construct
  misc_feature 1..23: note = Synthetic Construct
  source 1..23: mol_type = other DNA
acgctttgcctctattcatagct

SEQ ID NO: 9435 - DNA, 25 bp, synthetic construct
  misc_feature 1..25: note = Synthetic Construct
  source 1..25: mol_type = other DNA
ttctgtctccatttcccttttctca

SEQ ID NO: 9436 - DNA, 21 bp, synthetic construct
  misc_feature 1..21: note = Synthetic Construct
  source 1..21: mol_type = other DNA
ccccattcgtgaaggctctac

SEQ ID NO: 9437 - DNA, 19 bp, synthetic construct
  misc_feature 1..19: note = Synthetic Construct
  source 1..19: mol_type = other DNA
gaggtgaggctgggtctca

SEQ ID NO: 9438 - DNA, 26 bp, synthetic construct
  misc_feature 1..26: note = Synthetic Construct
  source 1..26: mol_type = other DNA
gctctccaaagagaatgtggacttta

SEQ ID NO: 9439 - DNA, 26 bp, synthetic construct
  misc_feature 1..26: note = Synthetic Construct
  source 1..26: mol_type = other DNA
cattgtccagccttttctcttaatgg

SEQ ID NO: 9440 - DNA, 19 bp, synthetic construct
  misc_feature 1..19: note = Synthetic Construct
  source 1..19: mol_type = other DNA
gccaccagagccctccatt

SEQ ID NO: 9441 - DNA, 22 bp, synthetic construct
  misc_feature 1..22: note = Synthetic Construct
  source 1..22: mol_type = other DNA
gactgcacgaatgtgtgaaagc

SEQ ID NO: 9442 - DNA, 30 bp, synthetic construct
  misc_feature 1..30: note = Synthetic Construct
  source 1..30: mol_type = other DNA
aacaaaggcttgtcctagaaaaatcatatt

SEQ ID NO: 9443 - DNA, 20 bp, synthetic construct
  misc_feature 1..20: note = Synthetic Construct
  source 1..20: mol_type = other DNA
acaaccatggagggctgcaa

SEQ ID NO: 9444 - DNA, 24 bp, synthetic construct
  misc_feature 1..24: note = Synthetic Construct
  source 1..24: mol_type = other DNA
gcacttttcgtgtgtaaggaacag

SEQ ID NO: 9445 - DNA, 25 bp, synthetic construct
  misc_feature 1..25: note = Synthetic Construct
  source 1..25: mol_type = other DNA
gagagggtcatatatgggggaatga

SEQ ID NO: 9446 - DNA, 23 bp, synthetic construct
  misc_feature 1..23: note = Synthetic Construct
  source 1..23: mol_type = other DNA
ccaaaggcaaagactaccctttg

SEQ ID NO: 9447 - DNA, 22 bp, synthetic construct
  misc_feature 1..22: note = Synthetic Construct
  source 1..22: mol_type = other DNA
tgttggctagtcttgcaacaga

SEQ ID NO: 9448 - DNA, 26 bp, synthetic construct
  misc_feature 1..26: note = Synthetic Construct
  source 1..26: mol_type = other DNA
gaaattttcttggaaacgcaaaacca

SEQ ID NO: 9449 - DNA, 25 bp, synthetic construct
  misc_feature 1..25: note = Synthetic Construct
  source 1..25: mol_type = other DNA
cctggacactgcatgaagtattctg

SEQ ID NO: 9450 - DNA, 25 bp, synthetic construct
  misc_feature 1..25: note = Synthetic Construct
  source 1..25: mol_type = other DNA
cctctgaatttcaaactccctttgg

SEQ ID NO: 9451 - DNA, 28 bp, synthetic construct
  misc_feature 1..28: note = Synthetic Construct
  source 1..28: mol_type = other DNA
ggcataagattacacactgggttagatc

SEQ ID NO: 9452 - DNA, 24 bp, synthetic construct
  misc_feature 1..24: note = Synthetic Construct
  source 1..24: mol_type = other DNA
tgaacactctttcctggtgatgtg

SEQ ID NO: 9453 - DNA, 20 bp, synthetic construct
  misc_feature 1..20: note = Synthetic Construct
  source 1..20: mol_type = other DNA
ctggcctggctaggattcct

SEQ ID NO: 9454 - DNA, 24 bp, synthetic construct
  misc_feature 1..24: note = Synthetic Construct
  source 1..24: mol_type = other DNA
ccaaacctattctgggagccgaaa

SEQ ID NO: 9455 - DNA, 27 bp, synthetic construct
  misc_feature 1..27: note = Synthetic Construct
  source 1..27: mol_type = other DNA
cgctggtaaagttgagtcttatttcac

SEQ ID NO: 9456 - DNA, 22 bp, synthetic construct
  misc_feature 1..22: note = Synthetic Construct
  source 1..22: mol_type = other DNA
cctatcctggacccaagatgct

SEQ ID NO: 9457 - DNA, 19 bp, synthetic construct
  misc_feature 1..19: note = Synthetic Construct
  source 1..19: mol_type = other DNA
atgcccggccatcctgaat

SEQ ID NO: 9458 - DNA, 19 bp, synthetic construct
  misc_feature 1..19: note = Synthetic Construct
  source 1..19: mol_type = other DNA
aggtggaggaggccttgag

SEQ ID NO: 9459 - DNA, 19 bp, synthetic construct
  misc_feature 1..19: note = Synthetic Construct
  source 1..19: mol_type = other DNA
ggagcggaagtgagcatgt

SEQ ID NO: 9460 - DNA, 28 bp, synthetic construct
  misc_feature 1..28: note = Synthetic Construct
  source 1..28: mol_type = other DNA
gattttggagggacaggaaattaaagag

SEQ ID NO: 9461 - DNA, 19 bp, synthetic construct
  misc_feature 1..19: note = Synthetic Construct
  source 1..19: mol_type = other DNA
cctgctgtgctcagttcca

SEQ ID NO: 9462 - DNA, 22 bp, synthetic construct
  misc_feature 1..22: note = Synthetic Construct
  source 1..22: mol_type = other DNA
gggtgtgggaaggctatatgag

SEQ ID NO: 9463 - DNA, 21 bp, synthetic construct
  misc_feature 1..21: note = Synthetic Construct
  source 1..21: mol_type = other DNA
ggtacccgcatgttgctatgg

SEQ ID NO: 9464 - DNA, 19 bp, synthetic construct
  misc_feature 1..19: note = Synthetic Construct
  source 1..19: mol_type = other DNA
atccctcccagccacaact

SEQ ID NO: 9465 - DNA, 26 bp, synthetic construct
  misc_feature 1..26: note = Synthetic Construct
  source 1..26: mol_type = other DNA
ctatctacatcccattggccataact

SEQ ID NO: 9466 - DNA, 21 bp, synthetic construct
  misc_feature 1..21: note = Synthetic Construct
  source 1..21: mol_type = other DNA
agggaaggggccataacttct

SEQ ID NO: 9467 - DNA, 27 bp, synthetic construct
  misc_feature 1..27: note = Synthetic Construct
  source 1..27: mol_type = other DNA
cagttaggaagccgatgaaattagttt

SEQ ID NO: 9468 - DNA, 25 bp, synthetic construct
  misc_feature 1..25: note = Synthetic Construct
  source 1..25: mol_type = other DNA
caaccctactaactgcacagagaag

SEQ ID NO: 9469 - DNA, 20 bp, synthetic construct
  misc_feature 1..20: note = Synthetic Construct
  source 1..20: mol_type = other DNA
ctctgagcgctgttcctgaa

SEQ ID NO: 9470 - DNA, 19 bp, synthetic construct
  misc_feature 1..19: note = Synthetic Construct
  source 1..19: mol_type = other DNA
ggagccactgcagctttct

SEQ ID NO: 9471 - DNA, 19 bp, synthetic construct
  misc_feature 1..19: note = Synthetic Construct
  source 1..19: mol_type = other DNA
aggcatggcaaggctacct

SEQ ID NO: 9472 - DNA, 29 bp, synthetic construct
  misc_feature 1..29: note = Synthetic Construct
  source 1..29: mol_type = other DNA
ctctgattctgttttacagcaaaatgaga

SEQ ID NO: 9473 - DNA, 22 bp, synthetic construct
  misc_feature 1..22: note = Synthetic Construct
  source 1..22: mol_type = other DNA
ctcccctgcctcccaaatttaa

SEQ ID NO: 9474 - DNA, 21 bp, synthetic construct
  misc_feature 1..21: note = Synthetic Construct
  source 1..21: mol_type = other DNA
agaccacactcaacccagaga

SEQ ID NO: 9475 - DNA, 27 bp, synthetic construct
  misc_feature 1..27: note = Synthetic Construct
  source 1..27: mol_type = other DNA
tccatgataagcaggtctatacaatcc

SEQ ID NO: 9476 - DNA, 18 bp, synthetic construct
  misc_feature 1..18: note = Synthetic Construct
  source 1..18: mol_type = other DNA
agcggcatccctgtcctt

SEQ ID NO: 9477 - DNA, 20 bp, synthetic construct
  misc_feature 1..20: note = Synthetic Construct
  source 1..20: mol_type = other DNA
gctgcctagctgggtaacct

SEQ ID NO: 9478 - DNA, 24 bp, synthetic construct
  misc_feature 1..24: note = Synthetic Construct
  source 1..24: mol_type = other DNA
gacaatcggatgaggagcagatac

SEQ ID NO: 9479 - DNA, 22 bp, synthetic construct
  misc_feature 1..22: note = Synthetic Construct
  source 1..22: mol_type = other DNA
ggaaactgaggaggcattctca

SEQ ID NO: 9480 - DNA, 24 bp, synthetic construct
  misc_feature 1..24: note = Synthetic Construct
  source 1..24: mol_type = other DNA
cacagaattgacccctcacttcca

SEQ ID NO: 9481 - DNA, 21 bp, synthetic construct
  misc_feature 1..21: note = Synthetic Construct
  source 1..21: mol_type = other DNA
actttctggtggcatgagcaa

SEQ ID NO: 9482 - DNA, 23 bp, synthetic construct
  misc_feature 1..23: note = Synthetic Construct
  source 1..23: mol_type = other DNA
aacccaccaaaatctgacttcct

SEQ ID NO: 9483 - DNA, 18 bp, synthetic construct
  misc_feature 1..18: note = Synthetic Construct
  source 1..18: mol_type = other DNA
gggggagggaggaaacgt

SEQ ID NO: 9484 - DNA, 25 bp, synthetic construct
  misc_feature 1..25: note = Synthetic Construct
  source 1..25: mol_type = other DNA
gtgctatgtggggagtagattggaa

SEQ ID NO: 9485 - DNA, 20 bp, synthetic construct
  misc_feature 1..20: note = Synthetic Construct
  source 1..20: mol_type = other DNA
ctctgcgctgcaaagttgtc

SEQ ID NO: 9486 - DNA, 30 bp, synthetic construct
  misc_feature 1..30: note = Synthetic Construct
  source 1..30: mol_type = other DNA
cccactcctcataataggtatttgaggaaa

SEQ ID NO: 9487 - DNA, 27 bp, synthetic construct
  misc_feature 1..27: note = Synthetic Construct
  source 1..27: mol_type = other DNA
caggtattacgcttaagtgttcattgc

SEQ ID NO: 9488 - DNA, 26 bp, synthetic construct
  misc_feature 1..26: note = Synthetic Construct
  source 1..26: mol_type = other DNA
ccaaggattttctcctctcctcagat

SEQ ID NO: 9489 - DNA, 23 bp, synthetic construct
  misc_feature 1..23: note = Synthetic Construct
  source 1..23: mol_type = other DNA
tccctcagctctgaagacctact

SEQ ID NO: 9490 - DNA, 25 bp, synthetic construct
  misc_feature 1..25: note = Synthetic Construct
  source 1..25: mol_type = other DNA
gcttgtgaatcaaactgtgaaagct

SEQ ID NO: 9491 - DNA, 22 bp, synthetic construct
  misc_feature 1..22: note = Synthetic Construct
  source 1..22: mol_type = other DNA
gtggtccaacaacggtaagtgt

SEQ ID NO: 9492 - DNA, 24 bp, synthetic construct
  misc_feature 1..24: note = Synthetic Construct
  source 1..24: mol_type = other DNA
ggaatggggtctatgttggaaaga

SEQ ID NO: 9493 - DNA, 20 bp, synthetic construct
  misc_feature 1..20: note = Synthetic Construct
  source 1..20: mol_type = other DNA
ccccagtttcttggcactgt

SEQ ID NO: 9494 - DNA, 26 bp, synthetic construct
  misc_feature 1..26: note = Synthetic Construct
  source 1..26: mol_type = other DNA
gaatttcattcatgcctacgacttca

SEQ ID NO: 9495 - DNA, 24 bp, synthetic construct
  misc_feature 1..24: note = Synthetic Construct
  source 1..24: mol_type = other DNA
ccttgctagattgcaggcttcttg

SEQ ID NO: 9496 - DNA, 20 bp, synthetic construct
  misc_feature 1..20: note = Synthetic Construct
  source 1..20: mol_type = other DNA
aggtgggggtgatggtgact

SEQ ID NO: 9497 - DNA, 22 bp, synthetic construct
  misc_feature 1..22: note = Synthetic Construct
  source 1..22: mol_type = other DNA
ggagggtctagagctggatcct

SEQ ID NO: 9498 - DNA, 19 bp, synthetic construct
  misc_feature 1..19: note = Synthetic Construct
  source 1..19: mol_type = other DNA
caggaggccgtccaattgg

SEQ ID NO: 9499 - DNA, 27 bp, synthetic construct
  misc_feature 1..27: note = Synthetic Construct
  source 1..27: mol_type = other DNA
gttttaaaggttcaactgcctttacct

SEQ ID NO: 9500 - DNA, 23 bp, synthetic construct
  misc_feature 1..23: note = Synthetic Construct
  source 1..23: mol_type = other DNA
ggagatcttcccatgaaccactt

SEQ ID NO: 9501 - DNA, 22 bp, synthetic construct
  misc_feature 1..22: note = Synthetic Construct
  source 1..22: mol_type = other DNA
aaagtggtggctcctgtagaga

SEQ ID NO: 9502 - DNA, 25 bp, synthetic construct
  misc_feature 1..25: note = Synthetic Construct
  source 1..25: mol_type = other DNA
gaaagtctttgttccctgcagatac

SEQ ID NO: 9503 - DNA, 23 bp, synthetic construct
  misc_feature 1..23: note = Synthetic Construct
  source 1..23: mol_type = other DNA
cccacaagtggcagagaagaaaa

SEQ ID NO: 9504 - DNA, 26 bp, synthetic construct
  misc_feature 1..26: note = Synthetic Construct
  source 1..26: mol_type = other DNA
gcaaagagaagcatttgttcctttcc

SEQ ID NO: 9505 - DNA, 23 bp, synthetic construct
  misc_feature 1..23: note = Synthetic Construct
  source 1..23: mol_type = other DNA
gctatgggggaggctttattcaa

SEQ ID NO: 9506 - DNA, 23 bp, synthetic construct
  misc_feature 1..23: note = Synthetic Construct
  source 1..23: mol_type = other DNA
acaagctggcagatagggaagag

SEQ ID NO: 9507 - DNA, 22 bp, synthetic construct
  misc_feature 1..22: note = Synthetic Construct
  source 1..22: mol_type = other DNA
cagacatgtcatggctcctgaa

SEQ ID NO: 9508 - DNA, 24 bp, synthetic construct
  misc_feature 1..24: note = Synthetic Construct
  source 1..24: mol_type = other DNA
gtggcagttctagtggcttctagt

SEQ ID NO: 9509 - DNA, 23 bp, synthetic construct
  misc_feature 1..23: note = Synthetic Construct
  source 1..23: mol_type = other DNA
agactcagcactggaagaaacac

SEQ ID NO: 9510 - DNA, 24 bp, synthetic construct
  misc_feature 1..24: note = Synthetic Construct
  source 1..24: mol_type = other DNA
ctgccatgacaaatccttctacac

SEQ ID NO: 9511 - DNA, 30 bp, synthetic construct
  misc_feature 1..30: note = Synthetic Construct
  source 1..30: mol_type = other DNA
gggacttacgatgccataataaagaatttg

SEQ ID NO: 9512 - DNA, 24 bp, synthetic construct
  misc_feature 1..24: note = Synthetic Construct
  source 1..24: mol_type = other DNA
cctagagaaccggtaaagcagtac

SEQ ID NO: 9513 - DNA, 22 bp, synthetic construct
  misc_feature 1..22: note = Synthetic Construct
  source 1..22: mol_type = other DNA
aggcaattgctacctcgatcca

SEQ ID NO: 9514 - DNA, 24 bp, synthetic construct
  misc_feature 1..24: note = Synthetic Construct
  source 1..24: mol_type = other DNA
gtgactacaggagcagcatatctg

SEQ ID NO: 9515 - DNA, 19 bp, synthetic construct
  misc_feature 1..19: note = Synthetic Construct
  source 1..19: mol_type = other DNA
caggcagggacagctgaaa

SEQ ID NO: 9516 - DNA, 29 bp, synthetic construct
  misc_feature 1..29: note = Synthetic Construct
  source 1..29: mol_type = other DNA
tcttaccataattccagagaacagtacat

SEQ ID NO: 9517 - DNA, 25 bp, synthetic construct
  misc_feature 1..25: note = Synthetic Construct
  source 1..25: mol_type = other DNA
acttctgaaagaaagaaggccaaga

SEQ ID NO: 9518 - DNA, 22 bp, synthetic construct
  misc_feature 1..22: note = Synthetic Construct
  source 1..22: mol_type = other DNA
tggtacagtgagggtagaacca

SEQ ID NO: 9519 - DNA, 26 bp, synthetic construct
  misc_feature 1..26: note = Synthetic Construct
  source 1..26: mol_type = other DNA
gccgtgattatgactggcattacatc

SEQ ID NO: 9520 - DNA, 29 bp, synthetic construct
  misc_feature 1..29: note = Synthetic Construct
  source 1..29: mol_type = other DNA
cctgcattacaaatggttttcttcctgtt

SEQ ID NO: 9521 - DNA, 22 bp, synthetic construct
  misc_feature 1..22: note = Synthetic Construct
  source 1..22: mol_type = other DNA
gccttcttcctcctgctttgtt

SEQ ID NO: 9522 - DNA, 29 bp, synthetic construct
  misc_feature 1..29: note = Synthetic Construct
  source 1..29: mol_type = other DNA
caaggagtgactagtctgactttaaatct

SEQ ID NO: 9523 - DNA, 21 bp, synthetic construct
  misc_feature 1..21: note = Synthetic Construct
  source 1..21: mol_type = other DNA
ccccctcatcaatgcctcctt

SEQ ID NO: 9524 - DNA, 23 bp, synthetic construct
  misc_feature 1..23: note = Synthetic Construct
  source 1..23: mol_type = other DNA
gtgactcccaccaaatacaggat

SEQ ID NO: 9525 - DNA, 21 bp, synthetic construct
  misc_feature 1..21: note = Synthetic Construct
  source 1..21: mol_type = other DNA
tccctgtcctatgcacccaaa

SEQ ID NO: 9526 - DNA, 20 bp, synthetic construct
  misc_feature 1..20: note = Synthetic Construct
  source 1..20: mol_type = other DNA
ccaccctaccccacctgtac

SEQ ID NO: 9527 - DNA, 22 bp, synthetic construct
  misc_feature 1..22: note = Synthetic Construct
  source 1..22: mol_type = other DNA
tctgcgattttcccccatgtct

SEQ ID NO: 9528 - DNA, 22 bp, synthetic construct
  misc_feature 1..22: note = Synthetic Construct
  source 1..22: mol_type = other DNA
cgcacccggcccattattataa

SEQ ID NO: 9529 - DNA, 21 bp, synthetic construct
  misc_feature 1..21: note = Synthetic Construct
  source 1..21: mol_type = other DNA
ttcgtcctagtccctgtgtga

SEQ ID NO: 9530 - DNA, 27 bp, synthetic construct
  misc_feature 1..27: note = Synthetic Construct
  source 1..27: mol_type = other DNA
aacacatacatgttaacacacctatgc

SEQ ID NO: 9531 - DNA, 26 bp, synthetic construct
  misc_feature 1..26: note = Synthetic Construct
  source 1..26: mol_type = other DNA
cctggtaagtttgccttctatgtttc

SEQ ID NO: 9532 - DNA, 25 bp, synthetic construct
  misc_feature 1..25: note = Synthetic Construct
  source 1..25: mol_type = other DNA
gggaaagctttctacatgctttgag

SEQ ID NO: 9533 - DNA, 22 bp, synthetic construct
  misc_feature 1..22: note = Synthetic Construct
  source 1..22: mol_type = other DNA
actgtacactggctgttttgca

SEQ ID NO: 9534 - DNA, 21 bp, synthetic construct
  misc_feature 1..21: note = Synthetic Construct
  source 1..21: mol_type = other DNA
tcttggcattgcaacctccat

SEQ ID NO: 9535 - DNA, 24 bp, synthetic construct
  misc_feature 1..24: note = Synthetic Construct
  source 1..24: mol_type = other DNA
gtggacgaggagaaatgagagctt

SEQ ID NO: 9536 - DNA, 20 bp, synthetic construct
  misc_feature 1..20: note = Synthetic Construct
  source 1..20: mol_type = other DNA
agtgccgcatccctatgtca

SEQ ID NO: 9537 - DNA, 25 bp, synthetic construct
  misc_feature 1..25: note = Synthetic Construct
  source 1..25: mol_type = other DNA
cctaaccttaggggatgctcatctt

SEQ ID NO: 9538 - DNA, 19 bp, synthetic construct
  misc_feature 1..19: note = Synthetic Construct
  source 1..19: mol_type = other DNA
agggcacagggctcagctt

SEQ ID NO: 9539 - DNA, 22 bp, synthetic construct
  misc_feature 1..22: note = Synthetic Construct
  source 1..22: mol_type = other DNA
tggactagaggatcccccagtt

SEQ ID NO: 9540 - DNA, 21 bp, synthetic construct
  misc_feature 1..21: note = Synthetic Construct
  source 1..21: mol_type = other DNA
tgctggggagattccttgaac

SEQ ID NO: 9541 - DNA, 24 bp, synthetic construct
  misc_feature 1..24: note = Synthetic Construct
  source 1..24: mol_type = other DNA
gtggtggagcaaagttcctctaga

SEQ ID NO: 9542 - DNA, 26 bp, synthetic construct
  misc_feature 1..26: note = Synthetic Construct
  source 1..26: mol_type = other DNA
gctccacagaattactcccagtgatc

SEQ ID NO: 9543 - DNA, 20 bp, synthetic construct
  misc_feature 1..20: note = Synthetic Construct
  source 1..20: mol_type = other DNA
tctgcacctctgcacttgct

SEQ ID NO: 9544 - DNA, 24 bp, synthetic construct
  misc_feature 1..24: note = Synthetic Construct
  source 1..24: mol_type = other DNA
catcaccctcaattcttgcagatg

SEQ ID NO: 9545 - DNA, 26 bp, synthetic construct
  misc_feature 1..26: note = Synthetic Construct
  source 1..26: mol_type = other DNA
gctgcatcgagaaaataagaatcact

SEQ ID NO: 9546 - DNA, 25 bp, synthetic construct
  misc_feature 1..25: note = Synthetic Construct
  source 1..25: mol_type = other DNA
gggagaactgaaggtgtctgactat

SEQ ID NO: 9547 - DNA, 19 bp, synthetic construct
  misc_feature 1..19: note = Synthetic Construct
  source 1..19: mol_type = other DNA
gccaacacctgcccagttg

SEQ ID NO: 9548 - DNA, 24 bp, synthetic construct
  misc_feature 1..24: note = Synthetic Construct
  source 1..24: mol_type = other DNA
gcaacatagcaactgaggctcaga

SEQ ID NO: 9549 - DNA, 19 bp, synthetic construct
  misc_feature 1..19: note = Synthetic Construct
  source 1..19: mol_type = other DNA
agggactctgcccctagct

SEQ ID NO: 9550 - DNA, 24 bp, synthetic construct
  misc_feature 1..24: note = Synthetic Construct
  source 1..24: mol_type = other DNA
gccccttgaaatactgtgaaatcc

SEQ ID NO: 9551 - DNA, 21 bp, synthetic construct
  misc_feature 1..21: note = Synthetic Construct
  source 1..21: mol_type = other DNA
atggaccccactccctatgtt

SEQ ID NO: 9552 - DNA, 26 bp, synthetic construct
  misc_feature 1..26: note = Synthetic Construct
  source 1..26: mol_type = other DNA
ggcacagctgagatgttgaattactc

SEQ ID NO: 9553 - DNA, 19 bp, synthetic construct
  misc_feature 1..19: note = Synthetic Construct
  source 1..19: mol_type = other DNA
tttgggccgaggcatcaca

SEQ ID NO: 9554 - DNA, 22 bp, synthetic construct
  misc_feature 1..22: note = Synthetic Construct
  source 1..22: mol_type = other DNA
acccactggattctcccttagt

SEQ ID NO: 9555 - DNA, 29 bp, synthetic construct
  misc_feature 1..29: note = Synthetic Construct
  source 1..29: mol_type = other DNA
ccacttccaagaagatagttcattcatca

SEQ ID NO: 9556 - DNA, 20 bp, synthetic construct
  misc_feature 1..20: note = Synthetic Construct
  source 1..20: mol_type = other DNA
cctttgctgcttccggatgt

SEQ ID NO: 9557 - DNA, 24 bp, synthetic construct
  misc_feature 1..24: note = Synthetic Construct
  source 1..24: mol_type = other DNA
tgaagttcgacctgaaagaacact

SEQ ID NO: 9558 - DNA, 24 bp, synthetic construct
  misc_feature 1..24: note = Synthetic Construct
  source 1..24: mol_type = other DNA
agcaatcccgtcctacctctaaac

SEQ ID NO: 9559 - DNA, 21 bp, synthetic construct
  misc_feature 1..21: note = Synthetic Construct
  source 1..21: mol_type = other DNA
cccaggcatgagaaggaacct

SEQ ID NO: 9560 - DNA, 18 bp, synthetic construct
  misc_feature 1..18: note = Synthetic Construct
  source 1..18: mol_type = other DNA
tggctgacgctgcactgt

SEQ ID NO: 9561 - DNA, 19 bp, synthetic construct
  misc_feature 1..19: note = Synthetic Construct
  source 1..19: mol_type = other DNA
cctgtgtggcatgcagtct

SEQ ID NO: 9562 - DNA, 20 bp, synthetic construct
  misc_feature 1..20: note = Synthetic Construct
  source 1..20: mol_type = other DNA
gggttacctcagctgttgca

SEQ ID NO: 9563 - DNA, 24 bp, synthetic construct
  misc_feature 1..24: note = Synthetic Construct
  source 1..24: mol_type = other DNA
gcattacagtccccctgaaaagct

SEQ ID NO: 9564 - DNA, 27 bp, synthetic construct
  misc_feature 1..27: note = Synthetic Construct
  source 1..27: mol_type = other DNA
ctgtcacaaaggctgtccttaataaat

SEQ ID NO: 9565 - DNA, 23 bp, synthetic construct
  misc_feature 1..23: note = Synthetic Construct
  source 1..23: mol_type = other DNA
ccttgctggtgagacctaagact

SEQ ID NO: 9566 - DNA, 21 bp, synthetic construct
  misc_feature 1..21: note = Synthetic Construct
  source 1..21: mol_type = other DNA
tcgtcctgccaactgacagtt

SEQ ID NO: 9567 - DNA, 22 bp, synthetic construct
  misc_feature 1..22: note = Synthetic Construct
  source 1..22: mol_type = other DNA
ctgtcagggtctgcatgtgtat

SEQ ID NO: 9568 - DNA, 25 bp, synthetic construct
  misc_feature 1..25: note = Synthetic Construct
  source 1..25: mol_type = other DNA
cacttttccactgaagatccaagca

SEQ ID NO: 9569 - DNA, 22 bp, synthetic construct
  misc_feature 1..22: note = Synthetic Construct
  source 1..22: mol_type = other DNA
ctgggagctggaacttcaaagt

SEQ ID NO: 9570 - DNA, 28 bp, synthetic construct
  misc_feature 1..28: note = Synthetic Construct
  source 1..28: mol_type = other DNA
cctttttcctctcctttaatcaaccaat

SEQ ID NO: 9571 - DNA, 26 bp, synthetic construct
  misc_feature 1..26: note = Synthetic Construct
  source 1..26: mol_type = other DNA
cctgcttgttcataggcatgaaaatg

SEQ ID NO: 9572 - DNA, 23 bp, synthetic construct
  misc_feature 1..23: note = Synthetic Construct
  source 1..23: mol_type = other DNA
tcagaggctgtaccttgacaatc

SEQ ID NO: 9573 - DNA, 24 bp, synthetic construct
  misc_feature 1..24: note = Synthetic Construct
  source 1..24: mol_type = other DNA
tgacatccagcaactagacagaga

SEQ ID NO: 9574 - DNA, 26 bp, synthetic construct
  misc_feature 1..26: note = Synthetic Construct
  source 1..26: mol_type = other DNA
ttcacttcaagttttcaagctgcata

SEQ ID NO: 9575 - DNA, 22 bp, synthetic construct
  misc_feature 1..22: note = Synthetic Construct
  source 1..22: mol_type = other DNA
cacttcagggccacttactcaa

SEQ ID NO: 9576 - DNA, 22 bp, synthetic construct
  misc_feature 1..22: note = Synthetic Construct
  source 1..22: mol_type = other DNA
tcagctcctttcaaagcaaggt

SEQ ID NO: 9577 - DNA, 24 bp, synthetic construct
  misc_feature 1..24: note = Synthetic Construct
  source 1..24: mol_type = other DNA
ggtcacacacaagccatgtctaga

SEQ ID NO: 9578 - DNA, 28 bp, synthetic construct
  misc_feature 1..28: note = Synthetic Construct
  source 1..28: mol_type = other DNA
gaaagagcattggatatttatggagcaa

SEQ ID NO: 9579 - DNA, 25 bp, synthetic construct
  misc_feature 1..25: note = Synthetic Construct
  source 1..25: mol_type = other DNA
ccagaaagcaggtttcacctttagc

SEQ ID NO: 9580 - DNA, 22 bp, synthetic construct
  misc_feature 1..22: note = Synthetic Construct
  source 1..22: mol_type = other DNA
gtcagactggctaagcaacaca

SEQ ID NO: 9581 - DNA, 23 bp, synthetic construct
  misc_feature 1..23: note = Synthetic Construct
  source 1..23: mol_type = other DNA
gcttctgcttcttcctagcacat

SEQ ID NO: 9582 - DNA, 29 bp, synthetic construct
  misc_feature 1..29: note = Synthetic Construct
  source 1..29: mol_type = other DNA
tcactttataaactgcaatggaattcagt

SEQ ID NO: 9583 - DNA, 21 bp, synthetic construct
  misc_feature 1..21: note = Synthetic Construct
  source 1..21: mol_type = other DNA
cctgaagctcagagccaacct

SEQ ID NO: 9584 - DNA, 24 bp, synthetic construct
  misc_feature 1..24: note = Synthetic Construct
  source 1..24: mol_type = other DNA
gtgaagcagagatgaagcaccaaa

SEQ ID NO: 9585 - DNA, 22 bp, synthetic construct
  misc_feature 1..22: note = Synthetic Construct
  source 1..22: mol_type = other DNA
aggtcactgggaactgttcctt

SEQ ID NO: 9586 - DNA, 20 bp, synthetic construct
  misc_feature 1..20: note = Synthetic Construct
  source 1..20: mol_type = other DNA
agactgaaggccctgaagga

SEQ ID NO: 9587 - DNA, 24 bp, synthetic construct
  misc_feature 1..24: note = Synthetic Construct
  source 1..24: mol_type = other DNA
gcatagtagggaaaagggaccttt

SEQ ID NO: 9588 - DNA, 20 bp, synthetic construct
  misc_feature 1..20: note = Synthetic Construct
  source 1..20: mol_type = other DNA
agtgatggcgtgttgggatt

SEQ ID NO: 9589 - DNA, 27 bp, synthetic construct
  misc_feature 1..27: note = Synthetic Construct
  source 1..27: mol_type = other DNA
cagaaacagtgatctatcagttgcaat

SEQ ID NO: 9590 - DNA, 22 bp, synthetic construct
  misc_feature 1..22: note = Synthetic Construct
  source 1..22: mol_type = other DNA
cactgctttgtggaccaggtta

SEQ ID NO: 9591 - DNA, 21 bp, synthetic construct
  misc_feature 1..21: note = Synthetic Construct
  source 1..21: mol_type = other DNA
aaggcatctctcacacaagca

SEQ ID NO: 9592 - DNA, 26 bp, synthetic construct
  misc_feature 1..26: note = Synthetic Construct
  source 1..26: mol_type = other DNA
cattaaccttacaagcagagggagaa

SEQ ID NO: 9593 - DNA, 25 bp, synthetic construct
  misc_feature 1..25: note = Synthetic Construct
  source 1..25: mol_type = other DNA
gcacagttgttagagaaagtttgga

SEQ ID NO: 9594 - DNA, 26 bp, synthetic construct
  misc_feature 1..26: note = Synthetic Construct
  source 1..26: mol_type = other DNA
ggagagcaccttctctcttacataag

SEQ ID NO: 9595 - DNA, 23 bp, synthetic construct
  misc_feature 1..23: note = Synthetic Construct
  source 1..23: mol_type = other DNA
tgggcttcctcccacaattttac

SEQ ID NO: 9596 - DNA, 28 bp, synthetic construct
  misc_feature 1..28: note = Synthetic Construct
  source 1..28: mol_type = other DNA
cagacagattttactctgagttgtgtca

SEQ ID NO: 9597 - DNA, 21 bp, synthetic construct
  misc_feature 1..21: note = Synthetic Construct
  source 1..21: mol_type = other DNA
aagcacgtcccagtagtttcc

SEQ ID NO: 9598 - DNA, 22 bp, synthetic construct
  misc_feature 1..22: note = Synthetic Construct
  source 1..22: mol_type = other DNA
caaactgtggcaatgcgaatga

SEQ ID NO: 9599 - DNA, 24 bp, synthetic construct
  misc_feature 1..24: note = Synthetic Construct
  source 1..24: mol_type = other DNA
gccagcctcaagatttgtggtcaa

SEQ ID NO: 9600 - DNA, 25 bp, synthetic construct
  misc_feature 1..25: note = Synthetic Construct
  source 1..25: mol_type = other DNA
gtgcttgtgagtttttgagcctaga

SEQ ID NO: 9601 - DNA, 22 bp, synthetic construct
  misc_feature 1..22: note = Synthetic Construct
  source 1..22: mol_type = other DNA
ggaccttggccattatcattgc

SEQ ID NO: 9602 - DNA, 24 bp, synthetic construct
  misc_feature 1..24: note = Synthetic Construct
  source 1..24: mol_type = other DNA
tctaccatggctccaggtttaaac

SEQ ID NO: 9603 - DNA, 22 bp, synthetic construct
  misc_feature 1..22: note = Synthetic Construct
  source 1..22: mol_type = other DNA
agaggaccaaggacgttcgtaa

SEQ ID NO: 9604 - DNA, 21 bp, synthetic construct
  misc_feature 1..21: note = Synthetic Construct
  source 1..21: mol_type = other DNA
tcacagaaatgcgaccacaga

SEQ ID NO: 9605 - DNA, 24 bp, synthetic construct
  misc_feature 1..24: note = Synthetic Construct
  source 1..24: mol_type = other DNA
tgaatttggtagggaggacacaaa

SEQ ID NO: 9606 - DNA, 24 bp, synthetic construct
  misc_feature 1..24: note = Synthetic Construct
  source 1..24: mol_type = other DNA
tggatggacgggggtactatttct

SEQ ID NO: 9607 - DNA, 24 bp, synthetic construct
  misc_feature 1..24: note = Synthetic Construct
  source 1..24: mol_type = other DNA
attatggctcactgtagcctcaaa

SEQ ID NO: 9608 - DNA, 20 bp, synthetic construct
  misc_feature 1..20: note = Synthetic Construct
  source 1..20: mol_type = other DNA
catggctggcagttggtact

SEQ ID NO: 9609 - DNA, 20 bp, synthetic construct
  misc_feature 1..20: note = Synthetic Construct
  source 1..20: mol_type = other DNA
gcagtcaagcctcctttcca

SEQ ID NO: 9610 - DNA, 24 bp, synthetic construct
  misc_feature 1..24: note = Synthetic Construct
  source 1..24: mol_type = other DNA
gccaacctaaagcaagctcaaacc

SEQ ID NO: 9611 - DNA, 29 bp, synthetic construct
  misc_feature 1..29: note = Synthetic Construct
  source 1..29: mol_type = other DNA
ctgatttggggagagtaaaatgtcattag

SEQ ID NO: 9612 - DNA, 20 bp, synthetic construct
  misc_feature 1..20: note = Synthetic Construct
  source 1..20: mol_type = other DNA
ttgggtggcatcctgcaatg

SEQ ID NO: 9613 - DNA, 29 bp, synthetic construct
  misc_feature 1..29: note = Synthetic Construct
  source 1..29: mol_type = other DNA
ggctgagtaaactggcttatctctgaaat

SEQ ID NO: 9614 - DNA, 24 bp, synthetic construct
  misc_feature 1..24: note = Synthetic Construct
  source 1..24: mol_type = other DNA
acccacagactcgtcttgataggt

SEQ ID NO: 9615 - DNA, 22 bp, synthetic construct
  misc_feature 1..22: note = Synthetic Construct
  source 1..22: mol_type = other DNA
tgcccggtcttctgttcctaaa

SEQ ID NO: 9616 - DNA, 22 bp, synthetic construct
  misc_feature 1..22: note = Synthetic Construct
  source 1..22: mol_type = other DNA
tgccccttcactctgttgatga

SEQ ID NO: 9617 - DNA, 22 bp, synthetic construct
  misc_feature 1..22: note = Synthetic Construct
  source 1..22: mol_type = other DNA
acaagctgcagcctactaacac

SEQ ID NO: 9618 - DNA, 20 bp, synthetic construct
  misc_feature 1..20: note = Synthetic Construct
  source 1..20: mol_type = other DNA
atggggctgagtgacaagga

SEQ ID NO: 9619 - DNA, 22 bp, synthetic construct
  misc_feature 1..22: note = Synthetic Construct
  source 1..22: mol_type = other DNA
tcccacccgcatagaaaagatg

SEQ ID NO: 9620 - DNA, 25 bp, synthetic construct
  misc_feature 1..25: note = Synthetic Construct
  source 1..25: mol_type = other DNA
gcaaacttttgactgacgttctcaa

SEQ ID NO: 9621 - DNA, 25 bp, synthetic construct
  misc_feature 1..25: note = Synthetic Construct
  source 1..25: mol_type = other DNA
gacttgaaaagttctccccaaatgc

SEQ ID NO: 9622 - DNA, 28 bp, synthetic construct
  misc_feature 1..28: note = Synthetic Construct
  source 1..28: mol_type = other DNA
ggtttaagaaagccttagaactccatct

SEQ ID NO: 9623 - DNA, 23 bp, synthetic construct
  misc_feature 1..23: note = Synthetic Construct
  source 1..23: mol_type = other DNA
cactgctgtgccagaaaaacttg

SEQ ID NO: 9624 - DNA, 21 bp, synthetic construct
  misc_feature 1..21: note = Synthetic Construct
  source 1..21: mol_type = other DNA
agggaacaggagcctgctact

SEQ ID NO: 9625 - DNA, 21 bp, synthetic construct
  misc_feature 1..21: note = Synthetic Construct
  source 1..21: mol_type = other DNA
agtagcgtccagtgtgacaga

SEQ ID NO: 9626 - DNA, 24 bp, synthetic construct
  misc_feature 1..24: note = Synthetic Construct
  source 1..24: mol_type = other DNA
gggggctacattaactctgttgga

SEQ ID NO: 9627 - DNA, 28 bp, synthetic construct
  misc_feature 1..28: note = Synthetic Construct
  source 1..28: mol_type = other DNA
gtaggattcttgtcttagcatgtctttg

SEQ ID NO: 9628 - DNA, 21 bp, synthetic construct
  misc_feature 1..21: note = Synthetic Construct
  source 1..21: mol_type = other DNA
tcctgacccaggtttgttcgt

SEQ ID NO: 9629 - DNA, 21 bp, synthetic construct
  misc_feature 1..21: note = Synthetic Construct
  source 1..21: mol_type = other DNA
aaccccagtgcctgcaaatgt

SEQ ID NO: 9630 - DNA, 21 bp, synthetic construct
  misc_feature 1..21: note = Synthetic Construct
  source 1..21: mol_type = other DNA
agcctagtgacagcacctgaa

SEQ ID NO: 9631 - DNA, 26 bp, synthetic construct
  misc_feature 1..26: note = Synthetic Construct
  source 1..26: mol_type = other DNA
gcagtcacttccagagtcattacttc

SEQ ID NO: 9632 - DNA, 24 bp, synthetic construct
  misc_feature 1..24: note = Synthetic Construct
  source 1..24: mol_type = other DNA
agttgcagtctaggttttgttggt

SEQ ID NO: 9633 - DNA, 20 bp, synthetic construct
  misc_feature 1..20: note = Synthetic Construct
  source 1..20: mol_type = other DNA
aaagtgtggccagtgtttgc

SEQ ID NO: 9634 - DNA, 23 bp, synthetic construct
  misc_feature 1..23: note = Synthetic Construct
  source 1..23: mol_type = other DNA
tgggaggagagagccatattcca

SEQ ID NO: 9635 - DNA, 27 bp, synthetic construct
  misc_feature 1..27: note = Synthetic Construct
  source 1..27: mol_type = other DNA
acttggcatttaatgggaactatttcc

SEQ ID NO: 9636 - DNA, 28 bp, synthetic construct
  misc_feature 1..28: note = Synthetic Construct
  source 1..28: mol_type = other DNA
ggagaaatgagatagacgtgttgtgttc

SEQ ID NO: 9637 - DNA, 26 bp, synthetic construct
  misc_feature 1..26: note = Synthetic Construct
  source 1..26: mol_type = other DNA
ctcatcagagctcagtatggggacat

SEQ ID NO: 9638 - DNA, 21 bp, synthetic construct
  misc_feature 1..21: note = Synthetic Construct
  source 1..21: mol_type = other DNA
aggaccttgaggtggcctgaa

SEQ ID NO: 9639 - DNA, 20 bp, synthetic construct
  misc_feature 1..20: note = Synthetic Construct
  source 1..20: mol_type = other DNA
tttgcatcctgccacatcct

SEQ ID NO: 9640 - DNA, 23 bp, synthetic construct
  misc_feature 1..23: note = Synthetic Construct
  source 1..23: mol_type = other DNA
acacactcatactcctcccatct

SEQ ID NO: 9641 - DNA, 19 bp, synthetic construct
  misc_feature 1..19: note = Synthetic Construct
  source 1..19: mol_type = other DNA
gccagaccatcctgcatgt

SEQ ID NO: 9642 - DNA, 24 bp, synthetic construct
  misc_feature 1..24: note = Synthetic Construct
  source 1..24: mol_type = other DNA
gtggaagtgacaatgtgtgatagc

SEQ ID NO: 9643 - DNA, 28 bp, synthetic construct
  misc_feature 1..28: note = Synthetic Construct
  source 1..28: mol_type = other DNA
gagaaaagatccttgaagcatagtgttt

SEQ ID NO: 9644 - DNA, 30 bp, synthetic construct
  misc_feature 1..30: note = Synthetic Construct
  source 1..30: mol_type = other DNA
gcctaatccataaccaagaattaccctcta

SEQ ID NO: 9645 - DNA, 19 bp, synthetic construct
  misc_feature 1..19: note = Synthetic Construct
  source 1..19: mol_type = other DNA
tttcctgcaggccctttcg

SEQ ID NO: 9646 - DNA, 18 bp, synthetic construct
  misc_feature 1..18: note = Synthetic Construct
  source 1..18: mol_type = other DNA
aagcctcgctcccttcct

SEQ ID NO: 9647 - DNA, 25 bp, synthetic construct
  misc_feature 1..25: note = Synthetic Construct
  source 1..25: mol_type = other DNA
gcatggcacacaatgagaagatgag

SEQ ID NO: 9648 - DNA, 20 bp, synthetic construct
  misc_feature 1..20: note = Synthetic Construct
  source 1..20: mol_type = other DNA
tcctgggctcaagggatcct

SEQ ID NO: 9649 - DNA, 25 bp, synthetic construct
  misc_feature 1..25: note = Synthetic Construct
  source 1..25: mol_type = other DNA
atgacaagatgagtctggtttcagt

SEQ ID NO: 9650 - DNA, 28 bp, synthetic construct
  misc_feature 1..28: note = Synthetic Construct
  source 1..28: mol_type = other DNA
gctgtccaaaaaatattctcctgtccat

SEQ ID NO: 9651 - DNA, 20 bp, synthetic construct
  misc_feature 1..20: note = Synthetic Construct
  source 1..20: mol_type = other DNA
gtggagccacaacagcaaga

SEQ ID NO: 9652 - DNA, 26 bp, synthetic construct
  misc_feature 1..26: note = Synthetic Construct
  source 1..26: mol_type = other DNA
ccccaaaatagtcgaaggttcaaagc

SEQ ID NO: 9653 - DNA, 30 bp, synthetic construct
  misc_feature 1..30: note = Synthetic Construct
  source 1..30: mol_type = other DNA
tccttaggtacttattattgcacacaagta

SEQ ID NO: 9654 - DNA, 24 bp, synthetic construct
  misc_feature 1..24: note = Synthetic Construct
  source 1..24: mol_type = other DNA
aggcaccctctctctagattcaac

SEQ ID NO: 9655 - DNA, 28 bp, synthetic construct
  misc_feature 1..28: note = Synthetic Construct
  source 1..28: mol_type = other DNA
ctgagtgacttatgactcagtttttctg

SEQ ID NO: 9656 - DNA, 22 bp, synthetic construct
  misc_feature 1..22: note = Synthetic Construct
  source 1..22: mol_type = other DNA
cacccctacgtgttcaatcagt

SEQ ID NO: 9657 - DNA, 22 bp, synthetic construct
  misc_feature 1..22: note = Synthetic Construct
  source 1..22: mol_type = other DNA
gcaggtgcatagctgggacaga

SEQ ID NO: 9658 - DNA, 27 bp, synthetic construct
  misc_feature 1..27: note = Synthetic Construct
  source 1..27: mol_type = other DNA
ggcattaccctaggaattcaggaagaa

SEQ ID NO: 9659 - DNA, 22 bp, synthetic construct
  misc_feature 1..22: note = Synthetic Construct
  source 1..22: mol_type = other DNA
gacctggaaattaggcccttca

SEQ ID NO: 9660 - DNA, 30 bp, synthetic construct
  misc_feature 1..30: note = Synthetic Construct
  source 1..30: mol_type = other DNA
gcagtcttcaaaaatttttaagggcagatt

SEQ ID NO: 9661 - DNA, 22 bp, synthetic construct
  misc_feature 1..22: note = Synthetic Construct
  source 1..22: mol_type = other DNA
agttcaggctgcagtacagttg

SEQ ID NO: 9662 - DNA, 24 bp, synthetic construct
  misc_feature 1..24: note = Synthetic Construct
  source 1..24: mol_type = other DNA
ggagatagagggcctatccttcct

SEQ ID NO: 9663 - DNA, 22 bp, synthetic construct
  misc_feature 1..22: note = Synthetic Construct
  source 1..22: mol_type = other DNA
tctgctcacaacctagcaacct

SEQ ID NO: 9664 - DNA, 23 bp, synthetic construct
  misc_feature 1..23: note = Synthetic Construct
  source 1..23: mol_type = other DNA
tcctcctttctcccccaactagt

SEQ ID NO: 9665 - DNA, 30 bp, synthetic construct
  misc_feature 1..30: note = Synthetic Construct
  source 1..30: mol_type = other DNA
gtagagcagatgtttgtaatatgggtttta

SEQ ID NO: 9666 - DNA, 23 bp, synthetic construct
  misc_feature 1..23: note = Synthetic Construct
  source 1..23: mol_type = other DNA
ggttcaacagagctgagatctga

SEQ ID NO: 9667 - DNA, 20 bp, synthetic construct
  misc_feature 1..20: note = Synthetic Construct
  source 1..20: mol_type = other DNA
tccccaccacccatcttgat

SEQ ID NO: 9668 - DNA, 25 bp, synthetic construct
  misc_feature 1..25: note = Synthetic Construct
  source 1..25: mol_type = other DNA
ctagactgagtcatgcattctcaca

SEQ ID NO: 9669 - DNA, 23 bp, synthetic construct
  misc_feature 1..23: note = Synthetic Construct
  source 1..23: mol_type = other DNA
aatcctgactcccaaagcatcaa

SEQ ID NO: 9670 - DNA, 25 bp, synthetic construct
  misc_feature 1..25: note = Synthetic Construct
  source 1..25: mol_type = other DNA
ttaagggaagggcataggaaaaagt

SEQ ID NO: 9671 - DNA, 24 bp, synthetic construct
  misc_feature 1..24: note = Synthetic Construct
  source 1..24: mol_type = other DNA
gcacttcccacagattaggaacca

SEQ ID NO: 9672 - DNA, 19 bp, synthetic construct
  misc_feature 1..19: note = Synthetic Construct
  source 1..19: mol_type = other DNA
tccaggtctgggcccacaa

SEQ ID NO: 9673 - DNA, 25 bp, synthetic construct
  misc_feature 1..25: note = Synthetic Construct
  source 1..25: mol_type = other DNA
tccttgtctaatacccctgcaattt

SEQ ID NO: 9674 - DNA, 25 bp, synthetic construct
  misc_feature 1..25: note = Synthetic Construct
  source 1..25: mol_type = other DNA
ggagttgctcaaattcttggagcaa

SEQ ID NO: 9675 - DNA, 26 bp, synthetic construct
  misc_feature 1..26: note = Synthetic Construct
  source 1..26: mol_type = other DNA
ccactgacatcatttttcaggtcttg

SEQ ID NO: 9676 - DNA, 19 bp, synthetic construct
  misc_feature 1..19: note = Synthetic Construct
  source 1..19: mol_type = other DNA
gcctctgcagtgggatcag

SEQ ID NO: 9677 - DNA, 22 bp, synthetic construct
  misc_feature 1..22: note = Synthetic Construct
  source 1..22: mol_type = other DNA
tgagtaactgtggccactgaga

SEQ ID NO: 9678 - DNA, 22 bp, synthetic construct
  misc_feature 1..22: note = Synthetic Construct
  source 1..22: mol_type = other DNA
tcctggggccaagactcctaaa

SEQ ID NO: 9679 - DNA, 29 bp, synthetic construct
  misc_feature 1..29: note = Synthetic Construct
  source 1..29: mol_type = other DNA
gcttcagaaatgatatgtgttcaagagta

SEQ ID NO: 9680 - DNA, 22 bp, synthetic construct
  misc_feature 1..22: note = Synthetic Construct
  source 1..22: mol_type = other DNA
ccgctctacaggtttcaacagt

SEQ ID NO: 9681 - DNA, 26 bp, synthetic construct
  misc_feature 1..26: note = Synthetic Construct
  source 1..26: mol_type = other DNA
gctctctgtttacttccagtgttcca

SEQ ID NO: 9682 - DNA, 23 bp, synthetic construct
  misc_feature 1..23: note = Synthetic Construct
  source 1..23: mol_type = other DNA
gcttttaccccaactgtctcact

SEQ ID NO: 9683 - DNA, 22 bp, synthetic construct
  misc_feature 1..22: note = Synthetic Construct
  source 1..22: mol_type = other DNA
agccttcactggattgcctatc

SEQ ID NO: 9684 - DNA, 18 bp, synthetic construct
  misc_feature 1..18: note = Synthetic Construct
  source 1..18: mol_type = other DNA
aggtgcctgccctaacct

SEQ ID NO: 9685 - DNA, 26 bp, synthetic construct
  misc_feature 1..26: note = Synthetic Construct
  source 1..26: mol_type = other DNA
cttgcatttcctatgtaatggccaaa

SEQ ID NO: 9686 - DNA, 23 bp, synthetic construct
  misc_feature 1..23: note = Synthetic Construct
  source 1..23: mol_type = other DNA
agattgtcacatgggcatgttgt

SEQ ID NO: 9687 - DNA, 24 bp, synthetic construct
  misc_feature 1..24: note = Synthetic Construct
  source 1..24: mol_type = other DNA
gaaatcttgctggtgggattcagt

SEQ ID NO: 9688 - DNA, 28 bp, synthetic construct
  misc_feature 1..28: note = Synthetic Construct
  source 1..28: mol_type = other DNA
caatacagatttgaggggatcagaattg

SEQ ID NO: 9689 - DNA, 27 bp, synthetic construct
  misc_feature 1..27: note = Synthetic Construct
  source 1..27: mol_type = other DNA
gcaactgcattagtggtattcatgtca

SEQ ID NO: 9690 - DNA, 20 bp, synthetic construct
  misc_feature 1..20: note = Synthetic Construct
  source 1..20: mol_type = other DNA
gcccaggatcctgcactagt

SEQ ID NO: 9691 - DNA, 19 bp, synthetic construct
  misc_feature 1..19: note = Synthetic Construct
  source 1..19: mol_type = other DNA
agggaggcgcctggcatct

SEQ ID NO: 9692 - DNA, 22 bp, synthetic construct
  misc_feature 1..22: note = Synthetic Construct
  source 1..22: mol_type = other DNA
accagactgaaagccagaagac

SEQ ID NO: 9693 - DNA, 25 bp, synthetic construct
  misc_feature 1..25: note = Synthetic Construct
  source 1..25: mol_type = other DNA
ggtgtcagataacctgagagccatt

SEQ ID NO: 9694 - DNA, 24 bp, synthetic construct
  misc_feature 1..24: note = Synthetic Construct
  source 1..24: mol_type = other DNA
ccagcctaaggactgtgtaagaag

SEQ ID NO: 9695 - DNA, 27 bp, synthetic construct
  misc_feature 1..27: note = Synthetic Construct
  source 1..27: mol_type = other DNA
cacagttcaatctgtaatagcttgctt

SEQ ID NO: 9696 - DNA, 23 bp, synthetic construct
  misc_feature 1..23: note = Synthetic Construct
  source 1..23: mol_type = other DNA
gctgcaaatccattctccttctc

SEQ ID NO: 9697 - DNA, 25 bp, synthetic construct
  misc_feature 1..25: note = Synthetic Construct
  source 1..25: mol_type = other DNA
ctgattctgccacctatactgaact

SEQ ID NO: 9698 - DNA, 24 bp, synthetic construct
  misc_feature 1..24: note = Synthetic Construct
  source 1..24: mol_type = other DNA
gctggagaagctggaaaggagttt

SEQ ID NO: 9699 - DNA, 22 bp, synthetic construct
  misc_feature 1..22: note = Synthetic Construct
  source 1..22: mol_type = other DNA
ggccccaggaaaaacggaaaat

SEQ ID NO: 9700 - DNA, 21 bp, synthetic construct
  misc_feature 1..21: note = Synthetic Construct
  source 1..21: mol_type = other DNA
ctggggttgagagtgggtaga

SEQ ID NO: 9701 - DNA, 22 bp, synthetic construct
  misc_feature 1..22: note = Synthetic Construct
  source 1..22: mol_type = other DNA
cctaacccctgcctttctagca

SEQ ID NO: 9702 - DNA, 30 bp, synthetic construct
  misc_feature 1..30: note = Synthetic Construct
  source 1..30: mol_type = other DNA
gcagatcacttaccttaggatagcatacac

SEQ ID NO: 9703 - DNA, 19 bp, synthetic construct
  misc_feature 1..19: note = Synthetic Construct
  source 1..19: mol_type = other DNA
gccccagccgtcacattct

SEQ ID NO: 9704 - DNA, 30 bp, synthetic construct
  misc_feature 1..30: note = Synthetic Construct
  source 1..30: mol_type = other DNA
gttttaaggcaaagacagagaattcattga

SEQ ID NO: 9705 - DNA, 22 bp, synthetic construct
  misc_feature 1..22: note = Synthetic Construct
  source 1..22: mol_type = other DNA
gcctgaatcccatgcctaccaa

SEQ ID NO: 9706 - DNA, 19 bp, synthetic construct
  misc_feature 1..19: note = Synthetic Construct
  source 1..19: mol_type = other DNA
atggcaggggcggggtaca

SEQ ID NO: 9707 - DNA, 26 bp, synthetic construct
  misc_feature 1..26: note = Synthetic Construct
  source 1..26: mol_type = other DNA
ccaagccataaatgcactaggattgc

SEQ ID NO: 9708 - DNA, 23 bp, synthetic construct
  misc_feature 1..23: note = Synthetic Construct
  source 1..23: mol_type = other DNA
ctctcaaaccggaactcatttgc

SEQ ID NO: 9709 - DNA, 22 bp, synthetic construct
  misc_feature 1..22: note = Synthetic Construct
  source 1..22: mol_type = other DNA
aaggtcttctgagagggaaggt

SEQ ID NO: 9710 - DNA, 28 bp, synthetic construct
  misc_feature 1..28: note = Synthetic Construct
  source 1..28: mol_type = other DNA
tgtggaacagagcaatttaaatggaaat

SEQ ID NO: 9711 - DNA, 23 bp, synthetic construct
  misc_feature 1..23: note = Synthetic Construct
  source 1..23: mol_type = other DNA
gtccacagattgatcaccatgca

SEQ ID NO: 9712 - DNA, 30 bp, synthetic construct
  misc_feature 1..30: note = Synthetic Construct
  source 1..30: mol_type = other DNA
ctgcttaatcatttgggttaagtggtatta

SEQ ID NO: 9713 - DNA, 27 bp, synthetic construct
  misc_feature 1..27: note = Synthetic Construct
  source 1..27: mol_type = other DNA
acttcagacaagtatagctcccagctt

SEQ ID NO: 9714 - DNA, 22 bp, synthetic construct
  misc_feature 1..22: note = Synthetic Construct
  source 1..22: mol_type = other DNA
ctggggtcatggtttcaaggaa

SEQ ID NO: 9715 - DNA, 22 bp, synthetic construct
  misc_feature 1..22: note = Synthetic Construct
  source 1..22: mol_type = other DNA
gctgtgttgagaacaggctgaa

SEQ ID NO: 9716 - DNA, 22 bp, synthetic construct
  misc_feature 1..22: note = Synthetic Construct
  source 1..22: mol_type = other DNA
aggcttagtctggcagcttgtt

SEQ ID NO: 9717 - DNA, 30 bp, synthetic construct
  misc_feature 1..30: note = Synthetic Construct
  source 1..30: mol_type = other DNA
gcaaaagagctatatctccattctattcac

SEQ ID NO: 9718 - DNA, 25 bp, synthetic construct
  misc_feature 1..25: note = Synthetic Construct
  source 1..25: mol_type = other DNA
ggaaaaggaggtacaggagagaaaa

SEQ ID NO: 9719 - DNA, 28 bp, synthetic construct
  misc_feature 1..28: note = Synthetic Construct
  source 1..28: mol_type = other DNA
ggatgtatagggacagttttcctgaaag

SEQ ID NO: 9720 - DNA, 25 bp, synthetic construct
  misc_feature 1..25: note = Synthetic Construct
  source 1..25: mol_type = other DNA
cctgatgcctgtctgatttgaactg

SEQ ID NO: 9721 - DNA, 22 bp, synthetic construct
  misc_feature 1..22: note = Synthetic Construct
  source 1..22: mol_type = other DNA
actcctgggctcaagtaatcct

SEQ ID NO: 9722 - DNA, 20 bp, synthetic construct
  misc_feature 1..20: note = Synthetic Construct
  source 1..20: mol_type = other DNA
actcccagcaccaagtcagt

SEQ ID NO: 9723 - DNA, 22 bp, synthetic construct
  misc_feature 1..22: note = Synthetic Construct
  source 1..22: mol_type = other DNA
agcaatgtgaccagggtgaagt

SEQ ID NO: 9724 - DNA, 28 bp, synthetic construct
  misc_feature 1..28: note = Synthetic Construct
  source 1..28: mol_type = other DNA
ctacagaatttagttgtggggaactaga

SEQ ID NO: 9725 - DNA, 24 bp, synthetic construct
  misc_feature 1..24: note = Synthetic Construct
  source 1..24: mol_type = other DNA
aggaaactgagaactgtcctctct

SEQ ID NO: 9726 - DNA, 29 bp, synthetic construct
  misc_feature 1..29: note = Synthetic Construct
  source 1..29: mol_type = other DNA
tggagtgttcatataccctttgaagataa

SEQ ID NO: 9727 - DNA, 20 bp, synthetic construct
  misc_feature 1..20: note = Synthetic Construct
  source 1..20: mol_type = other DNA
gcgaaaaacacgcccttgat

SEQ ID NO: 9728 - DNA, 28 bp, synthetic construct
  misc_feature 1..28: note = Synthetic Construct
  source 1..28: mol_type = other DNA
agcatttcagtccatagtaaacaagaag

SEQ ID NO: 9729 - DNA, 23 bp, synthetic construct
  misc_feature 1..23: note = Synthetic Construct
  source 1..23: mol_type = other DNA
agccaggtcctttccttcaaagc

SEQ ID NO: 9730 - DNA, 30 bp, synthetic construct
  misc_feature 1..30: note = Synthetic Construct
  source 1..30: mol_type = other DNA
gatttataatgtaaaggcttgctctgtttg

SEQ ID NO: 9731 - DNA, 24 bp, synthetic construct
  misc_feature 1..24: note = Synthetic Construct
  source 1..24: mol_type = other DNA
gctacgaacacaagaaggctttcc

SEQ ID NO: 9732 - DNA, 24 bp, synthetic construct
  misc_feature 1..24: note = Synthetic Construct
  source 1..24: mol_type = other DNA
cccaagtagctggaactataagca

SEQ ID NO: 9733 - DNA, 26 bp, synthetic construct
  misc_feature 1..26: note = Synthetic Construct
  source 1..26: mol_type = other DNA
agtagttacagtcatccctccttacc

SEQ ID NO: 9734 - DNA, 22 bp, synthetic construct
  misc_feature 1..22: note = Synthetic Construct
  source 1..22: mol_type = other DNA
tgtaggacacggggtaggaaat

SEQ ID NO: 9735 - DNA, 22 bp, synthetic construct
  misc_feature 1..22: note = Synthetic Construct
  source 1..22: mol_type = other DNA
gccctaggagtgttaacagctt

SEQ ID NO: 9736 - DNA, 26 bp, synthetic construct
  misc_feature 1..26: note = Synthetic Construct
  source 1..26: mol_type = other DNA
cacaaccagaagatgatatccaggtt

SEQ ID NO: 9737 - DNA, 29 bp, synthetic construct
  misc_feature 1..29: note = Synthetic Construct
  source 1..29: mol_type = other DNA
gcactcaaatctaattaacggctacaaca

SEQ ID NO: 9738 - DNA, 19 bp, synthetic construct
  misc_feature 1..19: note = Synthetic Construct
  source 1..19: mol_type = other DNA
gccaagggtggtgcagtgt

SEQ ID NO: 9739 - DNA, 18 bp, synthetic construct
  misc_feature 1..18: note = Synthetic Construct
  source 1..18: mol_type = other DNA
gccagcctctgccaggta

SEQ ID NO: 9740 - DNA, 20 bp, synthetic construct
  misc_feature 1..20: note = Synthetic Construct
  source 1..20: mol_type = other DNA
gcatgggaagcgaccattgg

SEQ ID NO: 9741 - DNA, 26 bp, synthetic construct
  misc_feature 1..26: note = Synthetic Construct
  source 1..26: mol_type = other DNA
ttccagtaggagttgtgtgaatgtta

SEQ ID NO: 9742 - DNA, 30 bp, synthetic construct
  misc_feature 1..30: note = Synthetic Construct
  source 1..30: mol_type = other DNA
gtcaatcttaacacttcatatgtggagaac

SEQ ID NO: 9743 - DNA, 22 bp, synthetic construct
  misc_feature 1..22: note = Synthetic Construct
  source 1..22: mol_type = other DNA
gaacccaatcccttgcaatggt

SEQ ID NO: 9744 - DNA, 27 bp, synthetic construct
  misc_feature 1..27: note = Synthetic Construct
  source 1..27: mol_type = other DNA
gaaaccctataagctagaagggatcag

SEQ ID NO: 9745 - DNA, 27 bp, synthetic construct
  misc_feature 1..27: note = Synthetic Construct
  source 1..27: mol_type = other DNA
gtttcaggtaaagccctgttactatgt

SEQ ID NO: 9746 - DNA, 25 bp, synthetic construct
  misc_feature 1..25: note = Synthetic Construct
  source 1..25: mol_type = other DNA
gtcttgccttgtttgggtaatacca

SEQ ID NO: 9747 - DNA, 20 bp, synthetic construct
  misc_feature 1..20: note = Synthetic Construct
  source 1..20: mol_type = other DNA
tgctggtggtgggttgatga

SEQ ID NO: 9748 - DNA, 24 bp, synthetic construct
  misc_feature 1..24: note = Synthetic Construct
  source 1..24: mol_type = other DNA
accctctcctgatcccactttacc

SEQ ID NO: 9749 - DNA, 29 bp, synthetic construct
  misc_feature 1..29: note = Synthetic Construct
  source 1..29: mol_type = other DNA
gaagaaatcttaagtccttactgctttgt

SEQ ID NO: 9750 - DNA, 22 bp, synthetic construct
  misc_feature 1..22: note = Synthetic Construct
  source 1..22: mol_type = other DNA
gagggaggtgtcctcatagtct

SEQ ID NO: 9751 - DNA, 20 bp, synthetic construct
  misc_feature 1..20: note = Synthetic Construct
  source 1..20: mol_type = other DNA
ccacgcgatgctgtctcatc

SEQ ID NO: 9752 - DNA, 29 bp, synthetic construct
  misc_feature 1..29: note = Synthetic Construct
  source 1..29: mol_type = other DNA
ggaatctaaaaggaaatactggtggttct

SEQ ID NO: 9753 - DNA, 22 bp, synthetic construct
  misc_feature 1..22: note = Synthetic Construct
  source 1..22: mol_type = other DNA
aacagccctggataaggcaaga

SEQ ID NO: 9754 - DNA, 29 bp, synthetic construct
  misc_feature 1..29: note = Synthetic Construct
  source 1..29: mol_type = other DNA
tgacttaaagtagctatggcagagatatt

SEQ ID NO: 9755 - DNA, 22 bp, synthetic construct
  misc_feature 1..22: note = Synthetic Construct
  source 1..22: mol_type = other DNA
gctccccaaatcagctctagca

SEQ ID NO: 9756 - DNA, 21 bp, synthetic construct
  misc_feature 1..21: note = Synthetic Construct
  source 1..21: mol_type = other DNA
cgtctggtgtggtttgctaga

SEQ ID NO: 9757 - DNA, 23 bp, synthetic construct
  misc_feature 1..23: note = Synthetic Construct
  source 1..23: mol_type = other DNA
tgctaggacctgttgactgaaga

SEQ ID NO: 9758 - DNA, 22 bp, synthetic construct
  misc_feature 1..22: note = Synthetic Construct
  source 1..22: mol_type = other DNA
aagacagcctgagaagcacaga

SEQ ID NO: 9759 - DNA, 26 bp, synthetic construct
  misc_feature 1..26: note = Synthetic Construct
  source 1..26: mol_type = other DNA
caacactagctttttttctccttggt

SEQ ID NO: 9760 - DNA, 20 bp, synthetic construct
  misc_feature 1..20: note = Synthetic Construct
  source 1..20: mol_type = other DNA
tctgtggctgggaggaaacc

SEQ ID NO: 9761 - DNA, 28 bp, synthetic construct
  misc_feature 1..28: note = Synthetic Construct
  source 1..28: mol_type = other DNA
ggtttgaatttacatgcatcaggtgtac

SEQ ID NO: 9762 - DNA, 24 bp, synthetic construct
  misc_feature 1..24: note = Synthetic Construct
  source 1..24: mol_type = other DNA
gacagagggtctcagtatcaagct

SEQ ID NO: 9763 - DNA, 22 bp, synthetic construct
  misc_feature 1..22: note = Synthetic Construct
  source 1..22: mol_type = other DNA
cgtggccattttcctgaaccta

SEQ ID NO: 9764 - DNA, 21 bp, synthetic construct
  misc_feature 1..21: note = Synthetic Construct
  source 1..21: mol_type = other DNA
ctccagctgctctgtcttcag

SEQ ID NO: 9765 - DNA, 30 bp, synthetic construct
  misc_feature 1..30: note = Synthetic Construct
  source 1..30: mol_type = other DNA
agtagaaagctctaggaggtttatattgtg

SEQ ID NO: 9766 - DNA, 20 bp, synthetic construct
  misc_feature 1..20: note = Synthetic Construct
  source 1..20: mol_type = other DNA
ctgccccaagttctgtggat

SEQ ID NO: 9767 - DNA, 27 bp, synthetic construct
  misc_feature 1..27: note = Synthetic Construct
  source 1..27: mol_type = other DNA
gagctttgatgtttgtgagctctattt

SEQ ID NO: 9768 - DNA, 19 bp, synthetic construct
  misc_feature 1..19: note = Synthetic Construct
  source 1..19: mol_type = other DNA
agttgcctggctggtttgg

SEQ ID NO: 9769 - DNA, 18 bp, synthetic construct
  misc_feature 1..18: note = Synthetic Construct
  source 1..18: mol_type = other DNA
agcctctgtggggcatgt

SEQ ID NO: 9770 - DNA, 21 bp, synthetic construct
  misc_feature 1..21: note = Synthetic Construct
  source 1..21: mol_type = other DNA
tgggacacacatctgctagga

SEQ ID NO: 9771 - DNA, 24 bp, synthetic construct
  misc_feature 1..24: note = Synthetic Construct
  source 1..24: mol_type = other DNA
gatctccctgcttctacccttaac

SEQ ID NO: 9772 - DNA, 18 bp, synthetic construct
  misc_feature 1..18: note = Synthetic Construct
  source 1..18: mol_type = other DNA
tacgggctgggacatggt

SEQ ID NO: 9773 - DNA, 19 bp, synthetic construct
  misc_feature 1..19: note = Synthetic Construct
  source 1..19: mol_type = other DNA
tgggtgactgaggctgact

SEQ ID NO: 9774 - DNA, 18 bp, synthetic construct
  misc_feature 1..18: note = Synthetic Construct
  source 1..18: mol_type = other DNA
cagtgcagcccccatgct

SEQ ID NO: 9775 - DNA, 30 bp, synthetic construct
  misc_feature 1..30: note = Synthetic Construct
  source 1..30: mol_type = other DNA
cagactcctctgcttataagaattatacca

SEQ ID NO: 9776 - DNA, 24 bp, synthetic construct
  misc_feature 1..24: note = Synthetic Construct
  source 1..24: mol_type = other DNA
gggtcttggagtagatggtttgga

SEQ ID NO: 9777 - DNA, 23 bp, synthetic construct
  misc_feature 1..23: note = Synthetic Construct
  source 1..23: mol_type = other DNA
atcagcctctctcagaactcaga

SEQ ID NO: 9778 - DNA, 25 bp, synthetic construct
  misc_feature 1..25: note = Synthetic Construct
  source 1..25: mol_type = other DNA
gtcgttggaaatacaaagccactaa

SEQ ID NO: 9779 - DNA, 26 bp, synthetic construct
  misc_feature 1..26: note = Synthetic Construct
  source 1..26: mol_type = other DNA
ctgggcaatcataaagatctcaaggt

SEQ ID NO: 9780 - DNA, 23 bp, synthetic construct
  misc_feature 1..23: note = Synthetic Construct
  source 1..23: mol_type = other DNA
tctcacacattgtttccccaagt

SEQ ID NO: 9781 - DNA, 25 bp, synthetic construct
  misc_feature 1..25: note = Synthetic Construct
  source 1..25: mol_type = other DNA
ggctgggtcactttgatctccttat

SEQ ID NO: 9782 - DNA, 27 bp, synthetic construct
  misc_feature 1..27: note = Synthetic Construct
  source 1..27: mol_type = other DNA
cccacctttcatcttttaccacaagct

SEQ ID NO: 9783 - DNA, 22 bp, synthetic construct
  misc_feature 1..22: note = Synthetic Construct
  source 1..22: mol_type = other DNA
gaaagtggtgatttgccaacca

SEQ ID NO: 9784 - DNA, 30 bp, synthetic construct
  misc_feature 1..30: note = Synthetic Construct
  source 1..30: mol_type = other DNA
ttgattaattaccacacagtgaatacacat

SEQ ID NO: 9785 - DNA, 25 bp, synthetic construct
  misc_feature 1..25: note = Synthetic Construct
  source 1..25: mol_type = other DNA
aaggcaaattctctctctagagcaa

SEQ ID NO: 9786 - DNA, 20 bp, synthetic construct
  misc_feature 1..20: note = Synthetic Construct
  source 1..20: mol_type = other DNA
tgcgatggctcatgcttctg

SEQ ID NO: 9787 - DNA, 22 bp, synthetic construct
  misc_feature 1..22: note = Synthetic Construct
  source 1..22: mol_type = other DNA
gccgccctacagattcctaact

SEQ ID NO: 9788 - DNA, 19 bp, synthetic construct
  misc_feature 1..19: note = Synthetic Construct
  source 1..19: mol_type = other DNA
aagggccagccacctgcaa

SEQ ID NO: 9789 - DNA, 20 bp, synthetic construct
  misc_feature 1..20: note = Synthetic Construct
  source 1..20: mol_type = other DNA
gctcatcggtgcccaaagtc

SEQ ID NO: 9790 - DNA, 22 bp, synthetic construct
  misc_feature 1..22: note = Synthetic Construct
  source 1..22: mol_type = other DNA
gggcaggacgagagaagaaaaa

SEQ ID NO: 9791 - DNA, 25 bp, synthetic construct
  misc_feature 1..25: note = Synthetic Construct
  source 1..25: mol_type = other DNA
gagaaagtgaaatgcgcaaatgtga

SEQ ID NO: 9792 - DNA, 27 bp, synthetic construct
  misc_feature 1..27: note = Synthetic Construct
  source 1..27: mol_type = other DNA
aaattgctgggtaaaacatcgaataca

SEQ ID NO: 9793 - DNA, 22 bp, synthetic construct
  misc_feature 1..22: note = Synthetic Construct
  source 1..22: mol_type = other DNA
tgcccgagaatctcctggtgaa

SEQ ID NO: 9794 - DNA, 27 bp, synthetic construct
  misc_feature 1..27: note = Synthetic Construct
  source 1..27: mol_type = other DNA
aggtcttcaatgtgttgtaatcactga

SEQ ID NO: 9795 - DNA, 26 bp, synthetic construct
  misc_feature 1..26: note = Synthetic Construct
  source 1..26: mol_type = other DNA
gagaaggcccatttttacatcaggaa

SEQ ID NO: 9796 - DNA, 25 bp, synthetic construct
  misc_feature 1..25: note = Synthetic Construct
  source 1..25: mol_type = other DNA
ccatcctgtctccattcatcatggt

SEQ ID NO: 9797 - DNA, 24 bp, synthetic construct
  misc_feature 1..24: note = Synthetic Construct
  source 1..24: mol_type = other DNA
ggaaaaatggatcttgctcatgca

SEQ ID NO: 9798 - DNA, 19 bp, synthetic construct
  misc_feature 1..19: note = Synthetic Construct
  source 1..19: mol_type = other DNA
tgcatgcccaggctgatct

SEQ ID NO: 9799 - DNA, 27 bp, synthetic construct
  misc_feature 1..27: note = Synthetic Construct
  source 1..27: mol_type = other DNA
cccctttttaggtgtgtaatcctaggt

SEQ ID NO: 9800 - DNA, 29 bp, synthetic construct
  misc_feature 1..29: note = Synthetic Construct
  source 1..29: mol_type = other DNA
acaatttaagggtaaaggaaatgcaattg

SEQ ID NO: 9801 - DNA, 25 bp, synthetic construct
  misc_feature 1..25: note = Synthetic Construct
  source 1..25: mol_type = other DNA
cgtgagtaacccttcacttctgatg

SEQ ID NO: 9802 - DNA, 27 bp, synthetic construct
  misc_feature 1..27: note = Synthetic Construct
  source 1..27: mol_type = other DNA
ggtcaatctttatttgcctacctttca

SEQ ID NO: 9803 - DNA, 22 bp, synthetic construct
  misc_feature 1..22: note = Synthetic Construct
  source 1..22: mol_type = other DNA
agcacctgaagaacgcgattga

SEQ ID NO: 9804 - DNA, 29 bp, synthetic construct
  misc_feature 1..29: note = Synthetic Construct
  source 1..29: mol_type = other DNA
ccaatgaaagaagggactatgtagctcat

SEQ ID NO: 9805 - DNA, 29 bp, synthetic construct
  misc_feature 1..29: note = Synthetic Construct
  source 1..29: mol_type = other DNA
ggttgtttagttagcagagacaatgaaac

SEQ ID NO: 9806 - DNA, 25 bp, synthetic construct
  misc_feature 1..25: note = Synthetic Construct
  source 1..25: mol_type = other DNA
gcacttactatcctggcactattct

SEQ ID NO: 9807 - DNA, 20 bp, synthetic construct
  misc_feature 1..20: note = Synthetic Construct
  source 1..20: mol_type = other DNA
gccacaagccatgcaatgca

SEQ ID NO: 9808 - DNA, 22 bp, synthetic construct
  misc_feature 1..22: note = Synthetic Construct
  source 1..22: mol_type = other DNA
tgccattgggagagtggttgat

SEQ ID NO: 9809 - DNA, 24 bp, synthetic construct
  misc_feature 1..24: note = Synthetic Construct
  source 1..24: mol_type = other DNA
agttgaaatgatctctgcccacat

SEQ ID NO: 9810 - DNA, 19 bp, synthetic construct
  misc_feature 1..19: note = Synthetic Construct
  source 1..19: mol_type = other DNA
agtgtgccgcgatcttcct

SEQ ID NO: 9811 - DNA, 21 bp, synthetic construct
  misc_feature 1..21: note = Synthetic Construct
  source 1..21: mol_type = other DNA
gtcagaggccaccatcacttg

SEQ ID NO: 9812 - DNA, 30 bp, synthetic construct
  misc_feature 1..30: note = Synthetic Construct
  source 1..30: mol_type = other DNA
gctttaaaaataagcactgcatttaattgc

SEQ ID NO: 9813 - DNA, 21 bp, synthetic construct
  misc_feature 1..21: note = Synthetic Construct
  source 1..21: mol_type = other DNA
cccagcagagtgtctggaaca

SEQ ID NO: 9814 - DNA, 23 bp, synthetic construct
  misc_feature 1..23: note = Synthetic Construct
  source 1..23: mol_type = other DNA
gtgatgcttccaacaaggctctt

SEQ ID NO: 9815 - DNA, 30 bp, synthetic construct
  misc_feature 1..30: note = Synthetic Construct
  source 1..30: mol_type = other DNA
actcagaattagctaaattttgcattagga

SEQ ID NO: 9816 - DNA, 24 bp, synthetic construct
  misc_feature 1..24: note = Synthetic Construct
  source 1..24: mol_type = other DNA
gtgaccacatgtgatttccttggt

SEQ ID NO: 9817 - DNA, 24 bp, synthetic construct
  misc_feature 1..24: note = Synthetic Construct
  source 1..24: mol_type = other DNA
acgtctgacatctaccttcaggtt

SEQ ID NO: 9818 - DNA, 22 bp, synthetic construct
  misc_feature 1..22: note = Synthetic Construct
  source 1..22: mol_type = other DNA
tgctgtgagcagacactcttag

SEQ ID NO: 9819 - DNA, 22 bp, synthetic construct
  misc_feature 1..22: note = Synthetic Construct
  source 1..22: mol_type = other DNA
agctttcactgtgggccatatt

SEQ ID NO: 9820 - DNA, 26 bp, synthetic construct
  misc_feature 1..26: note = Synthetic Construct
  source 1..26: mol_type = other DNA
gaaaatggtgaggggattaactcagt

SEQ ID NO: 9821 - DNA, 22 bp, synthetic construct
  misc_feature 1..22: note = Synthetic Construct
  source 1..22: mol_type = other DNA
ctgtgtcggaaagggaaacgat

SEQ ID NO: 9822 - DNA, 20 bp, synthetic construct
  misc_feature 1..20: note = Synthetic Construct
  source 1..20: mol_type = other DNA
aggcagagcacagaggactt

SEQ ID NO: 9823 - DNA, 18 bp, synthetic construct
  misc_feature 1..18: note = Synthetic Construct
  source 1..18: mol_type = other DNA
gcccaggctggtcttgca

SEQ ID NO: 9824 - DNA, 24 bp, synthetic construct
  misc_feature 1..24: note = Synthetic Construct
  source 1..24: mol_type = other DNA
acttgactgccctagctaaaaagg

SEQ ID NO: 9825 - DNA, 28 bp, synthetic construct
  misc_feature 1..28: note = Synthetic Construct
  source 1..28: mol_type = other DNA
ggcatcagcatttgtgactaagtttacc

SEQ ID NO: 9826 - DNA, 24 bp, synthetic construct
  misc_feature 1..24: note = Synthetic Construct
  source 1..24: mol_type = other DNA
tccagcttcctctccatcaaaatg

SEQ ID NO: 9827 - DNA, 19 bp, synthetic construct
  misc_feature 1..19: note = Synthetic Construct
  source 1..19: mol_type = other DNA
tgcccatgggtcccaagat

SEQ ID NO: 9828 - DNA, 26 bp, synthetic construct
  misc_feature 1..26: note = Synthetic Construct
  source 1..26: mol_type = other DNA
ccaagatactgtgctctgtactgaga

SEQ ID NO: 9829 - DNA, 21 bp, synthetic construct
  misc_feature 1..21: note = Synthetic Construct
  source 1..21: mol_type = other DNA
atggccacccaagttctcttg

SEQ ID NO: 9830 - DNA, 20 bp, synthetic construct
  misc_feature 1..20: note = Synthetic Construct
  source 1..20: mol_type = other DNA
gcattggtacaggccgttca

SEQ ID NO: 9831 - DNA, 18 bp, synthetic construct
  misc_feature 1..18: note = Synthetic Construct
  source 1..18: mol_type = other DNA
tggcagctcccacacaca

SEQ ID NO: 9832 - DNA, 23 bp, synthetic construct
  misc_feature 1..23: note = Synthetic Construct
  source 1..23: mol_type = other DNA
agtggacatccctgcttatcagt

SEQ ID NO: 9833 - DNA, 24 bp, synthetic construct
  misc_feature 1..24: note = Synthetic Construct
  source 1..24: mol_type = other DNA
ggcagagaacagcaaatgcaaagg

SEQ ID NO: 9834 - DNA, 19 bp, synthetic construct
  misc_feature 1..19: note = Synthetic Construct
  source 1..19: mol_type = other DNA
agggcaggtgtcagcagaa

SEQ ID NO: 9835 - DNA, 23 bp, synthetic construct
  misc_feature 1..23: note = Synthetic Construct
  source 1..23: mol_type = other DNA
tgagtcctagaggagcagtgagt

SEQ ID NO: 9836 - DNA, 23 bp, synthetic construct
  misc_feature 1..23: note = Synthetic Construct
  source 1..23: mol_type = other DNA
gcttgttgctgcaacacagtgat

SEQ ID NO: 9837 - DNA, 27 bp, synthetic construct
  misc_feature 1..27: note = Synthetic Construct
  source 1..27: mol_type = other DNA
gctgagctgttttctcttaaagcaaca

SEQ ID NO: 9838 - DNA, 21 bp, synthetic construct
  misc_feature 1..21: note = Synthetic Construct
  source 1..21: mol_type = other DNA
tttggcctgctccttctgtct

SEQ ID NO: 9839 - DNA, 28 bp, synthetic construct
  misc_feature 1..28: note = Synthetic Construct
  source 1..28: mol_type = other DNA
cagccaaaataggaggattctattctgt

SEQ ID NO: 9840 - DNA, 27 bp, synthetic construct
  misc_feature 1..27: note = Synthetic Construct
  source 1..27: mol_type = other DNA
cactcgacgaaagtgagacattatcag

SEQ ID NO: 9841 - DNA, 22 bp, synthetic construct
  misc_feature 1..22: note = Synthetic Construct
  source 1..22: mol_type = other DNA
gctcccacctattcctgaaggt

SEQ ID NO: 9842 - DNA, 26 bp, synthetic construct
  misc_feature 1..26: note = Synthetic Construct
  source 1..26: mol_type = other DNA
gagtagtgggaaatcattctgatcca

SEQ ID NO: 9843 - DNA, 22 bp, synthetic construct
  misc_feature 1..22: note = Synthetic Construct
  source 1..22: mol_type = other DNA
agtagacggggatggcaataca

SEQ ID NO: 9844 - DNA, 24 bp, synthetic construct
  misc_feature 1..24: note = Synthetic Construct
  source 1..24: mol_type = other DNA
ggatttacccgtgaaagtcaagct

SEQ ID NO: 9845 - DNA, 24 bp, synthetic construct
  misc_feature 1..24: note = Synthetic Construct
  source 1..24: mol_type = other DNA
gttccattggcctatgtggaatct

SEQ ID NO: 9846 - DNA, 19 bp, synthetic construct
  misc_feature 1..19: note = Synthetic Construct
  source 1..19: mol_type = other DNA
tggtgtgggcgcctaaact

SEQ ID NO: 9847 - DNA, 23 bp, synthetic construct
  misc_feature 1..23: note = Synthetic Construct
  source 1..23: mol_type = other DNA
cttcatcccagaagtgacatgca

SEQ ID NO: 9848 - DNA, 19 bp, synthetic construct
  misc_feature 1..19: note = Synthetic Construct
  source 1..19: mol_type = other DNA
gggtcacctcccccgaaac

SEQ ID NO: 9849 - DNA, 21 bp, synthetic construct
  misc_feature 1..21: note = Synthetic Construct
  source 1..21: mol_type = other DNA
agcgtcccgatgagataagga

SEQ ID NO: 9850 - DNA, 25 bp, synthetic construct
  misc_feature 1..25: note = Synthetic Construct
  source 1..25: mol_type = other DNA
gcaagagtacttcagaggtgataca

SEQ ID NO: 9851 - DNA, 18 bp, synthetic construct
  misc_feature 1..18: note = Synthetic Construct
  source 1..18: mol_type = other DNA
agctgcctggcacaagct

SEQ ID NO: 9852 - DNA, 22 bp, synthetic construct
  misc_feature 1..22: note = Synthetic Construct
  source 1..22: mol_type = other DNA
gtcaagaaggtgccttgtggta

SEQ ID NO: 9853 - DNA, 27 bp, synthetic construct
  misc_feature 1..27: note = Synthetic Construct
  source 1..27: mol_type = other DNA
gcacaagttgatctaatgcctatttgg

SEQ ID NO: 9854 - DNA, 22 bp, synthetic construct
  misc_feature 1..22: note = Synthetic Construct
  source 1..22: mol_type = other DNA
gcccatgggttctgctttattg

SEQ ID NO: 9855 - DNA, 25 bp, synthetic construct
  misc_feature 1..25: note = Synthetic Construct
  source 1..25: mol_type = other DNA
cactggtcccctttctacatagttg

SEQ ID NO: 9856 - DNA, 30 bp, synthetic construct
  misc_feature 1..30: note = Synthetic Construct
  source 1..30: mol_type = other DNA
aaatctcatagttcattagtatgcgttgtt

SEQ ID NO: 9857 - DNA, 24 bp, synthetic construct
  misc_feature 1..24: note = Synthetic Construct
  source 1..24: mol_type = other DNA
caccacttccatcatggttcatca

SEQ ID NO: 9858 - DNA, 24 bp, synthetic construct
  misc_feature 1..24: note = Synthetic Construct
  source 1..24: mol_type = other DNA
ggcctgaggaattttggctattca

SEQ ID NO: 9859 - DNA, 26 bp, synthetic construct
  misc_feature 1..26: note = Synthetic Construct
  source 1..26: mol_type = other DNA
caactgttccttactccctcttaacc

SEQ ID NO: 9860 - DNA, 21 bp, synthetic construct
  misc_feature 1..21: note = Synthetic Construct
  source 1..21: mol_type = other DNA
ttgtatgcagccctggttcat

SEQ ID NO: 9861 - DNA, 21 bp, synthetic construct
  misc_feature 1..21: note = Synthetic Construct
  source 1..21: mol_type = other DNA
tcttggccacctgtgaaagac

SEQ ID NO: 9862 - DNA, 27 bp, synthetic construct
  misc_feature 1..27: note = Synthetic Construct
  source 1..27: mol_type = other DNA
cctctactccatcttttcacatgtgaa

SEQ ID NO: 9863 - DNA, 22 bp, synthetic construct
  misc_feature 1..22: note = Synthetic Construct
  source 1..22: mol_type = other DNA
aacaagagtggctggtcaacct

SEQ ID NO: 9864 - DNA, 20 bp, synthetic construct
  misc_feature 1..20: note = Synthetic Construct
  source 1..20: mol_type = other DNA
aagccaccccctcctcttca

SEQ ID NO: 9865 - DNA, 27 bp, synthetic construct
  misc_feature 1..27: note = Synthetic Construct
  source 1..27: mol_type = other DNA
gccaagggtcttttgcttatcttttgg

SEQ ID NO: 9866 - DNA, 26 bp, synthetic construct
  misc_feature 1..26: note = Synthetic Construct
  source 1..26: mol_type = other DNA
gccaatatgaaaagctgctccacaaa

SEQ ID NO: 9867 - DNA, 22 bp, synthetic construct
  misc_feature 1..22: note = Synthetic Construct
  source 1..22: mol_type = other DNA
ctgtgtgggtctcatggagaag

SEQ ID NO: 9868 - DNA, 22 bp, synthetic construct
  misc_feature 1..22: note = Synthetic Construct
  source 1..22: mol_type = other DNA
cacaactcagggccagtcaaat

SEQ ID NO: 9869 - DNA, 25 bp, synthetic construct
  misc_feature 1..25: note = Synthetic Construct
  source 1..25: mol_type = other DNA
ccaggtgccacttcaaatattgaaa

SEQ ID NO: 9870 - DNA, 26 bp, synthetic construct
  misc_feature 1..26: note = Synthetic Construct
  source 1..26: mol_type = other DNA
gcagaaaatgccaaagaaacaatggt

SEQ ID NO: 9871 - DNA, 24 bp, synthetic construct
  misc_feature 1..24: note = Synthetic Construct
  source 1..24: mol_type = other DNA
ccattagacagagattggcactct

SEQ ID NO: 9872 - DNA, 29 bp, synthetic construct
  misc_feature 1..29: note = Synthetic Construct
  source 1..29: mol_type = other DNA
gcccactattaatcttgatgaaacaacac

SEQ ID NO: 9873 - DNA, 27 bp, synthetic construct
  misc_feature 1..27: note = Synthetic Construct
  source 1..27: mol_type = other DNA
cactttttaacattaccctgcagttga

SEQ ID NO: 9874 - DNA, 26 bp, synthetic construct
  misc_feature 1..26: note = Synthetic Construct
  source 1..26: mol_type = other DNA
gaatgtgtgtacatatgggagaggaa

SEQ ID NO: 9875 - DNA, 27 bp, synthetic construct
  misc_feature 1..27: note = Synthetic Construct
  source 1..27: mol_type = other DNA
ggcagaatggaaatacagcaaacagtt

SEQ ID NO: 9876 - DNA, 26 bp, synthetic construct
  misc_feature 1..26: note = Synthetic Construct
  source 1..26: mol_type = other DNA
gagtacgcagcaagtaaaagtaaact

SEQ ID NO: 9877 - DNA, 23 bp, synthetic construct
  misc_feature 1..23: note = Synthetic Construct
  source 1..23: mol_type = other DNA
gtgtgtctgtcttccctctaacc

SEQ ID NO: 9878 - DNA, 27 bp, synthetic construct
  misc_feature 1..27: note = Synthetic Construct
  source 1..27: mol_type = other DNA
caaggatttaccacctctagagatagc

SEQ ID NO: 9879 - DNA, 23 bp, synthetic construct
  misc_feature 1..23: note = Synthetic Construct
  source 1..23: mol_type = other DNA
cagacactgtctgtgagtagcat

SEQ ID NO: 9880 - DNA, 23 bp, synthetic construct
  misc_feature 1..23: note = Synthetic Construct
  source 1..23: mol_type = other DNA
caggacgtttcttcaccacacaa

SEQ ID NO: 9881 - DNA, 26 bp, synthetic construct
  misc_feature 1..26: note = Synthetic Construct
  source 1..26: mol_type = other DNA
tgtatgtgctcaactctatgctgatc

SEQ ID NO: 9882 - DNA, 20 bp, synthetic construct
  misc_feature 1..20: note = Synthetic Construct
  source 1..20: mol_type = other DNA
ggcctggggtcttacatgca

SEQ ID NO: 9883 - DNA, 28 bp, synthetic construct
  misc_feature 1..28: note = Synthetic Construct
  source 1..28: mol_type = other DNA
gagttcgtgaacaaatagagtgtgtaat

SEQ ID NO: 9884 - DNA, 20 bp, synthetic construct
  misc_feature 1..20: note = Synthetic Construct
  source 1..20: mol_type = other DNA
tggggctcaccgctttatgg

SEQ ID NO: 9885 - DNA, 23 bp, synthetic construct
  misc_feature 1..23: note = Synthetic Construct
  source 1..23: mol_type = other DNA
tggaggtgaccgaggaactatac

SEQ ID NO: 9886 - DNA, 19 bp, synthetic construct
  misc_feature 1..19: note = Synthetic Construct
  source 1..19: mol_type = other DNA
gccaagatgccgtctcact

SEQ ID NO: 9887 - DNA, 22 bp, synthetic construct
  misc_feature 1..22: note = Synthetic Construct
  source 1..22: mol_type = other DNA
gactgaaagttgaggggaagca

SEQ ID NO: 9888 - DNA, 25 bp, synthetic construct
  misc_feature 1..25: note = Synthetic Construct
  source 1..25: mol_type = other DNA
tggaatatgaatgtggaggggatga

SEQ ID NO: 9889 - DNA, 24 bp, synthetic construct
  misc_feature 1..24: note = Synthetic Construct
  source 1..24: mol_type = other DNA
ttcctccccaggttaatgagtagt

SEQ ID NO: 9890 - DNA, 22 bp, synthetic construct
  misc_feature 1..22: note = Synthetic Construct
  source 1..22: mol_type = other DNA
gctctgggcttcattcatcaca

SEQ ID NO: 9891 - DNA, 22 bp, synthetic construct
  misc_feature 1..22: note = Synthetic Construct
  source 1..22: mol_type = other DNA
cccttcccttctcacagatgac

SEQ ID NO: 9892 - DNA, 25 bp, synthetic construct
  misc_feature 1..25: note = Synthetic Construct
  source 1..25: mol_type = other DNA
gcaagtctcccatcaagagtttaga

SEQ ID NO: 9893 - DNA, 30 bp, synthetic construct
  misc_feature 1..30: note = Synthetic Construct
  source 1..30: mol_type = other DNA
gaccatcaataggggattctttaattaagc

SEQ ID NO: 9894 - DNA, 25 bp, synthetic construct
  misc_feature 1..25: note = Synthetic Construct
  source 1..25: mol_type = other DNA
gcagaattcacagggcgtttttgtc

SEQ ID NO: 9895 - DNA, 26 bp, synthetic construct
  misc_feature 1..26: note = Synthetic Construct
  source 1..26: mol_type = other DNA
tcccataatgagtcaggtgttctatg

SEQ ID NO: 9896 - DNA, 25 bp, synthetic construct
  misc_feature 1..25: note = Synthetic Construct
  source 1..25: mol_type = other DNA
tctgtagaattcctccaccatcttg

SEQ ID NO: 9897 - DNA, 24 bp, synthetic construct
  misc_feature 1..24: note = Synthetic Construct
  source 1..24: mol_type = other DNA
gctcctgacttattgcctcaaacc

SEQ ID NO: 9898 - DNA, 21 bp, synthetic construct
  misc_feature 1..21: note = Synthetic Construct
  source 1..21: mol_type = other DNA
tctcccttcgctggagattga

SEQ ID NO: 9899 - DNA, 25 bp, synthetic construct
  misc_feature 1..25: note = Synthetic Construct
  source 1..25: mol_type = other DNA
ccttcaaatttcttgccatcaccat

SEQ ID NO: 9900 - DNA, 22 bp, synthetic construct
  misc_feature 1..22: note = Synthetic Construct
  source 1..22: mol_type = other DNA
aggacacagaccatgggcttaa

SEQ ID NO: 9901 - DNA, 24 bp, synthetic construct
  misc_feature 1..24: note = Synthetic Construct
  source 1..24: mol_type = other DNA
agcactacgtgactgtcagaatcc

SEQ ID NO: 9902 - DNA, 20 bp, synthetic construct
  misc_feature 1..20: note = Synthetic Construct
  source 1..20: mol_type = other DNA
acacgccctctacctttcca

SEQ ID NO: 9903 - DNA, 22 bp, synthetic construct
  misc_feature 1..22: note = Synthetic Construct
  source 1..22: mol_type = other DNA
gagcctggctacaacatagtgt

SEQ ID NO: 9904 - DNA, 20 bp, synthetic construct
  misc_feature 1..20: note = Synthetic Construct
  source 1..20: mol_type = other DNA
agggctgaccggtgagttca

SEQ ID NO: 9905 - DNA, 28 bp, synthetic construct
  misc_feature 1..28: note = Synthetic Construct
  source 1..28: mol_type = other DNA
cctggagttaaatctcatctcagactgt

SEQ ID NO: 9906 - DNA, 28 bp, synthetic construct
  misc_feature 1..28: note = Synthetic Construct
  source 1..28: mol_type = other DNA
tcacattgaaatagtgacaacacaactt

SEQ ID NO: 9907 - DNA, 23 bp, synthetic construct
  misc_feature 1..23: note = Synthetic Construct
  source 1..23: mol_type = other DNA
gcagtcgggcagtaagaaatttc

SEQ ID NO: 9908 - DNA, 19 bp, synthetic construct
  misc_feature 1..19: note = Synthetic Construct
  source 1..19: mol_type = other DNA
aggccctgtgtccgaaaga

SEQ ID NO: 9909 - DNA, 19 bp, synthetic construct
  misc_feature 1..19: note = Synthetic Construct
  source 1..19: mol_type = other DNA
aggaaaggaggcggaacca

SEQ ID NO: 9910 - DNA, 22 bp, synthetic construct
  misc_feature 1..22: note = Synthetic Construct
  source 1..22: mol_type = other DNA
gcatgacgttggcacatcactt

SEQ ID NO: 9911 - DNA, 25 bp, synthetic construct
  misc_feature 1..25: note = Synthetic Construct
  source 1..25: mol_type = other DNA
ctctcatcgcaccattgtcttatgg

SEQ ID NO: 9912 - DNA, 26 bp, synthetic construct
  misc_feature 1..26: note = Synthetic Construct
  source 1..26: mol_type = other DNA
gctgctaacagaatcctttctaagca

SEQ ID NO: 9913 - DNA, 28 bp, synthetic construct
  misc_feature 1..28: note = Synthetic Construct
  source 1..28: mol_type = other DNA
cacaagccctaatataacactcttcttg

SEQ ID NO: 9914 - DNA, 20 bp, synthetic construct
  misc_feature 1..20: note = Synthetic Construct
  source 1..20: mol_type = other DNA
atgagccaggcatcctgctt

SEQ ID NO: 9915 - DNA, 18 bp, synthetic construct
  misc_feature 1..18: note = Synthetic Construct
  source 1..18: mol_type = other DNA
tctgtggacccgctgcat

SEQ ID NO: 9916 - DNA, 25 bp, synthetic construct
  misc_feature 1..25: note = Synthetic Construct
  source 1..25: mol_type = other DNA
ctcccaatgtcagttaagcaagtgt

SEQ ID NO: 9917 - DNA, 29 bp, synthetic construct
  misc_feature 1..29: note = Synthetic Construct
  source 1..29: mol_type = other DNA
ctctctctctctgaattttgatgttacct

SEQ ID NO: 9918 - DNA, 23 bp, synthetic construct
  misc_feature 1..23: note = Synthetic Construct
  source 1..23: mol_type = other DNA
gcattcagatgggacctgggtaa

SEQ ID NO: 9919 - DNA, 27 bp, synthetic construct
  misc_feature 1..27: note = Synthetic Construct
  source 1..27: mol_type = other DNA
gttggcatccagatatacagacaaagt

SEQ ID NO: 9920 - DNA, 22 bp, synthetic construct
  misc_feature 1..22: note = Synthetic Construct
  source 1..22: mol_type = other DNA
ggcaaagaacagagagcagtga

SEQ ID NO: 9921 - DNA, 25 bp, synthetic construct
  misc_feature 1..25: note = Synthetic Construct
  source 1..25: mol_type = other DNA
cttctgccatcttagttgtgtgagt

SEQ ID NO: 9922 - DNA, 27 bp, synthetic construct
  misc_feature 1..27: note = Synthetic Construct
  source 1..27: mol_type = other DNA
gcaacaaaacaagtctagatcctgact

SEQ ID NO: 9923 - DNA, 21 bp, synthetic construct
  misc_feature 1..21: note = Synthetic Construct
  source 1..21: mol_type = other DNA
tgggcctctattgctccacaa

SEQ ID NO: 9924 - DNA, 27 bp, synthetic construct
  misc_feature 1..27: note = Synthetic Construct
  source 1..27: mol_type = other DNA
ccacttttcctgaaatacctagatcct

SEQ ID NO: 9925 - DNA, 21 bp, synthetic construct
  misc_feature 1..21: note = Synthetic Construct
  source 1..21: mol_type = other DNA
ccacaggatggctgagaggat

SEQ ID NO: 9926 - DNA, 24 bp, synthetic construct
  misc_feature 1..24: note = Synthetic Construct
  source 1..24: mol_type = other DNA
gtcatccttcattgggtgaatggt

SEQ ID NO: 9927 - DNA, 22 bp, synthetic construct
  misc_feature 1..22: note = Synthetic Construct
  source 1..22: mol_type = other DNA
ttccagcatcgtgggagcattt

SEQ ID NO: 9928 - DNA, 26 bp, synthetic construct
  misc_feature 1..26: note = Synthetic Construct
  source 1..26: mol_type = other DNA
ccttacctctctgctatcacttatgc

SEQ ID NO: 9929 - DNA, 22 bp, synthetic construct
  misc_feature 1..22: note = Synthetic Construct
  source 1..22: mol_type = other DNA
tctcaggacaccatgggaatga

SEQ ID NO: 9930 - DNA, 21 bp, synthetic construct
  misc_feature 1..21: note = Synthetic Construct
  source 1..21: mol_type = other DNA
actgcaggggtttcacttgtg

SEQ ID NO: 9931 - DNA, 26 bp, synthetic construct
  misc_feature 1..26: note = Synthetic Construct
  source 1..26: mol_type = other DNA
gcatgcctgcaatcctaagtattcag

SEQ ID NO: 9932 - DNA, 29 bp, synthetic construct
  misc_feature 1..29: note = Synthetic Construct
  source 1..29: mol_type = other DNA
gcctcaggacttaggtatgatttttagca

SEQ ID NO: 9933 - DNA, 28 bp, synthetic construct
  misc_feature 1..28: note = Synthetic Construct
  source 1..28: mol_type = other DNA
catcaagatgatctttgatgtggaaagt

SEQ ID NO: 9934 - DNA, 22 bp, synthetic construct
  misc_feature 1..22: note = Synthetic Construct
  source 1..22: mol_type = other DNA
ccagctgttgagagtgttgact

SEQ ID NO: 9935 - DNA, 21 bp, synthetic construct
  misc_feature 1..21: note = Synthetic Construct
  source 1..21: mol_type = other DNA
aggtgagctggggagacttag

SEQ ID NO: 9936 - DNA, 26 bp, synthetic construct
  misc_feature 1..26: note = Synthetic Construct
  source 1..26: mol_type = other DNA
ggaaccatgatgagctgaagttcttg

SEQ ID NO: 9937 - DNA, 22 bp, synthetic construct
  misc_feature 1..22: note = Synthetic Construct
  source 1..22: mol_type = other DNA
gcactggcaaaactcaggaaga

SEQ ID NO: 9938 - DNA, 25 bp, synthetic construct
  misc_feature 1..25: note = Synthetic Construct
  source 1..25: mol_type = other DNA
gcagagcctaaaatatttgctgtct

SEQ ID NO: 9939 - DNA, 24 bp, synthetic construct
  misc_feature 1..24: note = Synthetic Construct
  source 1..24: mol_type = other DNA
cagattcacaggcatggtcagaag

SEQ ID NO: 9940 - DNA, 23 bp, synthetic construct
  misc_feature 1..23: note = Synthetic Construct
  source 1..23: mol_type = other DNA
gcttccagaggattccagatgtc

SEQ ID NO: 9941 - DNA, 20 bp, synthetic construct
  misc_feature 1..20: note = Synthetic Construct
  source 1..20: mol_type = other DNA
aggggtgcttggctccatct

SEQ ID NO: 9942 - DNA, 25 bp, synthetic construct
  misc_feature 1..25: note = Synthetic Construct
  source 1..25: mol_type = other DNA
acccagagttaaagccaaaataggt

SEQ ID NO: 9943 - DNA, 22 bp, synthetic construct
  misc_feature 1..22: note = Synthetic Construct
  source 1..22: mol_type = other DNA
ctttgtgactccaagccttcca

SEQ ID NO: 9944 - DNA, 22 bp, synthetic construct
  misc_feature 1..22: note = Synthetic Construct
  source 1..22: mol_type = other DNA
gtggaaggactcaacacccaat

SEQ ID NO: 9945 - DNA, 22 bp, synthetic construct
  misc_feature 1..22: note = Synthetic Construct
  source 1..22: mol_type = other DNA
ctgcttccagtgctctaagtga

SEQ ID NO: 9946 - DNA, 25 bp, synthetic construct
  misc_feature 1..25: note = Synthetic Construct
  source 1..25: mol_type = other DNA
gttgatgaacctgttaatgcacgta

SEQ ID NO: 9947 - DNA, 24 bp, synthetic construct
  misc_feature 1..24: note = Synthetic Construct
  source 1..24: mol_type = other DNA
cagtctgttgcactacaaggtaga

SEQ ID NO: 9948 - DNA, 22 bp, synthetic construct
  misc_feature 1..22: note = Synthetic Construct
  source 1..22: mol_type = other DNA
agtgttaggacaagggcttgag

SEQ ID NO: 9949 - DNA, 21 bp, synthetic construct
  misc_feature 1..21: note = Synthetic Construct
  source 1..21: mol_type = other DNA
tgtgggacctcgtggatttgt

SEQ ID NO: 9950 - DNA, 27 bp, synthetic construct
  misc_feature 1..27: note = Synthetic Construct
  source 1..27: mol_type = other DNA
gactttgaccagcactatactgtaaca

SEQ ID NO: 9951 - DNA, 25 bp, synthetic construct
  misc_feature 1..25: note = Synthetic Construct
  source 1..25: mol_type = other DNA
gccatcacagttgtccttaatatgc

SEQ ID NO: 9952 - DNA, 22 bp, synthetic construct
  misc_feature 1..22: note = Synthetic Construct
  source 1..22: mol_type = other DNA
gcagaatccagccctctcattt

SEQ ID NO: 9953 - DNA, 26 bp, synthetic construct
  misc_feature 1..26: note = Synthetic Construct
  source 1..26: mol_type = other DNA
ctgggatttctgaacttatgctgaga

SEQ ID NO: 9954 - DNA, 24 bp, synthetic construct
  misc_feature 1..24: note = Synthetic Construct
  source 1..24: mol_type = other DNA
gccctttggtttgcaaagaaaaca

SEQ ID NO: 9955 - DNA, 22 bp, synthetic construct
  misc_feature 1..22: note = Synthetic Construct
  source 1..22: mol_type = other DNA
tgcccacaacctctgactaagt

SEQ ID NO: 9956 - DNA, 22 bp, synthetic construct
  misc_feature 1..22: note = Synthetic Construct
  source 1..22: mol_type = other DNA
gtggggaagggataaggtagga

SEQ ID NO: 9957 - DNA, 30 bp, synthetic construct
  misc_feature 1..30: note = Synthetic Construct
  source 1..30: mol_type = other DNA
gatgcatagaaatgtcccaaatatttctga

SEQ ID NO: 9958 - DNA, 24 bp, synthetic construct
  misc_feature 1..24: note = Synthetic Construct
  source 1..24: mol_type = other DNA
agcccagatacttgtcccatcaac

SEQ ID NO: 9959 - DNA, 30 bp, synthetic construct
  misc_feature 1..30: note = Synthetic Construct
  source 1..30: mol_type = other DNA
tgagcatcaaagagtagttttcaatatgac

SEQ ID NO: 9960 - DNA, 27 bp, synthetic construct
  misc_feature 1..27: note = Synthetic Construct
  source 1..27: mol_type = other DNA
tgacaaaaatccaaggttcttttcact

SEQ ID NO: 9961 - DNA, 27 bp, synthetic construct
  misc_feature 1..27: note = Synthetic Construct
  source 1..27: mol_type = other DNA
gcccagtattgaacttctcccttagga

SEQ ID NO: 9962 - DNA, 25 bp, synthetic construct
  misc_feature 1..25: note = Synthetic Construct
  source 1..25: mol_type = other DNA
tctacccctgatgtaacttggctat

SEQ ID NO: 9963 - DNA, 21 bp, synthetic construct
  misc_feature 1..21: note = Synthetic Construct
  source 1..21: mol_type = other DNA
agagcttccctacacctgctt

SEQ ID NO: 9964 - DNA, 23 bp, synthetic construct
  misc_feature 1..23: note = Synthetic Construct
  source 1..23: mol_type = other DNA
attctggaaccaactctgcgtat

SEQ ID NO: 9965 - DNA, 20 bp, synthetic construct
  misc_feature 1..20: note = Synthetic Construct
  source 1..20: mol_type = other DNA
cctgaaggggtgctctgtga

SEQ ID NO: 9966 - DNA, 25 bp, synthetic construct
  misc_feature 1..25: note = Synthetic Construct
  source 1..25: mol_type = other DNA
cagagaagtcactcttggggactat

SEQ ID NO: 9967 - DNA, 22 bp, synthetic construct
  misc_feature 1..22: note = Synthetic Construct
  source 1..22: mol_type = other DNA
tccacacccaaggaccatatgt

SEQ ID NO: 9968 - DNA, 29 bp, synthetic construct
  misc_feature 1..29: note = Synthetic Construct
  source 1..29: mol_type = other DNA
ggaaataataaatgataagggcctgaaca

SEQ ID NO: 9969 - DNA, 22 bp, synthetic construct
  misc_feature 1..22: note = Synthetic Construct
  source 1..22: mol_type = other DNA
gaagcttccccacccactaaaa

SEQ ID NO: 9970 - DNA, 27 bp, synthetic construct
  misc_feature 1..27: note = Synthetic Construct
  source 1..27: mol_type = other DNA
ggaataaatcagcaaacatgccttgga

SEQ ID NO: 9971 - DNA, 19 bp, synthetic construct
  misc_feature 1..19: note = Synthetic Construct
  source 1..19: mol_type = other DNA
tgcatgggcacgtggttgt

SEQ ID NO: 9972 - DNA, 25 bp, synthetic construct
  misc_feature 1..25: note = Synthetic Construct
  source 1..25: mol_type = other DNA
gctactccattcacagttctctgtt

SEQ ID NO: 9973 - DNA, 22 bp, synthetic construct
  misc_feature 1..22: note = Synthetic Construct
  source 1..22: mol_type = other DNA
tgaggaaggcatgaaggaacct

SEQ ID NO: 9974 - DNA, 24 bp, synthetic construct
  misc_feature 1..24: note = Synthetic Construct
  source 1..24: mol_type = other DNA
ggggtcagagaattgagttatgct

SEQ ID NO: 9975 - DNA, 28 bp, synthetic construct
  misc_feature 1..28: note = Synthetic Construct
  source 1..28: mol_type = other DNA
ccagggcacaagatcttatttttatcac

SEQ ID NO: 9976 - DNA, 22 bp, synthetic construct
  misc_feature 1..22: note = Synthetic Construct
  source 1..22: mol_type = other DNA
ggcaaagaagtcaaggctcctt

SEQ ID NO: 9977 - DNA, 23 bp, synthetic construct
  misc_feature 1..23: note = Synthetic Construct
  source 1..23: mol_type = other DNA
agcctctcccttggtgtttaagc

SEQ ID NO: 9978 - DNA, 24 bp, synthetic construct
  misc_feature 1..24: note = Synthetic Construct
  source 1..24: mol_type = other DNA
gagctatgtataggacgccacttt

SEQ ID NO: 9979 - DNA, 24 bp, synthetic construct
  misc_feature 1..24: note = Synthetic Construct
  source 1..24: mol_type = other DNA
ccttgtggatgacaggagtttcct

SEQ ID NO: 9980 - DNA, 24 bp, synthetic construct
  misc_feature 1..24: note = Synthetic Construct
  source 1..24: mol_type = other DNA
gcatgactgagactggatgttcca

SEQ ID NO: 9981 - DNA, 22 bp, synthetic construct
  misc_feature 1..22: note = Synthetic Construct
  source 1..22: mol_type = other DNA
ccatccccaagctcttttgtgt

SEQ ID NO: 9982 - DNA, 25 bp, synthetic construct
  misc_feature 1..25: note = Synthetic Construct
  source 1..25: mol_type = other DNA
ctggcttgctatgctgttttattgt

SEQ ID NO: 9983 - DNA, 30 bp, synthetic construct
  misc_feature 1..30: note = Synthetic Construct
  source 1..30: mol_type = other DNA
agcaaggcagttattaattgtttaggatta

SEQ ID NO: 9984 - DNA, 29 bp, synthetic construct
  misc_feature 1..29: note = Synthetic Construct
  source 1..29: mol_type = other DNA
cctccaggtagagattctaagtagacaga

SEQ ID NO: 9985 - DNA, 22 bp, synthetic construct
  misc_feature 1..22: note = Synthetic Construct
  source 1..22: mol_type = other DNA
tctcccatccaccatctttgca

SEQ ID NO: 9986 - DNA, 24 bp, synthetic construct
  misc_feature 1..24: note = Synthetic Construct
  source 1..24: mol_type = other DNA
ggagatggaaagcaacccacagaa

SEQ ID NO: 9987 - DNA, 19 bp, synthetic construct
  misc_feature 1..19: note = Synthetic Construct
  source 1..19: mol_type = other DNA
cctcccagctgccttcaca

SEQ ID NO: 9988 - DNA, 22 bp, synthetic construct
  misc_feature 1..22: note = Synthetic Construct
  source 1..22: mol_type = other DNA
gcttcaggccagtagtttgaga

SEQ ID NO: 9989 - DNA, 18 bp, synthetic construct
  misc_feature 1..18: note = Synthetic Construct
  source 1..18: mol_type = other DNA
tggatggcagggcatgga

SEQ ID NO: 9990 - DNA, 25 bp, synthetic construct
  misc_feature 1..25: note = Synthetic Construct
  source 1..25: mol_type = other DNA
tggtcaagaagtcctctttctatgg

SEQ ID NO: 9991 - DNA, 24 bp, synthetic construct
  misc_feature 1..24: note = Synthetic Construct
  source 1..24: mol_type = other DNA
agggaagggagtactcaagctatg

SEQ ID NO: 9992 - DNA, 27 bp, synthetic construct
  misc_feature 1..27: note = Synthetic Construct
  source 1..27: mol_type = other DNA
aaatgttcaggtttctcccatcatttt

SEQ ID NO: 9993 - DNA, 20 bp, synthetic construct
  misc_feature 1..20: note = Synthetic Construct
  source 1..20: mol_type = other DNA
tgcgtcaggactgagaacct

SEQ ID NO: 9994 - DNA, 22 bp, synthetic construct
  misc_feature 1..22: note = Synthetic Construct
  source 1..22: mol_type = other DNA
ggcagatggcttgatgactgtt

SEQ ID NO: 9995 - DNA, 27 bp, synthetic construct
  misc_feature 1..27: note = Synthetic Construct
  source 1..27: mol_type = other DNA
cctctaacatctattacctgcattggt

SEQ ID NO: 9996 - DNA, 24 bp, synthetic construct
  misc_feature 1..24: note = Synthetic Construct
  source 1..24: mol_type = other DNA
ctctagtctccacttctccagaga

SEQ ID NO: 9997 - DNA, 20 bp, synthetic construct
  misc_feature 1..20: note = Synthetic Construct
  source 1..20: mol_type = other DNA
tcaacaagccaggcatccat

SEQ ID NO: 9998 - DNA, 26 bp, synthetic construct
  misc_feature 1..26: note = Synthetic Construct
  source 1..26: mol_type = other DNA
ggtacctgttcatcaaaacctgtttc

SEQ ID NO: 9999 - DNA, 22 bp, synthetic construct
  misc_feature 1..22: note = Synthetic Construct
  source 1..22: mol_type = other DNA
acacagagcatcctccctactc

SEQ ID NO: 10000 - DNA, 28 bp, synthetic construct
  misc_feature 1..28: note = Synthetic Construct
  source 1..28: mol_type = other DNA
cccctcacctaatttttcactgttgttg

SEQ ID NO: 10001 - DNA, 29 bp, synthetic construct
  misc_feature 1..29: note = Synthetic Construct
  source 1..29: mol_type = other DNA
ccttcatctttgggataaaatctaagctt

SEQ ID NO: 10002 - DNA, 22 bp, synthetic construct
  misc_feature 1..22: note = Synthetic Construct
  source 1..22: mol_type = other DNA
cctagctctgtctgctgagaga

SEQ ID NO: 10003 - DNA, 25 bp, synthetic construct
  misc_feature 1..25: note = Synthetic Construct
  source 1..25: mol_type = other DNA
gggtttgcctcatcttacttttcaa

SEQ ID NO: 10004 - DNA, 24 bp, synthetic construct
  misc_feature 1..24: note = Synthetic Construct
  source 1..24: mol_type = other DNA
tggccacattttctatttgtgcat

SEQ ID NO: 10005 - DNA, 21 bp, synthetic construct
  misc_feature 1..21: note = Synthetic Construct
  source 1..21: mol_type = other DNA
gctgtgtccatgcctgtggta

SEQ ID NO: 10006 - DNA, 23 bp, synthetic construct
  misc_feature 1..23: note = Synthetic Construct
  source 1..23: mol_type = other DNA
ggcaaagcaaatgcgtcttttcc

SEQ ID NO: 10007 - DNA, 28 bp, synthetic construct
  misc_feature 1..28: note = Synthetic Construct
  source 1..28: mol_type = other DNA
gcaatcattcatatactcagcgaacatg

SEQ ID NO: 10008 - DNA, 25 bp, synthetic construct
  misc_feature 1..25: note = Synthetic Construct
  source 1..25: mol_type = other DNA
tcccacaaggtctaaaatgattgga

SEQ ID NO: 10009 - DNA, 25 bp, synthetic construct
  misc_feature 1..25: note = Synthetic Construct
  source 1..25: mol_type = other DNA
gcctggctatcactcatgtttcttt

SEQ ID NO: 10010 - DNA, 21 bp, synthetic construct
  misc_feature 1..21: note = Synthetic Construct
  source 1..21: mol_type = other DNA
tgttgtcaagccctccacatt

SEQ ID NO: 10011 - DNA, 24 bp, synthetic construct
  misc_feature 1..24: note = Synthetic Construct
  source 1..24: mol_type = other DNA
tcctgaattgcattctctggttct

SEQ ID NO: 10012 - DNA, 20 bp, synthetic construct
  misc_feature 1..20: note = Synthetic Construct
  source 1..20: mol_type = other DNA
agctgagaaggctccacact

SEQ ID NO: 10013 - DNA, 20 bp, synthetic construct
  misc_feature 1..20: note = Synthetic Construct
  source 1..20: mol_type = other DNA
aggcccagcttagctcttca

SEQ ID NO: 10014 - DNA, 23 bp, synthetic construct
  misc_feature 1..23: note = Synthetic Construct
  source 1..23: mol_type = other DNA
tggcataggtgtttctgcaaatg

SEQ ID NO: 10015 - DNA, 26 bp, synthetic construct
  misc_feature 1..26: note = Synthetic Construct
  source 1..26: mol_type = other DNA
gcctcacattgttcactctggtctac

SEQ ID NO: 10016 - DNA, 26 bp, synthetic construct
  misc_feature 1..26: note = Synthetic Construct
  source 1..26: mol_type = other DNA
ggcaagttggtagcagaatatttgag

SEQ ID NO: 10017 - DNA, 29 bp, synthetic construct
  misc_feature 1..29: note = Synthetic Construct
  source 1..29: mol_type = other DNA
gggtatttctttaacgacaaattccttga

SEQ ID NO: 10018 - DNA, 26 bp, synthetic construct
  misc_feature 1..26: note = Synthetic Construct
  source 1..26: mol_type = other DNA
gtgacagacactgaattctggcaatt

SEQ ID NO: 10019 - DNA, 22 bp, synthetic construct
  misc_feature 1..22: note = Synthetic Construct
  source 1..22: mol_type = other DNA
acgtagagggctcttgagtttg

SEQ ID NO: 10020 - DNA, 22 bp, synthetic construct
  misc_feature 1..22: note = Synthetic Construct
  source 1..22: mol_type = other DNA
tgaggagtcagagccaaagaca

SEQ ID NO: 10021 - DNA, 26 bp, synthetic construct
  misc_feature 1..26: note = Synthetic Construct
  source 1..26: mol_type = other DNA
agggagtgaaattatgagtgcttttg

SEQ ID NO: 10022 - DNA, 24 bp, synthetic construct
  misc_feature 1..24: note = Synthetic Construct
  source 1..24: mol_type = other DNA
ggatgggcttacacactttactgt

SEQ ID NO: 10023 - DNA, 22 bp, synthetic construct
  misc_feature 1..22: note = Synthetic Construct
  source 1..22: mol_type = other DNA
ggatttgccagcctctttctct

SEQ ID NO: 10024 - DNA, 24 bp, synthetic construct
  misc_feature 1..24: note = Synthetic Construct
  source 1..24: mol_type = other DNA
gcggtgtgattaatgtgggaatcc

SEQ ID NO: 10025 - DNA, 26 bp, synthetic construct
  misc_feature 1..26: note = Synthetic Construct
  source 1..26: mol_type = other DNA
gctatttcaataacacctggcaggaa

SEQ ID NO: 10026 - DNA, 22 bp, synthetic construct
  misc_feature 1..22: note = Synthetic Construct
  source 1..22: mol_type = other DNA
cagggctactgctcaccaaata

SEQ ID NO: 10027 - DNA, 21 bp, synthetic construct
  misc_feature 1..21: note = Synthetic Construct
  source 1..21: mol_type = other DNA
tctttcagcctccgtctccta

SEQ ID NO: 10028 - DNA, 18 bp, synthetic construct
  misc_feature 1..18: note = Synthetic Construct
  source 1..18: mol_type = other DNA
gaccagggcccacaccat

SEQ ID NO: 10029 - DNA, 23 bp, synthetic construct
  misc_feature 1..23: note = Synthetic Construct
  source 1..23: mol_type = other DNA
tcggcagttcagtacatgtgatg

SEQ ID NO: 10030 - DNA, 21 bp, synthetic construct
  misc_feature 1..21: note = Synthetic Construct
  source 1..21: mol_type = other DNA
ggccgttttgagctacaactg

SEQ ID NO: 10031 - DNA, 23 bp, synthetic construct
  misc_feature 1..23: note = Synthetic Construct
  source 1..23: mol_type = other DNA
gtcagcaaacatccagtgacctt

SEQ ID NO: 10032 - DNA, 26 bp, synthetic construct
  misc_feature 1..26: note = Synthetic Construct
  source 1..26: mol_type = other DNA
gttttaaagtgatgccctctttcaga

SEQ ID NO: 10033 - DNA, 27 bp, synthetic construct
  misc_feature 1..27: note = Synthetic Construct
  source 1..27: mol_type = other DNA
gcacttttacaaaatttcacccagttt

SEQ ID NO: 10034 - DNA, 21 bp, synthetic construct
  misc_feature 1..21: note = Synthetic Construct
  source 1..21: mol_type = other DNA
tgccagcaccctctactttcc

SEQ ID NO: 10035 - DNA, 26 bp, synthetic construct
  misc_feature 1..26: note = Synthetic Construct
  source 1..26: mol_type = other DNA
gcttacattccctgtgatgctcttag

SEQ ID NO: 10036 - DNA, 22 bp, synthetic construct
  misc_feature 1..22: note = Synthetic Construct
  source 1..22: mol_type = other DNA
accccacccaaaacattcaact

SEQ ID NO: 10037 - DNA, 18 bp, synthetic construct
  misc_feature 1..18: note = Synthetic Construct
  source 1..18: mol_type = other DNA
ccggtacccacccagctt

SEQ ID NO: 10038 - DNA, 26 bp, synthetic construct
  misc_feature 1..26: note = Synthetic Construct
  source 1..26: mol_type = other DNA
gaggtggagaccctatagcctttatc

SEQ ID NO: 10039 - DNA, 24 bp, synthetic construct
  misc_feature 1..24: note = Synthetic Construct
  source 1..24: mol_type = other DNA
ggaaagggcctactgacttctttc

SEQ ID NO: 10040 - DNA, 18 bp, synthetic construct
  misc_feature 1..18: note = Synthetic Construct
  source 1..18: mol_type = other DNA
agcgaggcgggtgacgtt

SEQ ID NO: 10041 - DNA, 22 bp, synthetic construct
  misc_feature 1..22: note = Synthetic Construct
  source 1..22: mol_type = other DNA
agccctgagtcagatgcctatt

SEQ ID NO: 10042 - DNA, 28 bp, synthetic construct
  misc_feature 1..28: note = Synthetic Construct
  source 1..28: mol_type = other DNA
aaaataaccactggcaacttataaagct

SEQ ID NO: 10043 - DNA, 24 bp, synthetic construct
  misc_feature 1..24: note = Synthetic Construct
  source 1..24: mol_type = other DNA
cagcacaggtaatcagttccatga

SEQ ID NO: 10044 - DNA, 24 bp, synthetic construct
  misc_feature 1..24: note = Synthetic Construct
  source 1..24: mol_type = other DNA
ggaagagtgggaaggactttgtct

SEQ ID NO: 10045 - DNA, 20 bp, synthetic construct
  misc_feature 1..20: note = Synthetic Construct
  source 1..20: mol_type = other DNA
ctgctgaagctcaggggttt

SEQ ID NO: 10046 - DNA, 24 bp, synthetic construct
  misc_feature 1..24: note = Synthetic Construct
  source 1..24: mol_type = other DNA
ccctactttcctacaccctcattc

SEQ ID NO: 10047 - DNA, 27 bp, synthetic construct
  misc_feature 1..27: note = Synthetic Construct
  source 1..27: mol_type = other DNA
ccatttgcaagaatcaaggagatttcc

SEQ ID NO: 10048 - DNA, 24 bp, synthetic construct
  misc_feature 1..24: note = Synthetic Construct
  source 1..24: mol_type = other DNA
tgcctttgcctgtgttcttattca

SEQ ID NO: 10049 - DNA, 30 bp, synthetic construct
  misc_feature 1..30: note = Synthetic Construct
  source 1..30: mol_type = other DNA
cctgtcttctcttttctaggtttggatgat

SEQ ID NO: 10050 - DNA, 24 bp, synthetic construct
  misc_feature 1..24: note = Synthetic Construct
  source 1..24: mol_type = other DNA
tccttcctcacccttcactcttct

SEQ ID NO: 10051 - DNA, 30 bp, synthetic construct
  misc_feature 1..30: note = Synthetic Construct
  source 1..30: mol_type = other DNA
ccttagcagctatattctataacgtcaaac

SEQ ID NO: 10052 - DNA, 23 bp, synthetic construct
  misc_feature 1..23: note = Synthetic Construct
  source 1..23: mol_type = other DNA
tggtagagacacatctccaacca

SEQ ID NO: 10053 - DNA, 22 bp, synthetic construct
  misc_feature 1..22: note = Synthetic Construct
  source 1..22: mol_type = other DNA
ccttggaaaagccagttttgct

SEQ ID NO: 10054 - DNA, 26 bp, synthetic construct
  misc_feature 1..26: note = Synthetic Construct
  source 1..26: mol_type = other DNA
cctactgattgtggatgtgatgtttc

SEQ ID NO: 10055 - DNA, 24 bp, synthetic construct
  misc_feature 1..24: note = Synthetic Construct
  source 1..24: mol_type = other DNA
catgactcagattctgcccatcaa

SEQ ID NO: 10056 - DNA, 19 bp, synthetic construct
  misc_feature 1..19: note = Synthetic Construct
  source 1..19: mol_type = other DNA
agtgccagcacctgtagga

SEQ ID NO: 10057 - DNA, 25 bp, synthetic construct
  misc_feature 1..25: note = Synthetic Construct
  source 1..25: mol_type = other DNA
gggacagggatcaatcataacatct

SEQ ID NO: 10058 - DNA, 28 bp, synthetic construct
  misc_feature 1..28: note = Synthetic Construct
  source 1..28: mol_type = other DNA
ctcttggtgaaactgaaatcctattgag

SEQ ID NO: 10059 - DNA, 22 bp, synthetic construct
  misc_feature 1..22: note = Synthetic Construct
  source 1..22: mol_type = other DNA
gcctgagagcttgcattcctaa

SEQ ID NO: 10060 - DNA, 19 bp, synthetic construct
  misc_feature 1..19: note = Synthetic Construct
  source 1..19: mol_type = other DNA
tgggctcagcctccatcac

SEQ ID NO: 10061 - DNA, 27 bp, synthetic construct
  misc_feature 1..27: note = Synthetic Construct
  source 1..27: mol_type = other DNA
gtttcctatccctcagtgatgatacat

SEQ ID NO: 10062 - DNA, 29 bp, synthetic construct
  misc_feature 1..29: note = Synthetic Construct
  source 1..29: mol_type = other DNA
caagctatggtgaatgagttagtaaagtt

SEQ ID NO: 10063 - DNA, 28 bp, synthetic construct
  misc_feature 1..28: note = Synthetic Construct
  source 1..28: mol_type = other DNA
agagatctgactcgtagaagaaagaaag

SEQ ID NO: 10064 - DNA, 24 bp, synthetic construct
  misc_feature 1..24: note = Synthetic Construct
  source 1..24: mol_type = other DNA
gggagaagaatgatgggagacagt

SEQ ID NO: 10065 - DNA, 22 bp, synthetic construct
  misc_feature 1..22: note = Synthetic Construct
  source 1..22: mol_type = other DNA
cacattcccctcaaggtgacat

SEQ ID NO: 10066 - DNA, 24 bp, synthetic construct
  misc_feature 1..24: note = Synthetic Construct
  source 1..24: mol_type = other DNA
ccattacatccctgctaggtagga

SEQ ID NO: 10067 - DNA, 27 bp, synthetic construct
  misc_feature 1..27: note = Synthetic Construct
  source 1..27: mol_type = other DNA
ggtataggagaagcttggagtctctct

SEQ ID NO: 10068 - DNA, 29 bp, synthetic construct
  misc_feature 1..29: note = Synthetic Construct
  source 1..29: mol_type = other DNA
cccagtggctaggtttttattatgttctg

SEQ ID NO: 10069 - DNA, 21 bp, synthetic construct
  misc_feature 1..21: note = Synthetic Construct
  source 1..21: mol_type = other DNA
gtgacagctgagccactagac

SEQ ID NO: 10070 - DNA, 21 bp, synthetic construct
  misc_feature 1..21: note = Synthetic Construct
  source 1..21: mol_type = other DNA
cctgagctccctgtgtaagga

SEQ ID NO: 10071 - DNA, 25 bp, synthetic construct
  misc_feature 1..25: note = Synthetic Construct
  source 1..25: mol_type = other DNA
gtggctatacattggccttatcaca

SEQ ID NO: 10072 - DNA, 29 bp, synthetic construct
  misc_feature 1..29: note = Synthetic Construct
  source 1..29: mol_type = other DNA
cttaagttcatacctgagagtgtacttgt

SEQ ID NO: 10073 - DNA, 18 bp, synthetic construct
  misc_feature 1..18: note = Synthetic Construct
  source 1..18: mol_type = other DNA
ctgcacccccagctgatg

SEQ ID NO: 10074 - DNA, 28 bp, synthetic construct
  misc_feature 1..28: note = Synthetic Construct
  source 1..28: mol_type = other DNA
ctggaaaggtaagagaaaaaagcacttt

SEQ ID NO: 10075 - DNA, 29 bp, synthetic construct
  misc_feature 1..29: note = Synthetic Construct
  source 1..29: mol_type = other DNA
ggctattacctatctcccagtagaacaaa

SEQ ID NO: 10076 - DNA, 19 bp, synthetic construct
  misc_feature 1..19: note = Synthetic Construct
  source 1..19: mol_type = other DNA
aagggcctgtgagctcact

SEQ ID NO: 10077 - DNA, 22 bp, synthetic construct
  misc_feature 1..22: note = Synthetic Construct
  source 1..22: mol_type = other DNA
ccaagccagtatcccatgtgaa

SEQ ID NO: 10078 - DNA, 29 bp, synthetic construct
  misc_feature 1..29: note = Synthetic Construct
  source 1..29: mol_type = other DNA
cttttctctcacataccttaatggatagc

SEQ ID NO: 10079 - DNA, 28 bp, synthetic construct
  misc_feature 1..28: note = Synthetic Construct
  source 1..28: mol_type = other DNA
ctgagaagcgtaaaaaaacctttaacct

SEQ ID NO: 10080 - DNA, 21 bp, synthetic construct
  misc_feature 1..21: note = Synthetic Construct
  source 1..21: mol_type = other DNA
acctcacacctggaccatcaa

SEQ ID NO: 10081 - DNA, 21 bp, synthetic construct
  misc_feature 1..21: note = Synthetic Construct
  source 1..21: mol_type = other DNA
tgcatggaaagggggctacct

SEQ ID NO: 10082 - DNA, 27 bp, synthetic construct
  misc_feature 1..27: note = Synthetic Construct
  source 1..27: mol_type = other DNA
catgctccatgatccttacagcaagga

SEQ ID NO: 10083 - DNA, 26 bp, synthetic construct
  misc_feature 1..26: note = Synthetic Construct
  source 1..26: mol_type = other DNA
gggtctggagatactgtagcaaatct

SEQ ID NO: 10084 - DNA, 24 bp, synthetic construct
  misc_feature 1..24: note = Synthetic Construct
  source 1..24: mol_type = other DNA
acctcctgttctttctgtgttcag

SEQ ID NO: 10085 - DNA, 24 bp, synthetic construct
  misc_feature 1..24: note = Synthetic Construct
  source 1..24: mol_type = other DNA
gctctgttttaccacggtgctttc

SEQ ID NO: 10086 - DNA, 24 bp, synthetic construct
  misc_feature 1..24: note = Synthetic Construct
  source 1..24: mol_type = other DNA
agctaaagtgctgtccacaataca

SEQ ID NO: 10087 - DNA, 24 bp, synthetic construct
  misc_feature 1..24: note = Synthetic Construct
  source 1..24: mol_type = other DNA
actcatttgtgcttgaaggttcca

SEQ ID NO: 10088 - DNA, 20 bp, synthetic construct
  misc_feature 1..20: note = Synthetic Construct
  source 1..20: mol_type = other DNA
ggtgtcctcactcggtctca

SEQ ID NO: 10089 - DNA, 29 bp, synthetic construct
  misc_feature 1..29: note = Synthetic Construct
  source 1..29: mol_type = other DNA
ccttgataacacaaagttgccaataaaat

SEQ ID NO: 10090 - DNA, 22 bp, synthetic construct
  misc_feature 1..22: note = Synthetic Construct
  source 1..22: mol_type = other DNA
gaaggagacggagcaagatcag

SEQ ID NO: 10091 - DNA, 22 bp, synthetic construct
  misc_feature 1..22: note = Synthetic Construct
  source 1..22: mol_type = other DNA
aacaaggcagcagtctctatgg

SEQ ID NO: 10092 - DNA, 26 bp, synthetic construct
  misc_feature 1..26: note = Synthetic Construct
  source 1..26: mol_type = other DNA
ccttgccatttaccttgtatttgact

SEQ ID NO: 10093 - DNA, 22 bp, synthetic construct
  misc_feature 1..22: note = Synthetic Construct
  source 1..22: mol_type = other DNA
gctaccatgcccagtcaagtct

SEQ ID NO: 10094 - DNA, 23 bp, synthetic construct
  misc_feature 1..23: note = Synthetic Construct
  source 1..23: mol_type = other DNA
gtttcccatttggaggtgaggaa

SEQ ID NO: 10095 - DNA, 23 bp, synthetic construct
  misc_feature 1..23: note = Synthetic Construct
  source 1..23: mol_type = other DNA
ggcaaaacccaaatggacgatga

SEQ ID NO: 10096 - DNA, 23 bp, synthetic construct
  misc_feature 1..23: note = Synthetic Construct
  source 1..23: mol_type = other DNA
ccacactcaggattcttggaaca

SEQ ID NO: 10097 - DNA, 25 bp, synthetic construct
  misc_feature 1..25: note = Synthetic Construct
  source 1..25: mol_type = other DNA
aatttgtgacaggcatatgcacaat

SEQ ID NO: 10098 - DNA, 27 bp, synthetic construct
  misc_feature 1..27: note = Synthetic Construct
  source 1..27: mol_type = other DNA
gtttgtgtctgcaatgattatgcaaaa

SEQ ID NO: 10099 - DNA, 22 bp, synthetic construct
  misc_feature 1..22: note = Synthetic Construct
  source 1..22: mol_type = other DNA
caactccatgagctcagctgta

SEQ ID NO: 10100 - DNA, 28 bp, synthetic construct
  misc_feature 1..28: note = Synthetic Construct
  source 1..28: mol_type = other DNA
tgcatatatcttgcagtaacttcccatt

SEQ ID NO: 10101 - DNA, 27 bp, synthetic construct
  misc_feature 1..27: note = Synthetic Construct
  source 1..27: mol_type = other DNA
cccagaaggcttccaatttgaacaata

SEQ ID NO: 10102 - DNA, 25 bp, synthetic construct
  misc_feature 1..25: note = Synthetic Construct
  source 1..25: mol_type = other DNA
ttccatggccttggagaaaaataac

SEQ ID NO: 10103 - DNA, 25 bp, synthetic construct
  misc_feature 1..25: note = Synthetic Construct
  source 1..25: mol_type = other DNA
ggagggaaaactgaggaagtagatg

SEQ ID NO: 10104 - DNA, 23 bp, synthetic construct
  misc_feature 1..23: note = Synthetic Construct
  source 1..23: mol_type = other DNA
gcactaacctgctttaggaatgc

SEQ ID NO: 10105 - DNA, 23 bp, synthetic construct
  misc_feature 1..23: note = Synthetic Construct
  source 1..23: mol_type = other DNA
tctccaaactcttcccctaggtt

SEQ ID NO: 10106 - DNA, 26 bp, synthetic construct
  misc_feature 1..26: note = Synthetic Construct
  source 1..26: mol_type = other DNA
ggccatttttttcccctctagaaacc

SEQ ID NO: 10107 - DNA, 30 bp, synthetic construct
  misc_feature 1..30: note = Synthetic Construct
  source 1..30: mol_type = other DNA
gtatggataaataaatgaagggtccaatgg

SEQ ID NO: 10108 - DNA, 23 bp, synthetic construct
  misc_feature 1..23: note = Synthetic Construct
  source 1..23: mol_type = other DNA
agctccctcagggactaagttct

SEQ ID NO: 10109 - DNA, 22 bp, synthetic construct
  misc_feature 1..22: note = Synthetic Construct
  source 1..22: mol_type = other DNA
ctgtttgtcacagtgggaagga

SEQ ID NO: 10110 - DNA, 21 bp, synthetic construct
  misc_feature 1..21: note = Synthetic Construct
  source 1..21: mol_type = other DNA
ctctcccactgctctgttctg

SEQ ID NO: 10111 - DNA, 19 bp, synthetic construct
  misc_feature 1..19: note = Synthetic Construct
  source 1..19: mol_type = other DNA
gggcatggggtcacttgga

SEQ ID NO: 10112 - DNA, 26 bp, synthetic construct
  misc_feature 1..26: note = Synthetic Construct
  source 1..26: mol_type = other DNA
gaaagtttccagtttgctagcttgta

SEQ ID NO: 10113 - DNA, 23 bp, synthetic construct
  misc_feature 1..23: note = Synthetic Construct
  source 1..23: mol_type = other DNA
tctggacttcaggcttggactag

SEQ ID NO: 10114 - DNA, 23 bp, synthetic construct
  misc_feature 1..23: note = Synthetic Construct
  source 1..23: mol_type = other DNA
ccactgaatagggggaaaatggt

SEQ ID NO: 10115 - DNA, 22 bp, synthetic construct
  misc_feature 1..22: note = Synthetic Construct
  source 1..22: mol_type = other DNA
gcttagaccaaccagctatgct

SEQ ID NO: 10116 - DNA, 24 bp, synthetic construct
  misc_feature 1..24: note = Synthetic Construct
  source 1..24: mol_type = other DNA
ccactgcaagagagatggttccta

SEQ ID NO: 10117 - DNA, 30 bp, synthetic construct
  misc_feature 1..30: note = Synthetic Construct
  source 1..30: mol_type = other DNA
tttacaaagttaagagagctttctgttgat

SEQ ID NO: 10118 - DNA, 24 bp, synthetic construct
  misc_feature 1..24: note = Synthetic Construct
  source 1..24: mol_type = other DNA
tttccaagaagagccacaatacct

SEQ ID NO: 10119 - DNA, 23 bp, synthetic construct
  misc_feature 1..23: note = Synthetic Construct
  source 1..23: mol_type = other DNA
tccacatgcaagagaaagaagct

SEQ ID NO: 10120 - DNA, 22 bp, synthetic construct
  misc_feature 1..22: note = Synthetic Construct
  source 1..22: mol_type = other DNA
tgaggtactatcaggccatcgt

SEQ ID NO: 10121 - DNA, 27 bp, synthetic construct
  misc_feature 1..27: note = Synthetic Construct
  source 1..27: mol_type = other DNA
gccctaggaatattggaaaacccttca

SEQ ID NO: 10122 - DNA, 24 bp, synthetic construct
  misc_feature 1..24: note = Synthetic Construct
  source 1..24: mol_type = other DNA
gcctgtgttctcacctgtgaaatg

SEQ ID NO: 10123 - DNA, 24 bp, synthetic construct
  misc_feature 1..24: note = Synthetic Construct
  source 1..24: mol_type = other DNA
ggcccatgtagtgcttgacttttg

SEQ ID NO: 10124 - DNA, 24 bp, synthetic construct
  misc_feature 1..24: note = Synthetic Construct
  source 1..24: mol_type = other DNA
cacccacttccatacagtgttgag

SEQ ID NO: 10125 - DNA, 22 bp, synthetic construct
  misc_feature 1..22: note = Synthetic Construct
  source 1..22: mol_type = other DNA
aggccagagttggggaattaca

SEQ ID NO: 10126 - DNA, 22 bp, synthetic construct
  misc_feature 1..22: note = Synthetic Construct
  source 1..22: mol_type = other DNA
cttgactttggcattgcatcca

SEQ ID NO: 10127 - DNA, 26 bp, synthetic construct
  misc_feature 1..26: note = Synthetic Construct
  source 1..26: mol_type = other DNA
catgagctctttctagtgaacagtgt

SEQ ID NO: 10128 - DNA, 18 bp, synthetic construct
  misc_feature 1..18: note = Synthetic Construct
  source 1..18: mol_type = other DNA
gccagcgctcctctctca

SEQ ID NO: 10129 - DNA, 22 bp, synthetic construct
  misc_feature 1..22: note = Synthetic Construct
  source 1..22: mol_type = other DNA
acgcttctaacagcctcttctc

SEQ ID NO: 10130 - DNA, 23 bp, synthetic construct
  misc_feature 1..23: note = Synthetic Construct
  source 1..23: mol_type = other DNA
aggagaagagtccagtctgtctt

SEQ ID NO: 10131 - DNA, 25 bp, synthetic construct
  misc_feature 1..25: note = Synthetic Construct
  source 1..25: mol_type = other DNA
cacagttgagtcgtcttctcttctc

SEQ ID NO: 10132 - DNA, 23 bp, synthetic construct
  misc_feature 1..23: note = Synthetic Construct
  source 1..23: mol_type = other DNA
acccgagctctatccccatatgg

SEQ ID NO: 10133 - DNA, 22 bp, synthetic construct
  misc_feature 1..22: note = Synthetic Construct
  source 1..22: mol_type = other DNA
ctccaccttccccttgacattt

SEQ ID NO: 10134 - DNA, 21 bp, synthetic construct
  misc_feature 1..21: note = Synthetic Construct
  source 1..21: mol_type = other DNA
tgcaggctccagcagctagta

SEQ ID NO: 10135 - DNA, 22 bp, synthetic construct
  misc_feature 1..22: note = Synthetic Construct
  source 1..22: mol_type = other DNA
ttggccaggaattctccttcct

SEQ ID NO: 10136 - DNA, 27 bp, synthetic construct
  misc_feature 1..27: note = Synthetic Construct
  source 1..27: mol_type = other DNA
gtgcaagaggatcgtattacattgaca

SEQ ID NO: 10137 - DNA, 28 bp, synthetic construct
  misc_feature 1..28: note = Synthetic Construct
  source 1..28: mol_type = other DNA
ggaaaaaggaatcctgttaaagccgaat

SEQ ID NO: 10138 - DNA, 26 bp, synthetic construct
  misc_feature 1..26: note = Synthetic Construct
  source 1..26: mol_type = other DNA
aaactgctatcagtgaaaacctgaag

SEQ ID NO: 10139 - DNA, 19 bp, synthetic construct
  misc_feature 1..19: note = Synthetic Construct
  source 1..19: mol_type = other DNA
cacctctgagccccagtct

SEQ ID NO: 10140 - DNA, 24 bp, synthetic construct
  misc_feature 1..24: note = Synthetic Construct
  source 1..24: mol_type = other DNA
gcaggaagaggcactatcttgcta

SEQ ID NO: 10141 - DNA, 25 bp, synthetic construct
  misc_feature 1..25: note = Synthetic Construct
  source 1..25: mol_type = other DNA
ggttttgatgctgggacacctacta

SEQ ID NO: 10142 - DNA, 29 bp, synthetic construct
  misc_feature 1..29: note = Synthetic Construct
  source 1..29: mol_type = other DNA
ggtttttgttctcctgcttccattatagg

SEQ ID NO: 10143 - DNA, 26 bp, synthetic construct
  misc_feature 1..26: note = Synthetic Construct
  source 1..26: mol_type = other DNA
tccaattcagggagagaatgatcatc

SEQ ID NO: 10144 - DNA, 20 bp, synthetic construct
  misc_feature 1..20: note = Synthetic Construct
  source 1..20: mol_type = other DNA
tgggagctctgtcactgaca

SEQ ID NO: 10145 - DNA, 22 bp, synthetic construct
  misc_feature 1..22: note = Synthetic Construct
  source 1..22: mol_type = other DNA
tccaggtctgcatgtccttttt

SEQ ID NO: 10146 - DNA, 26 bp, synthetic construct
  misc_feature 1..26: note = Synthetic Construct
  source 1..26: mol_type = other DNA
ggtccctgatccactagtaacttcct

SEQ ID NO: 10147 - DNA, 24 bp, synthetic construct
  misc_feature 1..24: note = Synthetic Construct
  source 1..24: mol_type = other DNA
ctcagtttatcagcatgggagtga

SEQ ID NO: 10148 - DNA, 21 bp, synthetic construct
  misc_feature 1..21: note = Synthetic Construct
  source 1..21: mol_type = other DNA
tctccctggtgtgtcttctgt

SEQ ID NO: 10149 - DNA, 28 bp, synthetic construct
  misc_feature 1..28: note = Synthetic Construct
  source 1..28: mol_type = other DNA
gcacaaggagagtagggatttttacctt

SEQ ID NO: 10150 - DNA, 23 bp, synthetic construct
  misc_feature 1..23: note = Synthetic Construct
  source 1..23: mol_type = other DNA
gagcagtgactgtcattgacatg

SEQ ID NO: 10151 - DNA, 20 bp, synthetic construct
  misc_feature 1..20: note = Synthetic Construct
  source 1..20: mol_type = other DNA
cctctgtgcccctcaagttg

SEQ ID NO: 10152 - DNA, 22 bp, synthetic construct
  misc_feature 1..22: note = Synthetic Construct
  source 1..22: mol_type = other DNA
ccaagcctctcagtgaatccaa

SEQ ID NO: 10153 - DNA, 28 bp, synthetic construct
  misc_feature 1..28: note = Synthetic Construct
  source 1..28: mol_type = other DNA
gatggaaaaacctatgtgagttctaggt

SEQ ID NO: 10154 - DNA, 23 bp, synthetic construct
  misc_feature 1..23: note = Synthetic Construct
  source 1..23: mol_type = other DNA
tgaaaccaaggcctagaggagtt

SEQ ID NO: 10155 - DNA, 25 bp, synthetic construct
  misc_feature 1..25: note = Synthetic Construct
  source 1..25: mol_type = other DNA
cttatcagcaggtactatgctccaa

SEQ ID NO: 10156 - DNA, 24 bp, synthetic construct
  misc_feature 1..24: note = Synthetic Construct
  source 1..24: mol_type = other DNA
cctgggttcattttctgtgaacag

SEQ ID NO: 10157 - DNA, 30 bp, synthetic construct
  misc_feature 1..30: note = Synthetic Construct
  source 1..30: mol_type = other DNA
gattcttagttaaaaggaaaggctgttagg

SEQ ID NO: 10158 - DNA, 22 bp, synthetic construct
  misc_feature 1..22: note = Synthetic Construct
  source 1..22: mol_type = other DNA
gctcaggatttggggtagtgaa

SEQ ID NO: 10159 - DNA, 20 bp, synthetic construct
  misc_feature 1..20: note = Synthetic Construct
  source 1..20: mol_type = other DNA
aactgtggcctgacctggat

SEQ ID NO: 10160 - DNA, 25 bp, synthetic construct
  misc_feature 1..25: note = Synthetic Construct
  source 1..25: mol_type = other DNA
ggtggttggatgttcttgtcaaaag

SEQ ID NO: 10161 - DNA, 30 bp, synthetic construct
  misc_feature 1..30: note = Synthetic Construct
  source 1..30: mol_type = other DNA
gaagtggatccatttaagagatagtttgga

SEQ ID NO: 10162 - DNA, 22 bp, synthetic construct
  misc_feature 1..22: note = Synthetic Construct
  source 1..22: mol_type = other DNA
tctcttgctgccttctgacaat

SEQ ID NO: 10163 - DNA, 22 bp, synthetic construct
  misc_feature 1..22: note = Synthetic Construct
  source 1..22: mol_type = other DNA
ctgaccattgctgctcaagtgt

SEQ ID NO: 10164 - DNA, 28 bp, synthetic construct
  misc_feature 1..28: note = Synthetic Construct
  source 1..28: mol_type = other DNA
cacatctctgagtgattctgagttacta

SEQ ID NO: 10165 - DNA, 28 bp, synthetic construct
  misc_feature 1..28: note = Synthetic Construct
  source 1..28: mol_type = other DNA
gaagccaggtattctttaaactgaaaga

SEQ ID NO: 10166 - DNA, 22 bp, synthetic construct
  misc_feature 1..22: note = Synthetic Construct
  source 1..22: mol_type = other DNA
ctcacactgcctgcaatgagat

SEQ ID NO: 10167 - DNA, 24 bp, synthetic construct
  misc_feature 1..24: note = Synthetic Construct
  source 1..24: mol_type = other DNA
cagcagggaggtatggattaaagg

SEQ ID NO: 10168 - DNA, 29 bp, synthetic construct
  misc_feature 1..29: note = Synthetic Construct
  source 1..29: mol_type = other DNA
ctctaatagtctatgggattttggctttc

SEQ ID NO: 10169 - DNA, 22 bp, synthetic construct
  misc_feature 1..22: note = Synthetic Construct
  source 1..22: mol_type = other DNA
acctgactctcagccaacattg

SEQ ID NO: 10170 - DNA, 28 bp, synthetic construct
  misc_feature 1..28: note = Synthetic Construct
  source 1..28: mol_type = other DNA
ctgagttatagagccatcgagtaacttg

SEQ ID NO: 10171 - DNA, 19 bp, synthetic construct
  misc_feature 1..19: note = Synthetic Construct
  source 1..19: mol_type = other DNA
gcagccacatccctcacaa

SEQ ID NO: 10172 - DNA, 23 bp, synthetic construct
  misc_feature 1..23: note = Synthetic Construct
  source 1..23: mol_type = other DNA
actggaaaatccaacagcaggta

SEQ ID NO: 10173 - DNA, 18 bp, synthetic construct
  misc_feature 1..18: note = Synthetic Construct
  source 1..18: mol_type = other DNA
agtgccctgccaggttct

SEQ ID NO: 10174 - DNA, 22 bp, synthetic construct
  misc_feature 1..22: note = Synthetic Construct
  source 1..22: mol_type = other DNA
accttgtgttcaggcaggaact

SEQ ID NO: 10175 - DNA, 21 bp, synthetic construct
  misc_feature 1..21: note = Synthetic Construct
  source 1..21: mol_type = other DNA
ccgtgcatctctgctcattga

SEQ ID NO: 10176 - DNA, 26 bp, synthetic construct
  misc_feature 1..26: note = Synthetic Construct
  source 1..26: mol_type = other DNA
gcaaggtctcaatctaagtcctggat

SEQ ID NO: 10177 - DNA, 28 bp, synthetic construct
  misc_feature 1..28: note = Synthetic Construct
  source 1..28: mol_type = other DNA
ctttaaatggtccacaactcttttccaa

SEQ ID NO: 10178 - DNA, 26 bp, synthetic construct
  misc_feature 1..26: note = Synthetic Construct
  source 1..26: mol_type = other DNA
ggaacaaataagaggagagggtgtga

SEQ ID NO: 10179 - DNA, 24 bp, synthetic construct
  misc_feature 1..24: note = Synthetic Construct
  source 1..24: mol_type = other DNA
gatgcctgtggccttatgtatagg

SEQ ID NO: 10180 - DNA, 27 bp, synthetic construct
  misc_feature 1..27: note = Synthetic Construct
  source 1..27: mol_type = other DNA
agcaccatgaaaactctttcataacat

SEQ ID NO: 10181 - DNA, 20 bp, synthetic construct
  misc_feature 1..20: note = Synthetic Construct
  source 1..20: mol_type = other DNA
tccagcccctgtcttatgct

SEQ ID NO: 10182 - DNA, 23 bp, synthetic construct
  misc_feature 1..23: note = Synthetic Construct
  source 1..23: mol_type = other DNA
ccccaactccatcttaggtacca

SEQ ID NO: 10183 - DNA, 30 bp, synthetic construct
  misc_feature 1..30: note = Synthetic Construct
  source 1..30: mol_type = other DNA
aaagccttgtatcatattcagaagattcag

SEQ ID NO: 10184 - DNA, 20 bp, synthetic construct
  misc_feature 1..20: note = Synthetic Construct
  source 1..20: mol_type = other DNA
gaaaaaagccgggcaaagca

SEQ ID NO: 10185 - DNA, 28 bp, synthetic construct
  misc_feature 1..28: note = Synthetic Construct
  source 1..28: mol_type = other DNA
ggtcttccacctatctacagatggaagt

SEQ ID NO: 10186 - DNA, 22 bp, synthetic construct
  misc_feature 1..22: note = Synthetic Construct
  source 1..22: mol_type = other DNA
ctgacttcagtgtccacatgct

SEQ ID NO: 10187 - DNA, 25 bp, synthetic construct
  misc_feature 1..25: note = Synthetic Construct
  source 1..25: mol_type = other DNA
gattccagaatgtaggcaaaaagct

SEQ ID NO: 10188 - DNA, 23 bp, synthetic construct
  misc_feature 1..23: note = Synthetic Construct
  source 1..23: mol_type = other DNA
gcagaagtgtggaggcacaaaat

SEQ ID NO: 10189 - DNA, 26 bp, synthetic construct
  misc_feature 1..26: note = Synthetic Construct
  source 1..26: mol_type = other DNA
ctgcctcttatcagtaatgagctgat

SEQ ID NO: 10190 - DNA, 25 bp, synthetic construct
  misc_feature 1..25: note = Synthetic Construct
  source 1..25: mol_type = other DNA
ttctgtctcctccctacctatacac

SEQ ID NO: 10191 - DNA, 30 bp, synthetic construct
  misc_feature 1..30: note = Synthetic Construct
  source 1..30: mol_type = other DNA
tgctgttaggatatagacaaagatctttca

SEQ ID NO: 10192 - DNA, 19 bp, synthetic construct
  misc_feature 1..19: note = Synthetic Construct
  source 1..19: mol_type = other DNA
agcagccaacagtgccaat

SEQ ID NO: 10193 - DNA, 18 bp, synthetic construct
  misc_feature 1..18: note = Synthetic Construct
  source 1..18: mol_type = other DNA
aggtggccccagcacttc

SEQ ID NO: 10194 - DNA, 27 bp, synthetic construct
  misc_feature 1..27: note = Synthetic Construct
  source 1..27: mol_type = other DNA
gttcctgcagaataagggagaccaaag

SEQ ID NO: 10195 - DNA, 26 bp, synthetic construct
  misc_feature 1..26: note = Synthetic Construct
  source 1..26: mol_type = other DNA
tgaacgttgaaagactcacctaaagt

SEQ ID NO: 10196 - DNA, 25 bp, synthetic construct
  misc_feature 1..25: note = Synthetic Construct
  source 1..25: mol_type = other DNA
gctaccgccttgttaactaacaaaa

SEQ ID NO: 10197 - DNA, 23 bp, synthetic construct
  misc_feature 1..23: note = Synthetic Construct
  source 1..23: mol_type = other DNA
tcccgaaattcatctctgcactt

SEQ ID NO: 10198 - DNA, 27 bp, synthetic construct
  misc_feature 1..27: note = Synthetic Construct
  source 1..27: mol_type = other DNA
tgctatcacaggtgatttgtttagcta

SEQ ID NO: 10199 - DNA, 25 bp, synthetic construct
  misc_feature 1..25: note = Synthetic Construct
  source 1..25: mol_type = other DNA
ccttaagaggctttgtgcttttacc

SEQ ID NO: 10200 - DNA, 19 bp, synthetic construct
  misc_feature 1..19: note = Synthetic Construct
  source 1..19: mol_type = other DNA
tccgtgcaggagggttgta

SEQ ID NO: 10201 - DNA, 20 bp, synthetic construct
  misc_feature 1..20: note = Synthetic Construct
  source 1..20: mol_type = other DNA
ggggcagtgtacaggcaaat

SEQ ID NO: 10202 - DNA, 25 bp, synthetic construct
  misc_feature 1..25: note = Synthetic Construct
  source 1..25: mol_type = other DNA
ccacatcctctttcattgtcaatcc

SEQ ID NO: 10203 - DNA, 19 bp, synthetic construct
  misc_feature 1..19: note = Synthetic Construct
  source 1..19: mol_type = other DNA
acacaggccaccgtcttct

SEQ ID NO: 10204 - DNA, 25 bp, synthetic construct
  misc_feature 1..25: note = Synthetic Construct
  source 1..25: mol_type = other DNA
gcttgctgtaaatccaccagttaca

SEQ ID NO: 10205 - DNA, 24 bp, synthetic construct
  misc_feature 1..24: note = Synthetic Construct
  source 1..24: mol_type = other DNA
gtgtgaatgaacaccatccacctt

SEQ ID NO: 10206 - DNA, 25 bp, synthetic construct
  misc_feature 1..25: note = Synthetic Construct
  source 1..25: mol_type = other DNA
ggctcaagaccacttcattctgtgt

SEQ ID NO: 10207 - DNA, 25 bp, synthetic construct
  misc_feature 1..25: note = Synthetic Construct
  source 1..25: mol_type = other DNA
gcttcaagggcatatttaggaggtt

SEQ ID NO: 10208 - DNA, 19 bp, synthetic construct
  misc_feature 1..19: note = Synthetic Construct
  source 1..19: mol_type = other DNA
agggctgggggaatgagaa

SEQ ID NO: 10209 - DNA, 26 bp, synthetic construct
  misc_feature 1..26: note = Synthetic Construct
  source 1..26: mol_type = other DNA
cgaagacacatttagcatgactacac

SEQ ID NO: 10210 - DNA, 20 bp, synthetic construct
  misc_feature 1..20: note = Synthetic Construct
  source 1..20: mol_type = other DNA
gggtggtctgtgcagtttgt

SEQ ID NO: 10211 - DNA, 24 bp, synthetic construct
  misc_feature 1..24: note = Synthetic Construct
  source 1..24: mol_type = other DNA
cactggtgattggaagagcagttg

SEQ ID NO: 10212 - DNA, 28 bp, synthetic construct
  misc_feature 1..28: note = Synthetic Construct
  source 1..28: mol_type = other DNA
tgggaaagtgacttttgatttgatatcc

SEQ ID NO: 10213 - DNA, 23 bp, synthetic construct
  misc_feature 1..23: note = Synthetic Construct
  source 1..23: mol_type = other DNA
tgggcgagagtgagactacatct

SEQ ID NO: 10214 - DNA, 22 bp, synthetic construct
  misc_feature 1..22: note = Synthetic Construct
  source 1..22: mol_type = other DNA
gcaactgcatccattggatcct

SEQ ID NO: 10215 - DNA, 26 bp, synthetic construct
  misc_feature 1..26: note = Synthetic Construct
  source 1..26: mol_type = other DNA
tggcttacacttgtaatgtcaccatt

SEQ ID NO: 10216 - DNA, 30 bp, synthetic construct
  misc_feature 1..30: note = Synthetic Construct
  source 1..30: mol_type = other DNA
tcaagtatttctttctagtgacccaaaaac

SEQ ID NO: 10217 - DNA, 23 bp, synthetic construct
  misc_feature 1..23: note = Synthetic Construct
  source 1..23: mol_type = other DNA
gttaaagggtctgctgttttgca

SEQ ID NO: 10218 - DNA, 26 bp, synthetic construct
  misc_feature 1..26: note = Synthetic Construct
  source 1..26: mol_type = other DNA
cgctcactgacactgggtattaatgg

SEQ ID NO: 10219 - DNA, 22 bp, synthetic construct
  misc_feature 1..22: note = Synthetic Construct
  source 1..22: mol_type = other DNA
ttgtgggacagtgaggagacaa

SEQ ID NO: 10220 - DNA, 24 bp, synthetic construct
  misc_feature 1..24: note = Synthetic Construct
  source 1..24: mol_type = other DNA
cgacatgaccaagtgtgcttgtag

SEQ ID NO: 10221 - DNA, 30 bp, synthetic construct
  misc_feature 1..30: note = Synthetic Construct
  source 1..30: mol_type = other DNA
gctttcaagattgcattagtcgtattaggt

SEQ ID NO: 10222 - DNA, 22 bp, synthetic construct
  misc_feature 1..22: note = Synthetic Construct
  source 1..22: mol_type = other DNA
tgcttacctgctgcttgtacgt

SEQ ID NO: 10223 - DNA, 28 bp, synthetic construct
  misc_feature 1..28: note = Synthetic Construct
  source 1..28: mol_type = other DNA
gcatgctatgaattctaccaaaccattg

SEQ ID NO: 10224 - DNA, 25 bp, synthetic construct
  misc_feature 1..25: note = Synthetic Construct
  source 1..25: mol_type = other DNA
gctgagaatgacttccatgttcttg

SEQ ID NO: 10225 - DNA, 24 bp, synthetic construct
  misc_feature 1..24: note = Synthetic Construct
  source 1..24: mol_type = other DNA
ctgggaccatctaccttgatcatc

SEQ ID NO: 10226 - DNA, 22 bp, synthetic construct
  misc_feature 1..22: note = Synthetic Construct
  source 1..22: mol_type = other DNA
aaaccaggagggggtgtaatca

SEQ ID NO: 10227 - DNA, 21 bp, synthetic construct
  misc_feature 1..21: note = Synthetic Construct
  source 1..21: mol_type = other DNA
cctggtgtggtggtgtttttc

SEQ ID NO: 10228 - DNA, 23 bp, synthetic construct
  misc_feature 1..23: note = Synthetic Construct
  source 1..23: mol_type = other DNA
tccttcatatcaccctgctgaca

SEQ ID NO: 10229 - DNA, 21 bp, synthetic construct
  misc_feature 1..21: note = Synthetic Construct
  source 1..21: mol_type = other DNA
ccccatcttccctagctctga

SEQ ID NO: 10230 - DNA, 18 bp, synthetic construct
  misc_feature 1..18: note = Synthetic Construct
  source 1..18: mol_type = other DNA
agccaaggcggtcctttc

SEQ ID NO: 10231 - DNA, 23 bp, synthetic construct
  misc_feature 1..23: note = Synthetic Construct
  source 1..23: mol_type = other DNA
actgctgaagacaagggattcac

SEQ ID NO: 10232 - DNA, 25 bp, synthetic construct
  misc_feature 1..25: note = Synthetic Construct
  source 1..25: mol_type = other DNA
gtgggttttcactatgtggactttg

SEQ ID NO: 10233 - DNA, 24 bp, synthetic construct
  misc_feature 1..24: note = Synthetic Construct
  source 1..24: mol_type = other DNA
gcacaaggattagtgggtggatag

SEQ ID NO: 10234 - DNA, 23 bp, synthetic construct
  misc_feature 1..23: note = Synthetic Construct
  source 1..23: mol_type = other DNA
agggcttcataggagggaaactg

SEQ ID NO: 10235 - DNA, 20 bp, synthetic construct
  misc_feature 1..20: note = Synthetic Construct
  source 1..20: mol_type = other DNA
tccccttgccaggaggttgt

SEQ ID NO: 10236 - DNA, 22 bp, synthetic construct
  misc_feature 1..22: note = Synthetic Construct
  source 1..22: mol_type = other DNA
ccagaactgctcacaggtacac

SEQ ID NO: 10237 - DNA, 22 bp, synthetic construct
  misc_feature 1..22: note = Synthetic Construct
  source 1..22: mol_type = other DNA
gtggaaagagcacacacaaaca

SEQ ID NO: 10238 - DNA, 22 bp, synthetic construct
  misc_feature 1..22: note = Synthetic Construct
  source 1..22: mol_type = other DNA
tttccaccaaatgcccctcttg

SEQ ID NO: 10239 - DNA, 19 bp, synthetic construct
  misc_feature 1..19: note = Synthetic Construct
  source 1..19: mol_type = other DNA
agccccactgccatttgct

SEQ ID NO: 10240 - DNA, 20 bp, synthetic construct
  misc_feature 1..20: note = Synthetic Construct
  source 1..20: mol_type = other DNA
aaatgccgcagtcctgtcat

SEQ ID NO: 10241 - DNA, 25 bp, synthetic construct
  misc_feature 1..25: note = Synthetic Construct
  source 1..25: mol_type = other DNA
gctgtttcttccaggaaaggaaacc

SEQ ID NO: 10242 - DNA, 24 bp, synthetic construct
  misc_feature 1..24: note = Synthetic Construct
  source 1..24: mol_type = other DNA
tgtaccaatctgtctagggtgtga

SEQ ID NO: 10243 - DNA, 26 bp, synthetic construct
  misc_feature 1..26: note = Synthetic Construct
  source 1..26: mol_type = other DNA
ccagtgaggacctgcatgataaatca

SEQ ID NO: 10244 - DNA, 30 bp, synthetic construct
  misc_feature 1..30: note = Synthetic Construct
  source 1..30: mol_type = other DNA
agcttgtataactgagtttcaaatgaagac

SEQ ID NO: 10245 - DNA, 28 bp, synthetic construct
  misc_feature 1..28: note = Synthetic Construct
  source 1..28: mol_type = other DNA
agaaaactccacaaaaattgaagacgat

SEQ ID NO: 10246 - DNA, 19 bp, synthetic construct
  misc_feature 1..19: note = Synthetic Construct
  source 1..19: mol_type = other DNA
ataggggccgcgtactaca

SEQ ID NO: 10247 - DNA, 20 bp, synthetic construct
  misc_feature 1..20: note = Synthetic Construct
  source 1..20: mol_type = other DNA
ggggccaagagctactgtgt

SEQ ID NO: 10248 - DNA, 27 bp, synthetic construct
  misc_feature 1..27: note = Synthetic Construct
  source 1..27: mol_type = other DNA
ttgggcaagagatgatagtaacatagg

SEQ ID NO: 10249 - DNA, 20 bp, synthetic construct
  misc_feature 1..20: note = Synthetic Construct
  source 1..20: mol_type = other DNA
tgcactccagaccccacttt

SEQ ID NO: 10250 - DNA, 20 bp, synthetic construct
  misc_feature 1..20: note = Synthetic Construct
  source 1..20: mol_type = other DNA
tccaggcttctcaggtttgc

SEQ ID NO: 10251 - DNA, 22 bp, synthetic construct
  misc_feature 1..22: note = Synthetic Construct
  source 1..22: mol_type = other DNA
cttactgtccttgctggaacca

SEQ ID NO: 10252 - DNA, 22 bp, synthetic construct
  misc_feature 1..22: note = Synthetic Construct
  source 1..22: mol_type = other DNA
tcaggcccagagaggttgattc

SEQ ID NO: 10253 - DNA, 26 bp, synthetic construct
  misc_feature 1..26: note = Synthetic Construct
  source 1..26: mol_type = other DNA
acctaggaaaaggaattcaggtgaat

SEQ ID NO: 10254 - DNA, 27 bp, synthetic construct
  misc_feature 1..27: note = Synthetic Construct
  source 1..27: mol_type = other DNA
cctttggtttgtaagctgaggttttca

SEQ ID NO: 10255 - DNA, 29 bp, synthetic construct
  misc_feature 1..29: note = Synthetic Construct
  source 1..29: mol_type = other DNA
ccattatgggtaaataagtctccctctag

SEQ ID NO: 10256 - DNA, 20 bp, synthetic construct
  misc_feature 1..20: note = Synthetic Construct
  source 1..20: mol_type = other DNA
tgtcccaggatccagtgtga

SEQ ID NO: 10257 - DNA, 22 bp, synthetic construct
  misc_feature 1..22: note = Synthetic Construct
  source 1..22: mol_type = other DNA
agcctccactttctggattcca

SEQ ID NO: 10258 - DNA, 25 bp, synthetic construct
  misc_feature 1..25: note = Synthetic Construct
  source 1..25: mol_type = other DNA
ccacggactgtctcactttttatgc

SEQ ID NO: 10259 - DNA, 21 bp, synthetic construct
  misc_feature 1..21: note = Synthetic Construct
  source 1..21: mol_type = other DNA
tcacagcctgtccatctcact

SEQ ID NO: 10260 - DNA, 24 bp, synthetic construct
  misc_feature 1..24: note = Synthetic Construct
  source 1..24: mol_type = other DNA
tggctctacctggaatatctgcta

SEQ ID NO: 10261 - DNA, 23 bp, synthetic construct
  misc_feature 1..23: note = Synthetic Construct
  source 1..23: mol_type = other DNA
gagctttcgttttgacccagaag

SEQ ID NO: 10262 - DNA, 28 bp, synthetic construct
  misc_feature 1..28: note = Synthetic Construct
  source 1..28: mol_type = other DNA
ccttacaccttaggggaaaaaaatgtac

SEQ ID NO: 10263 - DNA, 23 bp, synthetic construct
  misc_feature 1..23: note = Synthetic Construct
  source 1..23: mol_type = other DNA
gctgcttaatgggatgttttgca

SEQ ID NO: 10264 - DNA, 26 bp, synthetic construct
  misc_feature 1..26: note = Synthetic Construct
  source 1..26: mol_type = other DNA
ctctcatcctaccttgactcttatgc

SEQ ID NO: 10265 - DNA, 28 bp, synthetic construct
  misc_feature 1..28: note = Synthetic Construct
  source 1..28: mol_type = other DNA
ctttatgatgcaggaagtcagcttatag

SEQ ID NO: 10266 - DNA, 25 bp, synthetic construct
  misc_feature 1..25: note = Synthetic Construct
  source 1..25: mol_type = other DNA
gctccttctagtttcgtgcctttct

SEQ ID NO: 10267 - DNA, 27 bp, synthetic construct
  misc_feature 1..27: note = Synthetic Construct
  source 1..27: mol_type = other DNA
gattagcctcatgaatcctttttccaa

SEQ ID NO: 10268 - DNA, 29 bp, synthetic construct
  misc_feature 1..29: note = Synthetic Construct
  source 1..29: mol_type = other DNA
ctgtacgcactttataataccttggtctt

SEQ ID NO: 10269 - DNA, 21 bp, synthetic construct
  misc_feature 1..21: note = Synthetic Construct
  source 1..21: mol_type = other DNA
tcggggtgtccacattactca

SEQ ID NO: 10270 - DNA, 19 bp, synthetic construct
  misc_feature 1..19: note = Synthetic Construct
  source 1..19: mol_type = other DNA
gcccgacagacaacaacct

SEQ ID NO: 10271 - DNA, 21 bp, synthetic construct
  misc_feature 1..21: note = Synthetic Construct
  source 1..21: mol_type = other DNA
agccacctgccagagaagcta

SEQ ID NO: 10272 - DNA, 23 bp, synthetic construct
  misc_feature 1..23: note = Synthetic Construct
  source 1..23: mol_type = other DNA
ggcagattgcagagtttctgttt

SEQ ID NO: 10273 - DNA, 22 bp, synthetic construct
  misc_feature 1..22: note = Synthetic Construct
  source 1..22: mol_type = other DNA
aggatgacttggttgccctgta

SEQ ID NO: 10274 - DNA, 24 bp, synthetic construct
  misc_feature 1..24: note = Synthetic Construct
  source 1..24: mol_type = other DNA
ctcatgtacacaagtgcagctttt

SEQ ID NO: 10275 - DNA, 28 bp, synthetic construct
  misc_feature 1..28: note = Synthetic Construct
  source 1..28: mol_type = other DNA
gccagatatgacatttagagatggttct

SEQ ID NO: 10276 - DNA, 19 bp, synthetic construct
  misc_feature 1..19: note = Synthetic Construct
  source 1..19: mol_type = other DNA
cctgaggtgaggccccttt

SEQ ID NO: 10277 - DNA, 18 bp, synthetic construct
  misc_feature 1..18: note = Synthetic Construct
  source 1..18: mol_type = other DNA
cgtggcctcggaaactgt

SEQ ID NO: 10278 - DNA, 24 bp, synthetic construct
  misc_feature 1..24: note = Synthetic Construct
  source 1..24: mol_type = other DNA
gggtgccacacaataccctttagt

SEQ ID NO: 10279 - DNA, 28 bp, synthetic construct
  misc_feature 1..28: note = Synthetic Construct
  source 1..28: mol_type = other DNA
gagttcacatgtctgaatctaagctttt

SEQ ID NO: 10280 - DNA, 20 bp, synthetic construct
  misc_feature 1..20: note = Synthetic Construct
  source 1..20: mol_type = other DNA
acttgctggagcctccctaa

SEQ ID NO: 10281 - DNA, 22 bp, synthetic construct
  misc_feature 1..22: note = Synthetic Construct
  source 1..22: mol_type = other DNA
cacatgtcagtagaggcaccat

SEQ ID NO: 10282 - DNA, 23 bp, synthetic construct
  misc_feature 1..23: note = Synthetic Construct
  source 1..23: mol_type = other DNA
gctggatctgcactctctttgaa

SEQ ID NO: 10283 - DNA, 23 bp, synthetic construct
  misc_feature 1..23: note = Synthetic Construct
  source 1..23: mol_type = other DNA
gacttcagccaccacaaatacac

SEQ ID NO: 10284 - DNA, 21 bp, synthetic construct
  misc_feature 1..21: note = Synthetic Construct
  source 1..21: mol_type = other DNA
cctgcctgctgggtatctgta

SEQ ID NO: 10285 - DNA, 30 bp, synthetic construct
  misc_feature 1..30: note = Synthetic Construct
  source 1..30: mol_type = other DNA
tgaaatgctttaaataaagggattggctta

SEQ ID NO: 10286 - DNA, 24 bp, synthetic construct
  misc_feature 1..24: note = Synthetic Construct
  source 1..24: mol_type = other DNA
ggtgtacagcagagtatacatgca

SEQ ID NO: 10287 - DNA, 28 bp, synthetic construct
  misc_feature 1..28: note = Synthetic Construct
  source 1..28: mol_type = other DNA
aaactccagtgaacttttgataactgtt

SEQ ID NO: 10288 - DNA, 18 bp, synthetic construct
  misc_feature 1..18: note = Synthetic Construct
  source 1..18: mol_type = other DNA
aggctagagcgcggcaaa

SEQ ID NO: 10289 - DNA, 21 bp, synthetic construct
  misc_feature 1..21: note = Synthetic Construct
  source 1..21: mol_type = other DNA
tgggagcctcacctgtctttg

SEQ ID NO: 10290 - DNA, 26 bp, synthetic construct
  misc_feature 1..26: note = Synthetic Construct
  source 1..26: mol_type = other DNA
gccagactataacccctgatgaagga

SEQ ID NO: 10291 - DNA, 22 bp, synthetic construct
  misc_feature 1..22: note = Synthetic Construct
  source 1..22: mol_type = other DNA
cagtatagccagtgtgctgaca

SEQ ID NO: 10292 - DNA, 27 bp, synthetic construct
  misc_feature 1..27: note = Synthetic Construct
  source 1..27: mol_type = other DNA
gcaagttaaaactgagctaatgacact

SEQ ID NO: 10293 - DNA, 27 bp, synthetic construct
  misc_feature 1..27: note = Synthetic Construct
  source 1..27: mol_type = other DNA
tgtatagattagcagctacctgtctgt

SEQ ID NO: 10294 - DNA, 22 bp, synthetic construct
  misc_feature 1..22: note = Synthetic Construct
  source 1..22: mol_type = other DNA
ggatgggaaactcagccattcg

SEQ ID NO: 10295 - DNA, 20 bp, synthetic construct
  misc_feature 1..20: note = Synthetic Construct
  source 1..20: mol_type = other DNA
atggggaggccaagttatgc

SEQ ID NO: 10296 - DNA, 28 bp, synthetic construct
  misc_feature 1..28: note = Synthetic Construct
  source 1..28: mol_type = other DNA
gcctcagagtctcctagatgtttttctc

SEQ ID NO: 10297 - DNA, 23 bp, synthetic construct
  misc_feature 1..23: note = Synthetic Construct
  source 1..23: mol_type = other DNA
ggaaaagagtttgtggccaaagg

SEQ ID NO: 10298 - DNA, 23 bp, synthetic construct
  misc_feature 1..23: note = Synthetic Construct
  source 1..23: mol_type = other DNA
tcagtgagcctgtctagaaacct

SEQ ID NO: 10299 - DNA, 26 bp, synthetic construct
  misc_feature 1..26: note = Synthetic Construct
  source 1..26: mol_type = other DNA
cagctcatgattttgtcagaggttct

SEQ ID NO: 10300 - DNA, 26 bp, synthetic construct
  misc_feature 1..26: note = Synthetic Construct
  source 1..26: mol_type = other DNA
acattggggtagaacttttgtttctg

SEQ ID NO: 10301 - DNA, 26 bp, synthetic construct
  misc_feature 1..26: note = Synthetic Construct
  source 1..26: mol_type = other DNA
tcccatatgttatcccatttgtgctt

SEQ ID NO: 10302 - DNA, 20 bp, synthetic construct
  misc_feature 1..20: note = Synthetic Construct
  source 1..20: mol_type = other DNA
cgagcttgctccaggacaca

SEQ ID NO: 10303 - DNA, 20 bp, synthetic construct
  misc_feature 1..20: note = Synthetic Construct
  source 1..20: mol_type = other DNA
cccatgtgctgactgctcaa

SEQ ID NO: 10304 - DNA, 20 bp, synthetic construct
  misc_feature 1..20: note = Synthetic Construct
  source 1..20: mol_type = other DNA
cctgggtcctcagtgagact

SEQ ID NO: 10305 - DNA, 22 bp, synthetic construct
  misc_feature 1..22: note = Synthetic Construct
  source 1..22: mol_type = other DNA
ccctggctgtgaggttttagat

SEQ ID NO: 10306 - DNA, 25 bp, synthetic construct
  misc_feature 1..25: note = Synthetic Construct
  source 1..25: mol_type = other DNA
acataataccaaaacagggcacttg

SEQ ID NO: 10307 - DNA, 21 bp, synthetic construct
  misc_feature 1..21: note = Synthetic Construct
  source 1..21: mol_type = other DNA
accacctcccagtactgttgt

SEQ ID NO: 10308 - DNA, 22 bp, synthetic construct
  misc_feature 1..22: note = Synthetic Construct
  source 1..22: mol_type = other DNA
tcagctactgggcaagaggaat

SEQ ID NO: 10309 - DNA, 30 bp, synthetic construct
  misc_feature 1..30: note = Synthetic Construct
  source 1..30: mol_type = other DNA
gtagtcattttcaagggcaataaaaagttt

SEQ ID NO: 10310 - DNA, 24 bp, synthetic construct
  misc_feature 1..24: note = Synthetic Construct
  source 1..24: mol_type = other DNA
ccactgagagctgaatcaggctat

SEQ ID NO: 10311 - DNA, 28 bp, synthetic construct
  misc_feature 1..28: note = Synthetic Construct
  source 1..28: mol_type = other DNA
gcctgcaaaatctgtcttagaggatgag

SEQ ID NO: 10312 - DNA, 26 bp, synthetic construct
  misc_feature 1..26: note = Synthetic Construct
  source 1..26: mol_type = other DNA
ggatttcattctggcattgtgtagga

SEQ ID NO: 10313 - DNA, 25 bp, synthetic construct
  misc_feature 1..25: note = Synthetic Construct
  source 1..25: mol_type = other DNA
cacagatgcattcactcaaggaaga

SEQ ID NO: 10314 - DNA, 30 bp, synthetic construct
  misc_feature 1..30: note = Synthetic Construct
  source 1..30: mol_type = other DNA
ggatagtttttgggtaagaatttgaactgt

SEQ ID NO: 10315 - DNA, 19 bp, synthetic construct
  misc_feature 1..19: note = Synthetic Construct
  source 1..19: mol_type = other DNA
gattgccatgggccatcct

SEQ ID NO: 10316 - DNA, 28 bp, synthetic construct
  misc_feature 1..28: note = Synthetic Construct
  source 1..28: mol_type = other DNA
gtttcttttaaagtagctccagaaacct

SEQ ID NO: 10317 - DNA, 30 bp, synthetic construct
  misc_feature 1..30: note = Synthetic Construct
  source 1..30: mol_type = other DNA
ctttgtatttagccagattttcctgattgt

SEQ ID NO: 10318 - DNA, 26 bp, synthetic construct
  misc_feature 1..26: note = Synthetic Construct
  source 1..26: mol_type = other DNA
gttaggcaattagtacagtcgttgag

SEQ ID NO: 10319 - DNA, 25 bp, synthetic construct
  misc_feature 1..25: note = Synthetic Construct
  source 1..25: mol_type = other DNA
tccagggtgttctccattgattaag

SEQ ID NO: 10320 - DNA, 22 bp, synthetic construct
  misc_feature 1..22: note = Synthetic Construct
  source 1..22: mol_type = other DNA
gcacacacctccaccaaaagtt

SEQ ID NO: 10321 - DNA, 24 bp, synthetic construct
  misc_feature 1..24: note = Synthetic Construct
  source 1..24: mol_type = other DNA
gcaaacaagtctggaaagatgcat

SEQ ID NO: 10322 - DNA, 24 bp, synthetic construct
  misc_feature 1..24: note = Synthetic Construct
  source 1..24: mol_type = other DNA
tgaactgctctgtggaaacttagt

SEQ ID NO: 10323 - DNA, 25 bp, synthetic construct
  misc_feature 1..25: note = Synthetic Construct
  source 1..25: mol_type = other DNA
cccttgcaattagttagagccacat

SEQ ID NO: 10324 - DNA, 23 bp, synthetic construct
  misc_feature 1..23: note = Synthetic Construct
  source 1..23: mol_type = other DNA
ccctgcaacaagttcttctcact

SEQ ID NO: 10325 - DNA, 22 bp, synthetic construct
  misc_feature 1..22: note = Synthetic Construct
  source 1..22: mol_type = other DNA
cccttcagcacgttcttatcct

SEQ ID NO: 10326 - DNA, 24 bp, synthetic construct
  misc_feature 1..24: note = Synthetic Construct
  source 1..24: mol_type = other DNA
cacagtctgcacgaatgttatgtg

SEQ ID NO: 10327 - DNA, 24 bp, synthetic construct
  misc_feature 1..24: note = Synthetic Construct
  source 1..24: mol_type = other DNA
tgcattgtttcacactgtgaagtt

SEQ ID NO: 10328 - DNA, 29 bp, synthetic construct
  misc_feature 1..29: note = Synthetic Construct
  source 1..29: mol_type = other DNA
ggctttatttctcactgatgggaatagca

SEQ ID NO: 10329 - DNA, 26 bp, synthetic construct
  misc_feature 1..26: note = Synthetic Construct
  source 1..26: mol_type = other DNA
gtggttgcatattgatttgcttagga

SEQ ID NO: 10330 - DNA, 22 bp, synthetic construct
  misc_feature 1..22: note = Synthetic Construct
  source 1..22: mol_type = other DNA
ggctgtacctccctttcaaact

SEQ ID NO: 10331 - DNA, 23 bp, synthetic construct
  misc_feature 1..23: note = Synthetic Construct
  source 1..23: mol_type = other DNA
cacttttaacaccgcctgaggta

SEQ ID NO: 10332 - DNA, 22 bp, synthetic construct
  misc_feature 1..22: note = Synthetic Construct
  source 1..22: mol_type = other DNA
cccatcccagaaacactgaagt

SEQ ID NO: 10333 - DNA, 22 bp, synthetic construct
  misc_feature 1..22: note = Synthetic Construct
  source 1..22: mol_type = other DNA
tcaggcagaccaagatgtgaga

SEQ ID NO: 10334 - DNA, 21 bp, synthetic construct
  misc_feature 1..21: note = Synthetic Construct
  source 1..21: mol_type = other DNA
tgctctgaggcccataaacac

SEQ ID NO: 10335 - DNA, 22 bp, synthetic construct
  misc_feature 1..22: note = Synthetic Construct
  source 1..22: mol_type = other DNA
ttcagccttgcaagagcttcct

SEQ ID NO: 10336 - DNA, 20 bp, synthetic construct
  misc_feature 1..20: note = Synthetic Construct
  source 1..20: mol_type = other DNA
tggtaggtccaaggcactgt

SEQ ID NO: 10337 - DNA, 19 bp, synthetic construct
  misc_feature 1..19: note = Synthetic Construct
  source 1..19: mol_type = other DNA
agtgtcccccacccactct

SEQ ID NO: 10338 - DNA, 28 bp, synthetic construct
  misc_feature 1..28: note = Synthetic Construct
  source 1..28: mol_type = other DNA
ggtacaaatcagagcacagattttcttt

SEQ ID NO: 10339 - DNA, 26 bp, synthetic construct
  misc_feature 1..26: note = Synthetic Construct
  source 1..26: mol_type = other DNA
ctgtttcttgaagctgagactttcac

SEQ ID NO: 10340 - DNA, 22 bp, synthetic construct
  misc_feature 1..22: note = Synthetic Construct
  source 1..22: mol_type = other DNA
ttctcgaacaaggaggcacagt

SEQ ID NO: 10341 - DNA, 19 bp, synthetic construct
  misc_feature 1..19: note = Synthetic Construct
  source 1..19: mol_type = other DNA
acgttcacacagccgtgaa

SEQ ID NO: 10342 - DNA, 20 bp, synthetic construct
  misc_feature 1..20: note = Synthetic Construct
  source 1..20: mol_type = other DNA
gccatggacagtgcccttca

SEQ ID NO: 10343 - DNA, 26 bp, synthetic construct
  misc_feature 1..26: note = Synthetic Construct
  source 1..26: mol_type = other DNA
gccattttctacaggagcatgaagag

SEQ ID NO: 10344 - DNA, 24 bp, synthetic construct
  misc_feature 1..24: note = Synthetic Construct
  source 1..24: mol_type = other DNA
ccctttggagtaggagccttcaaa

SEQ ID NO: 10345 - DNA, 26 bp, synthetic construct
  misc_feature 1..26: note = Synthetic Construct
  source 1..26: mol_type = other DNA
gcttccacaaactgaaaacagagaga

SEQ ID NO: 10346 - DNA, 22 bp, synthetic construct
  misc_feature 1..22: note = Synthetic Construct
  source 1..22: mol_type = other DNA
tgcagaagcgttagttgctttg

SEQ ID NO: 10347 - DNA, 20 bp, synthetic construct
  misc_feature 1..20: note = Synthetic Construct
  source 1..20: mol_type = other DNA
ggagcagagcgttgcttagg

SEQ ID NO: 10348 - DNA, 25 bp, synthetic construct
  misc_feature 1..25: note = Synthetic Construct
  source 1..25: mol_type = other DNA
ggatgaggaggacacatgtcattgt

SEQ ID NO: 10349 - DNA, 30 bp, synthetic construct
  misc_feature 1..30: note = Synthetic Construct
  source 1..30: mol_type = other DNA
cgaatatctgacttagtcctaaaacaacag

SEQ ID NO: 10350 - DNA, 29 bp, synthetic construct
  misc_feature 1..29: note = Synthetic Construct
  source 1..29: mol_type = other DNA
gcctctagtataatggggtataccttgtc

SEQ ID NO: 10351 - DNA, 25 bp, synthetic construct
  misc_feature 1..25: note = Synthetic Construct
  source 1..25: mol_type = other DNA
gccccaattccactggactaaattc

SEQ ID NO: 10352 - DNA, 29 bp, synthetic construct
  misc_feature 1..29: note = Synthetic Construct
  source 1..29: mol_type = other DNA
tgattcgaataactaggggagtatagact

SEQ ID NO: 10353 - DNA, 22 bp, synthetic construct
  misc_feature 1..22: note = Synthetic Construct
  source 1..22: mol_type = other DNA
acacacttttccacctgcatct

SEQ ID NO: 10354 - DNA, 22 bp, synthetic construct
  misc_feature 1..22: note = Synthetic Construct
  source 1..22: mol_type = other DNA
ttctgcactttgtgtcctgtca

SEQ ID NO: 10355 - DNA, 24 bp, synthetic construct
  misc_feature 1..24: note = Synthetic Construct
  source 1..24: mol_type = other DNA
tccttgttcctaggagatcaatgc

SEQ ID NO: 10356 - DNA, 25 bp, synthetic construct
  misc_feature 1..25: note = Synthetic Construct
  source 1..25: mol_type = other DNA
gcacacatcctgtagtgatttccaa

SEQ ID NO: 10357 - DNA, 25 bp, synthetic construct
  misc_feature 1..25: note = Synthetic Construct
  source 1..25: mol_type = other DNA
cacaatacacagaaacctggaagca

SEQ ID NO: 10358 - DNA, 21 bp, synthetic construct
  misc_feature 1..21: note = Synthetic Construct
  source 1..21: mol_type = other DNA
gctggggagaaggaatttgct

SEQ ID NO: 10359 - DNA, 26 bp, synthetic construct
  misc_feature 1..26: note = Synthetic Construct
  source 1..26: mol_type = other DNA
cccttagcagtacttttccagttagg

SEQ ID NO: 10360 - DNA, 24 bp, synthetic construct
  misc_feature 1..24: note = Synthetic Construct
  source 1..24: mol_type = other DNA
aggcatccgaccaaagagtcttag

SEQ ID NO: 10361 - DNA, 28 bp, synthetic construct
  misc_feature 1..28: note = Synthetic Construct
  source 1..28: mol_type = other DNA
acaagcttaaactcatatagcctcttct

SEQ ID NO: 10362 - DNA, 29 bp, synthetic construct
  misc_feature 1..29: note = Synthetic Construct
  source 1..29: mol_type = other DNA
gctagttcttcaactggaaatgatgaaaa

SEQ ID NO: 10363 - DNA, 23 bp, synthetic construct
  misc_feature 1..23: note = Synthetic Construct
  source 1..23: mol_type = other DNA
agagctagagtacagcaggaagt

SEQ ID NO: 10364 - DNA, 28 bp, synthetic construct
  misc_feature 1..28: note = Synthetic Construct
  source 1..28: mol_type = other DNA
ctcatttctttgtgttttaggggtatgt

SEQ ID NO: 10365 - DNA, 22 bp, synthetic construct
  misc_feature 1..22: note = Synthetic Construct
  source 1..22: mol_type = other DNA
gggcagctctgaactgtcattg

SEQ ID NO: 10366 - DNA, 30 bp, synthetic construct
  misc_feature 1..30: note = Synthetic Construct
  source 1..30: mol_type = other DNA
ctctcccatttcttaattcctcagactttt

SEQ ID NO: 10367 - DNA, 24 bp, synthetic construct
  misc_feature 1..24: note = Synthetic Construct
  source 1..24: mol_type = other DNA
ctgccatcaacacatttcctttcc

SEQ ID NO: 10368 - DNA, 22 bp, synthetic construct
  misc_feature 1..22: note = Synthetic Construct
  source 1..22: mol_type = other DNA
agtcccaatgcctcactttggt

SEQ ID NO: 10369 - DNA, 19 bp, synthetic construct
  misc_feature 1..19: note = Synthetic Construct
  source 1..19: mol_type = other DNA
tccggagccctgaggagtt

SEQ ID NO: 10370 - DNA, 27 bp, synthetic construct
  misc_feature 1..27: note = Synthetic Construct
  source 1..27: mol_type = other DNA
ccaaccatgaatttgtgttaagcacta

SEQ ID NO: 10371 - DNA, 23 bp, synthetic construct
  misc_feature 1..23: note = Synthetic Construct
  source 1..23: mol_type = other DNA
attctgtgggaggatgactttgg

SEQ ID NO: 10372 - DNA, 22 bp, synthetic construct
  misc_feature 1..22: note = Synthetic Construct
  source 1..22: mol_type = other DNA
ccaggcatacaaccatgtcaga

SEQ ID NO: 10373 - DNA, 26 bp, synthetic construct
  misc_feature 1..26: note = Synthetic Construct
  source 1..26: mol_type = other DNA
ctcttacacctagacaagctgatcag

SEQ ID NO: 10374 - DNA, 26 bp, synthetic construct
  misc_feature 1..26: note = Synthetic Construct
  source 1..26: mol_type = other DNA
gttctcagggatatttctgccatcag

SEQ ID NO: 10375 - DNA, 22 bp, synthetic construct
  misc_feature 1..22: note = Synthetic Construct
  source 1..22: mol_type = other DNA
tccctctgaaggcagacatgga

SEQ ID NO: 10376 - DNA, 22 bp, synthetic construct
  misc_feature 1..22: note = Synthetic Construct
  source 1..22: mol_type = other DNA
caaggaaggcttcagctatggt

SEQ ID NO: 10377 - DNA, 26 bp, synthetic construct
  misc_feature 1..26: note = Synthetic Construct
  source 1..26: mol_type = other DNA
ttggagttctccaaatagccctattt

SEQ ID NO: 10378 - DNA, 23 bp, synthetic construct
  misc_feature 1..23: note = Synthetic Construct
  source 1..23: mol_type = other DNA
aagaagggcctctgcattatcag

SEQ ID NO: 10379 - DNA, 24 bp, synthetic construct
  misc_feature 1..24: note = Synthetic Construct
  source 1..24: mol_type = other DNA
gccctgacagtgatgtttgttctc

SEQ ID NO: 10380 - DNA, 26 bp, synthetic construct
  misc_feature 1..26: note = Synthetic Construct
  source 1..26: mol_type = other DNA
catagaaatcaggcaattgacaagct

SEQ ID NO: 10381 - DNA, 21 bp, synthetic construct
  misc_feature 1..21: note = Synthetic Construct
  source 1..21: mol_type = other DNA
cgcaaggagctcaagttcaag

SEQ ID NO: 10382 - DNA, 29 bp, synthetic construct
  misc_feature 1..29: note = Synthetic Construct
  source 1..29: mol_type = other DNA
gttacaaaatagtcagaagtctggtctca

SEQ ID NO: 10383 - DNA, 18 bp, synthetic construct
  misc_feature 1..18: note = Synthetic Construct
  source 1..18: mol_type = other DNA
gcagcaggcagggagaag

SEQ ID NO: 10384 - DNA, 24 bp, synthetic construct
  misc_feature 1..24: note = Synthetic Construct
  source 1..24: mol_type = other DNA
acaaccacagaaggatgtcaactg

SEQ ID NO: 10385 - DNA, 26 bp, synthetic construct
  misc_feature 1..26: note = Synthetic Construct
  source 1..26: mol_type = other DNA
gcttatgggagaaactatggattcca

SEQ ID NO: 10386 - DNA, 19 bp, synthetic construct
  misc_feature 1..19: note = Synthetic Construct
  source 1..19: mol_type = other DNA
agaggtggtcgggcatgga

SEQ ID NO: 10387 - DNA, 23 bp, synthetic construct
  misc_feature 1..23: note = Synthetic Construct
  source 1..23: mol_type = other DNA
tggttctaaaagccatccttgca

SEQ ID NO: 10388 - DNA, 22 bp, synthetic construct
  misc_feature 1..22: note = Synthetic Construct
  source 1..22: mol_type = other DNA
tcatctctcccctctcaacgaa

SEQ ID NO: 10389 - DNA, 24 bp, synthetic construct
  misc_feature 1..24: note = Synthetic Construct
  source 1..24: mol_type = other DNA
gccccaagagatgtttttattgca

SEQ ID NO: 10390 - DNA, 24 bp, synthetic construct
  misc_feature 1..24: note = Synthetic Construct
  source 1..24: mol_type = other DNA
gccagcttcaaatgcctctatctc

SEQ ID NO: 10391 - DNA, 20 bp, synthetic construct
  misc_feature 1..20: note = Synthetic Construct
  source 1..20: mol_type = other DNA
aacacaggaggggcaggata

SEQ ID NO: 10392 - DNA, 22 bp, synthetic construct
  misc_feature 1..22: note = Synthetic Construct
  source 1..22: mol_type = other DNA
ctaagcacagctggtgttttgg

SEQ ID NO: 10393 - DNA, 22 bp, synthetic construct
  misc_feature 1..22: note = Synthetic Construct
  source 1..22: mol_type = other DNA
tctgcttccactggagtttgag

SEQ ID NO: 10394 - DNA, 24 bp, synthetic construct
  misc_feature 1..24: note = Synthetic Construct
  source 1..24: mol_type = other DNA
tcagaaaggcagtagaagctcaat

SEQ ID NO: 10395 - DNA, 21 bp, synthetic construct
  misc_feature 1..21: note = Synthetic Construct
  source 1..21: mol_type = other DNA
tgaaggcttggtcaacttggt

SEQ ID NO: 10396 - DNA, 30 bp, synthetic construct
  misc_feature 1..30: note = Synthetic Construct
  source 1..30: mol_type = other DNA
gacctagatgatctcatatcttgcataaac

SEQ ID NO: 10397 - DNA, 24 bp, synthetic construct
  misc_feature 1..24: note = Synthetic Construct
  source 1..24: mol_type = other DNA
gcgaggcctcaattacatgtacac

SEQ ID NO: 10398 - DNA, 24 bp, synthetic construct
  misc_feature 1..24: note = Synthetic Construct
  source 1..24: mol_type = other DNA
gactggtactgggaagactgttgt

SEQ ID NO: 10399 - DNA, 24 bp, synthetic construct
  misc_feature 1..24: note = Synthetic Construct
  source 1..24: mol_type = other DNA
gaccaaatccaggggtcaattttc

SEQ ID NO: 10400 - DNA, 24 bp, synthetic construct
  misc_feature 1..24: note = Synthetic Construct
  source 1..24: mol_type = other DNA
ggaaccaaagcatcaagaaggaaa

SEQ ID NO: 10401 - DNA, 21 bp, synthetic construct
  misc_feature 1..21: note = Synthetic Construct
  source 1..21: mol_type = other DNA
tctgcttgcctggctgagtaa

SEQ ID NO: 10402 - DNA, 22 bp, synthetic construct
  misc_feature 1..22: note = Synthetic Construct
  source 1..22: mol_type = other DNA
tcctggcagattcacccaactc

SEQ ID NO: 10403 - DNA, 21 bp, synthetic construct
  misc_feature 1..21: note = Synthetic Construct
  source 1..21: mol_type = other DNA
agaaaaggggcttggaatgca

SEQ ID NO: 10404 - DNA, 26 bp, synthetic construct
  misc_feature 1..26: note = Synthetic Construct
  source 1..26: mol_type = other DNA
gcattgatacagtttctggcaaattc

SEQ ID NO: 10405 - DNA, 24 bp, synthetic construct
  misc_feature 1..24: note = Synthetic Construct
  source 1..24: mol_type = other DNA
cctctccctcaacaacccagtttt

SEQ ID NO: 10406 - DNA, 29 bp, synthetic construct
  misc_feature 1..29: note = Synthetic Construct
  source 1..29: mol_type = other DNA
cagaaaaattagtttccactccacttctc

SEQ ID NO: 10407 - DNA, 20 bp, synthetic construct
  misc_feature 1..20: note = Synthetic Construct
  source 1..20: mol_type = other DNA
gcagccatccaggagcagaa

SEQ ID NO: 10408 - DNA, 24 bp, synthetic construct
  misc_feature 1..24: note = Synthetic Construct
  source 1..24: mol_type = other DNA
gggtctgtggaattttccttctga

SEQ ID NO: 10409 - DNA, 25 bp, synthetic construct
  misc_feature 1..25: note = Synthetic Construct
  source 1..25: mol_type = other DNA
ccactctggctaatttaagcacaaa

SEQ ID NO: 10410 - DNA, 27 bp, synthetic construct
  misc_feature 1..27: note = Synthetic Construct
  source 1..27: mol_type = other DNA
ggaagaagagctcattgtcaaatactg

SEQ ID NO: 10411 - DNA, 28 bp, synthetic construct
  misc_feature 1..28: note = Synthetic Construct
  source 1..28: mol_type = other DNA
ttttcaattcctgactccattgaagtac

SEQ ID NO: 10412 - DNA, 24 bp, synthetic construct
  misc_feature 1..24: note = Synthetic Construct
  source 1..24: mol_type = other DNA
acaaaaaggctccctaaactagct

SEQ ID NO: 10413 - DNA, 20 bp, synthetic construct
  misc_feature 1..20: note = Synthetic Construct
  source 1..20: mol_type = other DNA
caccatgatgccaggggaaa

SEQ ID NO: 10414 - DNA, 21 bp, synthetic construct
  misc_feature 1..21: note = Synthetic Construct
  source 1..21: mol_type = other DNA
aggctcctaagctgcatttgg

SEQ ID NO: 10415 - DNA, 22 bp, synthetic construct
  misc_feature 1..22: note = Synthetic Construct
  source 1..22: mol_type = other DNA
tgccagggaagtgacatttcca

SEQ ID NO: 10416 - DNA, 25 bp, synthetic construct
  misc_feature 1..25: note = Synthetic Construct
  source 1..25: mol_type = other DNA
gtgacttcaggtgagaaaagatgct

SEQ ID NO: 10417 - DNA, 18 bp, synthetic construct
  misc_feature 1..18: note = Synthetic Construct
  source 1..18: mol_type = other DNA
gggcgaccgtccacatgt

SEQ ID NO: 10418 - DNA, 22 bp, synthetic construct
  misc_feature 1..22: note = Synthetic Construct
  source 1..22: mol_type = other DNA
ctggaaaactggcccaataggt

SEQ ID NO: 10419 - DNA, 28 bp, synthetic construct
  misc_feature 1..28: note = Synthetic Construct
  source 1..28: mol_type = other DNA
ccatggttatctgttcagttactttcaa

SEQ ID NO: 10420 - DNA, 22 bp, synthetic construct
  misc_feature 1..22: note = Synthetic Construct
  source 1..22: mol_type = other DNA
gcacctactttgtgcctagagt

SEQ ID NO: 10421 - DNA, 22 bp, synthetic construct
  misc_feature 1..22: note = Synthetic Construct
  source 1..22: mol_type = other DNA
cttctgcccccaaacaaaggaa

SEQ ID NO: 10422 - DNA, 24 bp, synthetic construct
  misc_feature 1..24: note = Synthetic Construct
  source 1..24: mol_type = other DNA
ctgtgtccattccttctccaatga

SEQ ID NO: 10423 - DNA, 22 bp, synthetic construct
  misc_feature 1..22: note = Synthetic Construct
  source 1..22: mol_type = other DNA
gctggctggcactgttacatat

SEQ ID NO: 10424 - DNA, 26 bp, synthetic construct
  misc_feature 1..26: note = Synthetic Construct
  source 1..26: mol_type = other DNA
gcaattgacctagtatctgactgcaa

SEQ ID NO: 10425 - DNA, 22 bp, synthetic construct
  misc_feature 1..22: note = Synthetic Construct
  source 1..22: mol_type = other DNA
cacagcatggttgagacctgtt

SEQ ID NO: 10426 - DNA, 25 bp, synthetic construct
  misc_feature 1..25: note = Synthetic Construct
  source 1..25: mol_type = other DNA
ggtgcactggaagtaaccatagcaa

SEQ ID NO: 10427 - DNA, 24 bp, synthetic construct
  misc_feature 1..24: note = Synthetic Construct
  source 1..24: mol_type = other DNA
gccttcacacaacaaacctgactt

SEQ ID NO: 10428 - DNA, 22 bp, synthetic construct
  misc_feature 1..22: note = Synthetic Construct
  source 1..22: mol_type = other DNA
acctgttgactttgggctgcat

SEQ ID NO: 10429 - DNA, 25 bp, synthetic construct
  misc_feature 1..25: note = Synthetic Construct
  source 1..25: mol_type = other DNA
gctgaaactctgggcatgttattct

SEQ ID NO: 10430 - DNA, 22 bp, synthetic construct
  misc_feature 1..22: note = Synthetic Construct
  source 1..22: mol_type = other DNA
gacacatgggacttgcaattcg

SEQ ID NO: 10431 - DNA, 22 bp, synthetic construct
  misc_feature 1..22: note = Synthetic Construct
  source 1..22: mol_type = other DNA
tgcgcctactttcccgttaagg

SEQ ID NO: 10432 - DNA, 23 bp, synthetic construct
  misc_feature 1..23: note = Synthetic Construct
  source 1..23: mol_type = other DNA
agtgcctgattggtattggcttt

SEQ ID NO: 10433 - DNA, 21 bp, synthetic construct
  misc_feature 1..21: note = Synthetic Construct
  source 1..21: mol_type = other DNA
accatgaaattgtgcgcaaca

SEQ ID NO: 10434 - DNA, 24 bp, synthetic construct
  misc_feature 1..24: note = Synthetic Construct
  source 1..24: mol_type = other DNA
cacactatacctccagccagaatc

SEQ ID NO: 10435 - DNA, 24 bp, synthetic construct
  misc_feature 1..24: note = Synthetic Construct
  source 1..24: mol_type = other DNA
gggagagcaaagggtacttaggaa

SEQ ID NO: 10436 - DNA, 19 bp, synthetic construct
  misc_feature 1..19: note = Synthetic Construct
  source 1..19: mol_type = other DNA
gggctcaggtggagtttcc

SEQ ID NO: 10437 - DNA, 25 bp, synthetic construct
  misc_feature 1..25: note = Synthetic Construct
  source 1..25: mol_type = other DNA
tgctcagttcctcttaaccattacc

SEQ ID NO: 10438 - DNA, 20 bp, synthetic construct
  misc_feature 1..20: note = Synthetic Construct
  source 1..20: mol_type = other DNA
gctgagctcttgccatggtt

SEQ ID NO: 10439 - DNA, 25 bp, synthetic construct
  misc_feature 1..25: note = Synthetic Construct
  source 1..25: mol_type = other DNA
cagatcttgggaatcatggttctct

SEQ ID NO: 10440 - DNA, 23 bp, synthetic construct
  misc_feature 1..23: note = Synthetic Construct
  source 1..23: mol_type = other DNA
agccctcgataatgtcagtgatc

SEQ ID NO: 10441 - DNA, 19 bp, synthetic construct
  misc_feature 1..19: note = Synthetic Construct
  source 1..19: mol_type = other DNA
actccctgcctccctgcat

SEQ ID NO: 10442 - DNA, 28 bp, synthetic construct
  misc_feature 1..28: note = Synthetic Construct
  source 1..28: mol_type = other DNA
ggataccatcatagttctgggaatggat

SEQ ID NO: 10443 - DNA, 23 bp, synthetic construct
  misc_feature 1..23: note = Synthetic Construct
  source 1..23: mol_type = other DNA
ttccccaggctcaggtcataaga

SEQ ID NO: 10444 - DNA, 21 bp, synthetic construct
  misc_feature 1..21: note = Synthetic Construct
  source 1..21: mol_type = other DNA
accactccggagcaaacaaca

SEQ ID NO: 10445 - DNA, 24 bp, synthetic construct
  misc_feature 1..24: note = Synthetic Construct
  source 1..24: mol_type = other DNA
gctgtttaccagaggaggacatca

SEQ ID NO: 10446 - DNA, 22 bp, synthetic construct
  misc_feature 1..22: note = Synthetic Construct
  source 1..22: mol_type = other DNA
agtgcaggagagaagtgatggt

SEQ ID NO: 10447 - DNA, 22 bp, synthetic construct
  misc_feature 1..22: note = Synthetic Construct
  source 1..22: mol_type = other DNA
tggaagcatgaagtgggttctc

SEQ ID NO: 10448 - DNA, 28 bp, synthetic construct
  misc_feature 1..28: note = Synthetic Construct
  source 1..28: mol_type = other DNA
gcaaaaacaactcctggtaacttcattg

SEQ ID NO: 10449 - DNA, 30 bp, synthetic construct
  misc_feature 1..30: note = Synthetic Construct
  source 1..30: mol_type = other DNA
cctgcattatcagttttcagagcaaaagaa

SEQ ID NO: 10450 - DNA, 20 bp, synthetic construct
  misc_feature 1..20: note = Synthetic Construct
  source 1..20: mol_type = other DNA
tgcctggggttgggagaaga

SEQ ID NO: 10451 - DNA, 25 bp, synthetic construct
  misc_feature 1..25: note = Synthetic Construct
  source 1..25: mol_type = other DNA
tttcttatggaaaggggacaactca

SEQ ID NO: 10452 - DNA, 27 bp, synthetic construct
  misc_feature 1..27: note = Synthetic Construct
  source 1..27: mol_type = other DNA
acctagtaggctgtagtagaacaactt

SEQ ID NO: 10453 - DNA, 20 bp, synthetic construct
  misc_feature 1..20: note = Synthetic Construct
  source 1..20: mol_type = other DNA
acacaaccccacacaaccat

SEQ ID NO: 10454 - DNA, 23 bp, synthetic construct
  misc_feature 1..23: note = Synthetic Construct
  source 1..23: mol_type = other DNA
gctttagctactgtggtcacctt

SEQ ID NO: 10455 - DNA, 24 bp, synthetic construct
  misc_feature 1..24: note = Synthetic Construct
  source 1..24: mol_type = other DNA
ctatcacttacacccacccctttc

SEQ ID NO: 10456 - DNA, 22 bp, synthetic construct
  misc_feature 1..22: note = Synthetic Construct
  source 1..22: mol_type = other DNA
tctggcctgataacctgctgat

SEQ ID NO: 10457 - DNA, 25 bp, synthetic construct
  misc_feature 1..25: note = Synthetic Construct
  source 1..25: mol_type = other DNA
ggaagactgtcacatctctggtgat

SEQ ID NO: 10458 - DNA, 29 bp, synthetic construct
  misc_feature 1..29: note = Synthetic Construct
  source 1..29: mol_type = other DNA
gtaatgttagtagccagatcagctatact

SEQ ID NO: 10459 - DNA, 25 bp, synthetic construct
  misc_feature 1..25: note = Synthetic Construct
  source 1..25: mol_type = other DNA
cttggaaaaggtaccatgaggatga

SEQ ID NO: 10460 - DNA, 25 bp, synthetic construct
  misc_feature 1..25: note = Synthetic Construct
  source 1..25: mol_type = other DNA
gcagaaatgcttccaccaacttcct

SEQ ID NO: 10461 - DNA, 22 bp, synthetic construct
  misc_feature 1..22: note = Synthetic Construct
  source 1..22: mol_type = other DNA
tctgagccaggcatgtctatgg

SEQ ID NO: 10462 - DNA, 27 bp, synthetic construct
  misc_feature 1..27: note = Synthetic Construct
  source 1..27: mol_type = other DNA
ggaactgaggatcagaaaggtatttgg

SEQ ID NO: 10463 - DNA, 25 bp, synthetic construct
  misc_feature 1..25: note = Synthetic Construct
  source 1..25: mol_type = other DNA
gttctaagaagacgagcagcatctt

SEQ ID NO: 10464 - DNA, 24 bp, synthetic construct
  misc_feature 1..24: note = Synthetic Construct
  source 1..24: mol_type = other DNA
tgagcaactcttccttccataggt

SEQ ID NO: 10465 - DNA, 24 bp, synthetic construct
  misc_feature 1..24: note = Synthetic Construct
  source 1..24: mol_type = other DNA
ggttggggaataaaggggaaaagc

SEQ ID NO: 10466 - DNA, 24 bp, synthetic construct
  misc_feature 1..24: note = Synthetic Construct
  source 1..24: mol_type = other DNA
ggtggacccttcttcattcttgac

SEQ ID NO: 10467 - DNA, 25 bp, synthetic construct
  misc_feature 1..25: note = Synthetic Construct
  source 1..25: mol_type = other DNA
tgcagactaaagaagagggaaagtg

SEQ ID NO: 10468 - DNA, 20 bp, synthetic construct
  misc_feature 1..20: note = Synthetic Construct
  source 1..20: mol_type = other DNA
tcccaccccatcagcaaagg

SEQ ID NO: 10469 - DNA, 19 bp, synthetic construct
  misc_feature 1..19: note = Synthetic Construct
  source 1..19: mol_type = other DNA
agtgcagggctggaaactc

SEQ ID NO: 10470 - DNA, 22 bp, synthetic construct
  misc_feature 1..22: note = Synthetic Construct
  source 1..22: mol_type = other DNA
tctcccatcaatcccagttgca

SEQ ID NO: 10471 - DNA, 27 bp, synthetic construct
  misc_feature 1..27: note = Synthetic Construct
  source 1..27: mol_type = other DNA
agattttctctcagcaactacttctca

SEQ ID NO: 10472 - DNA, 22 bp, synthetic construct
  misc_feature 1..22: note = Synthetic Construct
  source 1..22: mol_type = other DNA
ggacaaggggcatgtacaaaac

SEQ ID NO: 10473 - DNA, 19 bp, synthetic construct
  misc_feature 1..19: note = Synthetic Construct
  source 1..19: mol_type = other DNA
tgtgggagggtgagaccaa

SEQ ID NO: 10474 - DNA, 22 bp, synthetic construct
  misc_feature 1..22: note = Synthetic Construct
  source 1..22: mol_type = other DNA
tggctcatcatcatgggtctgt

SEQ ID NO: 10475 - DNA, 26 bp, synthetic construct
  misc_feature 1..26: note = Synthetic Construct
  source 1..26: mol_type = other DNA
atagtataacaagcaagtgggatggt

SEQ ID NO: 10476 - DNA, 27 bp, synthetic construct
  misc_feature 1..27: note = Synthetic Construct
  source 1..27: mol_type = other DNA
gagagttctgtacctgtgtgtatcttc

SEQ ID NO: 10477 - DNA, 27 bp, synthetic construct
  misc_feature 1..27: note = Synthetic Construct
  source 1..27: mol_type = other DNA
caggattttagacctagcacatacaga

SEQ ID NO: 10478 - DNA, 26 bp, synthetic construct
  misc_feature 1..26: note = Synthetic Construct
  source 1..26: mol_type = other DNA
agaaaagatctcctggaggaaatgac

SEQ ID NO: 10479 - DNA, 23 bp, synthetic construct
  misc_feature 1..23: note = Synthetic Construct
  source 1..23: mol_type = other DNA
caactgctcctgaatcccttttg

SEQ ID NO: 10480 - DNA, 23 bp, synthetic construct
  misc_feature 1..23: note = Synthetic Construct
  source 1..23: mol_type = other DNA
aaatcctgccacctctgtaaaca

SEQ ID NO: 10481 - DNA, 22 bp, synthetic construct
  misc_feature 1..22: note = Synthetic Construct
  source 1..22: mol_type = other DNA
gggtctgtaaagggctctgttc

SEQ ID NO: 10482 - DNA, 27 bp, synthetic construct
  misc_feature 1..27: note = Synthetic Construct
  source 1..27: mol_type = other DNA
gacctgagaaaagagtgttatccaaga

SEQ ID NO: 10483 - DNA, 20 bp, synthetic construct
  misc_feature 1..20: note = Synthetic Construct
  source 1..20: mol_type = other DNA
cctggtctgtgcttcaccaa

SEQ ID NO: 10484 - DNA, 25 bp, synthetic construct
  misc_feature 1..25: note = Synthetic Construct
  source 1..25: mol_type = other DNA
ctcacagttaagcgacctctttcag

SEQ ID NO: 10485 - DNA, 24 bp, synthetic construct
  misc_feature 1..24: note = Synthetic Construct
  source 1..24: mol_type = other DNA
ggatattcagctgctcctgtgaga

SEQ ID NO: 10486 - DNA, 26 bp, synthetic construct
  misc_feature 1..26: note = Synthetic Construct
  source 1..26: mol_type = other DNA
cataggacaatgagacccatgtactt

SEQ ID NO: 10487 - DNA, 22 bp, synthetic construct
  misc_feature 1..22: note = Synthetic Construct
  source 1..22: mol_type = other DNA
cagagttccagaagtggcttct

SEQ ID NO: 10488 - DNA, 26 bp, synthetic construct
  misc_feature 1..26: note = Synthetic Construct
  source 1..26: mol_type = other DNA
aagtttattactgccagagactttgc

SEQ ID NO: 10489 - DNA, 22 bp, synthetic construct
  misc_feature 1..22: note = Synthetic Construct
  source 1..22: mol_type = other DNA
acgacctttgctgagagaaggt

SEQ ID NO: 10490 - DNA, 22 bp, synthetic construct
  misc_feature 1..22: note = Synthetic Construct
  source 1..22: mol_type = other DNA
ctgttcagggcttgatctccat

SEQ ID NO: 10491 - DNA, 21 bp, synthetic construct
  misc_feature 1..21: note = Synthetic Construct
  source 1..21: mol_type = other DNA
cttcagtggcaaggagacctt

SEQ ID NO: 10492 - DNA, 25 bp, synthetic construct
  misc_feature 1..25: note = Synthetic Construct
  source 1..25: mol_type = other DNA
ggaccattttcagcaacacccctat

SEQ ID NO: 10493 - DNA, 30 bp, synthetic construct
  misc_feature 1..30: note = Synthetic Construct
  source 1..30: mol_type = other DNA
tgttaaaagtttttcgtctagaaagaggaa

SEQ ID NO: 10494 - DNA, 23 bp, synthetic construct
  misc_feature 1..23: note = Synthetic Construct
  source 1..23: mol_type = other DNA
ctccttttctttgcctcctttgc

SEQ ID NO: 10495 - DNA, 18 bp, synthetic construct
  misc_feature 1..18: note = Synthetic Construct
  source 1..18: mol_type = other DNA
tcccctccccagctgaca

SEQ ID NO: 10496 - DNA, 20 bp, synthetic construct
  misc_feature 1..20: note = Synthetic Construct
  source 1..20: mol_type = other DNA
gcccatgccaacaaggtgaa

SEQ ID NO: 10497 - DNA, 24 bp, synthetic construct
  misc_feature 1..24: note = Synthetic Construct
  source 1..24: mol_type = other DNA
cctagacgagctgatctgagtaca

SEQ ID NO: 10498 - DNA, 27 bp, synthetic construct
  misc_feature 1..27: note = Synthetic Construct
  source 1..27: mol_type = other DNA
ctgttaagtgccaactcttttgtctct

SEQ ID NO: 10499 - DNA, 27 bp, synthetic construct
  misc_feature 1..27: note = Synthetic Construct
  source 1..27: mol_type = other DNA
aggttgttctagcaaagatgaaaactg

SEQ ID NO: 10500 - DNA, 25 bp, synthetic construct
  misc_feature 1..25: note = Synthetic Construct
  source 1..25: mol_type = other DNA
cctgtgcaatcaattccatgccata

SEQ ID NO: 10501 - DNA, 24 bp, synthetic construct
  misc_feature 1..24: note = Synthetic Construct
  source 1..24: mol_type = other DNA
acttcatattgcctgagccaaaga

SEQ ID NO: 10502 - DNA, 29 bp, synthetic construct
  misc_feature 1..29: note = Synthetic Construct
  source 1..29: mol_type = other DNA
cgcataaagactgtttcagttatctgcta

SEQ ID NO: 10503 - DNA, 24 bp, synthetic construct
  misc_feature 1..24: note = Synthetic Construct
  source 1..24: mol_type = other DNA
ggaatgtgagtttcctgtgaccta

SEQ ID NO: 10504 - DNA, 22 bp, synthetic construct
  misc_feature 1..22: note = Synthetic Construct
  source 1..22: mol_type = other DNA
gcacacaaagcactcacaatcc

SEQ ID NO: 10505 - DNA, 25 bp, synthetic construct
  misc_feature 1..25: note = Synthetic Construct
  source 1..25: mol_type = other DNA
aggtattttgggacagacactgatt

SEQ ID NO: 10506 - DNA, 22 bp, synthetic construct
  misc_feature 1..22: note = Synthetic Construct
  source 1..22: mol_type = other DNA
atctcctgtcccagcatctttg

SEQ ID NO: 10507 - DNA, 27 bp, synthetic construct
  misc_feature 1..27: note = Synthetic Construct
  source 1..27: mol_type = other DNA
ttcagagctcaatactgtaaggatgag

SEQ ID NO: 10508 - DNA, 24 bp, synthetic construct
  misc_feature 1..24: note = Synthetic Construct
  source 1..24: mol_type = other DNA
gctacacaaactgcatctcttgga

SEQ ID NO: 10509 - DNA, 26 bp, synthetic construct
  misc_feature 1..26: note = Synthetic Construct
  source 1..26: mol_type = other DNA
gactcacaattttcaggcaagaaaca

SEQ ID NO: 10510 - DNA, 29 bp, synthetic construct
  misc_feature 1..29: note = Synthetic Construct
  source 1..29: mol_type = other DNA
gcataacatctggcttttaaaatctgact

SEQ ID NO: 10511 - DNA, 19 bp, synthetic construct
  misc_feature 1..19: note = Synthetic Construct
  source 1..19: mol_type = other DNA
agactggcagggagtgtgt

SEQ ID NO: 10512 - DNA, 22 bp, synthetic construct
  misc_feature 1..22: note = Synthetic Construct
  source 1..22: mol_type = other DNA
ggcatttctaggatgcgtggaa

SEQ ID NO: 10513 - DNA, 22 bp, synthetic construct
  misc_feature 1..22: note = Synthetic Construct
  source 1..22: mol_type = other DNA
tgtgcactaacagcccatgtac

SEQ ID NO: 10514 - DNA, 24 bp, synthetic construct
  misc_feature 1..24: note = Synthetic Construct
  source 1..24: mol_type = other DNA
tctgaacctgggtggaacaatagg

SEQ ID NO: 10515 - DNA, 29 bp, synthetic construct
  misc_feature 1..29: note = Synthetic Construct
  source 1..29: mol_type = other DNA
gcagttgatagctttacactcttgaatct

SEQ ID NO: 10516 - DNA, 27 bp, synthetic construct
  misc_feature 1..27: note = Synthetic Construct
  source 1..27: mol_type = other DNA
gaggaaatatgagacctccatttttgg

SEQ ID NO: 10517 - DNA, 26 bp, synthetic construct
  misc_feature 1..26: note = Synthetic Construct
  source 1..26: mol_type = other DNA
gctaggaacacagaaacattgttgca

SEQ ID NO: 10518 - DNA, 20 bp, synthetic construct
  misc_feature 1..20: note = Synthetic Construct
  source 1..20: mol_type = other DNA
tgattggagaggccctgcta

SEQ ID NO: 10519 - DNA, 27 bp, synthetic construct
  misc_feature 1..27: note = Synthetic Construct
  source 1..27: mol_type = other DNA
agattaaacacagctttggggttttac

SEQ ID NO: 10520 - DNA, 22 bp, synthetic construct
  misc_feature 1..22: note = Synthetic Construct
  source 1..22: mol_type = other DNA
ggacatcaacaaggctcaggat

SEQ ID NO: 10521 - DNA, 26 bp, synthetic construct
  misc_feature 1..26: note = Synthetic Construct
  source 1..26: mol_type = other DNA
gaattgccacaatagtctcagctttg

SEQ ID NO: 10522 - DNA, 19 bp, synthetic construct
  misc_feature 1..19: note = Synthetic Construct
  source 1..19: mol_type = other DNA
tgctgccaaaggccaggaa

SEQ ID NO: 10523 - DNA, 23 bp, synthetic construct
  misc_feature 1..23: note = Synthetic Construct
  source 1..23: mol_type = other DNA
tggcacctaggaggcatttattg

SEQ ID NO: 10524 - DNA, 22 bp, synthetic construct
  misc_feature 1..22: note = Synthetic Construct
  source 1..22: mol_type = other DNA
tcggttctttggcctgatgatt

SEQ ID NO: 10525 - DNA, 26 bp, synthetic construct
  misc_feature 1..26: note = Synthetic Construct
  source 1..26: mol_type = other DNA
ggccaattactgaatagccaggtact

SEQ ID NO: 10526 - DNA, 22 bp, synthetic construct
  misc_feature 1..22: note = Synthetic Construct
  source 1..22: mol_type = other DNA
cgtcacattctgcagaccacat

SEQ ID NO: 10527 - DNA, 24 bp, synthetic construct
  misc_feature 1..24: note = Synthetic Construct
  source 1..24: mol_type = other DNA
cttgtcttctcaggttgcttgttt

SEQ ID NO: 10528 - DNA, 19 bp, synthetic construct
  misc_feature 1..19: note = Synthetic Construct
  source 1..19: mol_type = other DNA
tgcctgtgttcccctctct

SEQ ID NO: 10529 - DNA, 29 bp, synthetic construct
  misc_feature 1..29: note = Synthetic Construct
  source 1..29: mol_type = other DNA
ggaattgatttggttggcactataatagc

SEQ ID NO: 10530 - DNA, 22 bp, synthetic construct
  misc_feature 1..22: note = Synthetic Construct
  source 1..22: mol_type = other DNA
tgcaatgccagacagcctgata

SEQ ID NO: 10531 - DNA, 28 bp, synthetic construct
  misc_feature 1..28: note = Synthetic Construct
  source 1..28: mol_type = other DNA
aactatttcaggagaaaggagtgattga

SEQ ID NO: 10532 - DNA, 20 bp, synthetic construct
  misc_feature 1..20: note = Synthetic Construct
  source 1..20: mol_type = other DNA
aaatcagtgcggtgcttgct

SEQ ID NO: 10533 - DNA, 22 bp, synthetic construct
  misc_feature 1..22: note = Synthetic Construct
  source 1..22: mol_type = other DNA
cctcctttctgttctgcttgga

SEQ ID NO: 10534 - DNA, 24 bp, synthetic construct
  misc_feature 1..24: note = Synthetic Construct
  source 1..24: mol_type = other DNA
ggttagcccttgggtagaatcaga

SEQ ID NO: 10535 - DNA, 19 bp, synthetic construct
  misc_feature 1..19: note = Synthetic Construct
  source 1..19: mol_type = other DNA
agggcctgctggactctca

SEQ ID NO: 10536 - DNA, 22 bp, synthetic construct
  misc_feature 1..22: note = Synthetic Construct
  source 1..22: mol_type = other DNA
gtgctacaagccactgttacgt

SEQ ID NO: 10537 - DNA, 25 bp, synthetic construct
  misc_feature 1..25: note = Synthetic Construct
  source 1..25: mol_type = other DNA
aataccttcctccgattgctttttg

SEQ ID NO: 10538 - DNA, 23 bp, synthetic construct
  misc_feature 1..23: note = Synthetic Construct
  source 1..23: mol_type = other DNA
agcagtggagccatgagatctca

SEQ ID NO: 10539 - DNA, 22 bp, synthetic construct
  misc_feature 1..22: note = Synthetic Construct
  source 1..22: mol_type = other DNA
ctctttccccagtcacccaatg

SEQ ID NO: 10540 - DNA, 27 bp, synthetic construct
  misc_feature 1..27: note = Synthetic Construct
  source 1..27: mol_type = other DNA
cctttttttctgagtaacctggaactg

SEQ ID NO: 10541 - DNA, 24 bp, synthetic construct
  misc_feature 1..24: note = Synthetic Construct
  source 1..24: mol_type = other DNA
tttaatgccgtgcatcattcaagt

SEQ ID NO: 10542 - DNA, 24 bp, synthetic construct
  misc_feature 1..24: note = Synthetic Construct
  source 1..24: mol_type = other DNA
ccgagccttagaaagaccccatat

SEQ ID NO: 10543 - DNA, 24 bp, synthetic construct
  misc_feature 1..24: note = Synthetic Construct
  source 1..24: mol_type = other DNA
tcatgaatcccgatgacatcactt

SEQ ID NO: 10544 - DNA, 20 bp, synthetic construct
  misc_feature 1..20: note = Synthetic Construct
  source 1..20: mol_type = other DNA
atgctggcaccaagattcca

SEQ ID NO: 10545 - DNA, 21 bp, synthetic construct
  misc_feature 1..21: note = Synthetic Construct
  source 1..21: mol_type = other DNA
agcagtggtgtgtgctacagt

SEQ ID NO: 10546 - DNA, 20 bp, synthetic construct
  misc_feature 1..20: note = Synthetic Construct
  source 1..20: mol_type = other DNA
tgctggttgggtcagatgga

SEQ ID NO: 10547 - DNA, 22 bp, synthetic construct
  misc_feature 1..22: note = Synthetic Construct
  source 1..22: mol_type = other DNA
ggtagcacagggcaaagttagg

SEQ ID NO: 10548 - DNA, 25 bp, synthetic construct
  misc_feature 1..25: note = Synthetic Construct
  source 1..25: mol_type = other DNA
cctgaccatgggttcaataattcca

SEQ ID NO: 10549 - DNA, 22 bp, synthetic construct
  misc_feature 1..22: note = Synthetic Construct
  source 1..22: mol_type = other DNA
tgtggagaccaagacctttcca

SEQ ID NO: 10550 - DNA, 21 bp, synthetic construct
  misc_feature 1..21: note = Synthetic Construct
  source 1..21: mol_type = other DNA
aagctgtgtgtggcctctaag

SEQ ID NO: 10551 - DNA, 21 bp, synthetic construct
  misc_feature 1..21: note = Synthetic Construct
  source 1..21: mol_type = other DNA
agccagagcagctgaacagta

SEQ ID NO: 10552 - DNA, 26 bp, synthetic construct
  misc_feature 1..26: note = Synthetic Construct
  source 1..26: mol_type = other DNA
ctgaggagaggagtcatatccttagg

SEQ ID NO: 10553 - DNA, 24 bp, synthetic construct
  misc_feature 1..24: note = Synthetic Construct
  source 1..24: mol_type = other DNA
tcctagctcagccacagtggaata

SEQ ID NO: 10554 - DNA, 20 bp, synthetic construct
  misc_feature 1..20: note = Synthetic Construct
  source 1..20: mol_type = other DNA
gggagcacagttctgtgaca

SEQ ID NO: 10555 - DNA, 25 bp, synthetic construct
  misc_feature 1..25: note = Synthetic Construct
  source 1..25: mol_type = other DNA
ttaaccactgtttcttgccaattgt

SEQ ID NO: 10556 - DNA, 25 bp, synthetic construct
  misc_feature 1..25: note = Synthetic Construct
  source 1..25: mol_type = other DNA
tgagttgttttttgccttgattcct

SEQ ID NO: 10557 - DNA, 24 bp, synthetic construct
  misc_feature 1..24: note = Synthetic Construct
  source 1..24: mol_type = other DNA
ctggatgaacctagccaagatcag

SEQ ID NO: 10558 - DNA, 24 bp, synthetic construct
  misc_feature 1..24: note = Synthetic Construct
  source 1..24: mol_type = other DNA
accagcatcagagatcctaagtct

SEQ ID NO: 10559 - DNA, 22 bp, synthetic construct
  misc_feature 1..22: note = Synthetic Construct
  source 1..22: mol_type = other DNA
tgtctcgcttctctctggatgt

SEQ ID NO: 10560 - DNA, 22 bp, synthetic construct
  misc_feature 1..22: note = Synthetic Construct
  source 1..22: mol_type = other DNA
tcctgtggtgaatgctgtagct

SEQ ID NO: 10561 - DNA, 26 bp, synthetic construct
  misc_feature 1..26: note = Synthetic Construct
  source 1..26: mol_type = other DNA
tgagaggtttagatccaggtaagtga

SEQ ID NO: 10562 - DNA, 29 bp, synthetic construct
  misc_feature 1..29: note = Synthetic Construct
  source 1..29: mol_type = other DNA
gctgcttctttcaaataatttgagggaaa

SEQ ID NO: 10563 - DNA, 19 bp, synthetic construct
  misc_feature 1..19: note = Synthetic Construct
  source 1..19: mol_type = other DNA
ggagcctgccacagatggt

SEQ ID NO: 10564 - DNA, 25 bp, synthetic construct
  misc_feature 1..25: note = Synthetic Construct
  source 1..25: mol_type = other DNA
tgacagactttggcacctatattca

SEQ ID NO: 10565 - DNA, 24 bp, synthetic construct
  misc_feature 1..24: note = Synthetic Construct
  source 1..24: mol_type = other DNA
ggcagctgggattggtattgttct

SEQ ID NO: 10566 - DNA, 28 bp, synthetic construct
  misc_feature 1..28: note = Synthetic Construct
  source 1..28: mol_type = other DNA
gagccactacgttaaaattaagaacaca

SEQ ID NO: 10567 - DNA, 24 bp, synthetic construct
  misc_feature 1..24: note = Synthetic Construct
  source 1..24: mol_type = other DNA
gttagattccagtctcccctgtga

SEQ ID NO: 10568 - DNA, 30 bp, synthetic construct
  misc_feature 1..30: note = Synthetic Construct
  source 1..30: mol_type = other DNA
ctggattcattaattcctacttgccttcta

SEQ ID NO: 10569 - DNA, 19 bp, synthetic construct
  misc_feature 1..19: note = Synthetic Construct
  source 1..19: mol_type = other DNA
accacctgccccccactga

SEQ ID NO: 10570 - DNA, 22 bp, synthetic construct
  misc_feature 1..22: note = Synthetic Construct
  source 1..22: mol_type = other DNA
cttcaaagcccacctgaaagtg

SEQ ID NO: 10571 - DNA, 24 bp, synthetic construct
  misc_feature 1..24: note = Synthetic Construct
  source 1..24: mol_type = other DNA
gggggaaactgcaccttgtatttg

SEQ ID NO: 10572 - DNA, 30 bp, synthetic construct
  misc_feature 1..30: note = Synthetic Construct
  source 1..30: mol_type = other DNA
cactacttgttggtctgagaattaggaaag

SEQ ID NO: 10573 - DNA, 29 bp, synthetic construct
  misc_feature 1..29: note = Synthetic Construct
  source 1..29: mol_type = other DNA
ggctgtccataaccttcttttagatctag

SEQ ID NO: 10574 - DNA, 22 bp, synthetic construct
  misc_feature 1..22: note = Synthetic Construct
  source 1..22: mol_type = other DNA
gggcttttctttgtgtgccttt

SEQ ID NO: 10575 - DNA, 20 bp, synthetic construct
  misc_feature 1..20: note = Synthetic Construct
  source 1..20: mol_type = other DNA
gggaatcccctgccaacctt

SEQ ID NO: 10576 - DNA, 19 bp, synthetic construct
  misc_feature 1..19: note = Synthetic Construct
  source 1..19: mol_type = other DNA
ccccttggtgcctgtgatg

SEQ ID NO: 10577 - DNA, 23 bp, synthetic construct
  misc_feature 1..23: note = Synthetic Construct
  source 1..23: mol_type = other DNA
agagcattctggaaaaggtgtga

SEQ ID NO: 10578 - DNA, 22 bp, synthetic construct
  misc_feature 1..22: note = Synthetic Construct
  source 1..22: mol_type = other DNA
ggtcatccacaagcacctgaat

SEQ ID NO: 10579 - DNA, 24 bp, synthetic construct
  misc_feature 1..24: note = Synthetic Construct
  source 1..24: mol_type = other DNA
gcacaccatagtggcatattttgg

SEQ ID NO: 10580 - DNA, 23 bp, synthetic construct
  misc_feature 1..23: note = Synthetic Construct
  source 1..23: mol_type = other DNA
gacacgtatctgacaggggattt

SEQ ID NO: 10581 - DNA, 18 bp, synthetic construct
  misc_feature 1..18: note = Synthetic Construct
  source 1..18: mol_type = other DNA
aggccctggttgcatgga

SEQ ID NO: 10582 - DNA, 21 bp, synthetic construct
  misc_feature 1..21: note = Synthetic Construct
  source 1..21: mol_type = other DNA
tcggaggtcacagctctcata

SEQ ID NO: 10583 - DNA, 26 bp, synthetic construct
  misc_feature 1..26: note = Synthetic Construct
  source 1..26: mol_type = other DNA
ggagtactttgtcatatcccaatgga

SEQ ID NO: 10584 - DNA, 21 bp, synthetic construct
  misc_feature 1..21: note = Synthetic Construct
  source 1..21: mol_type = other DNA
aggacaggcctatccagtcaa

SEQ ID NO: 10585 - DNA, 24 bp, synthetic construct
  misc_feature 1..24: note = Synthetic Construct
  source 1..24: mol_type = other DNA
ccagggctacagagttagatgagt

SEQ ID NO: 10586 - DNA, 29 bp, synthetic construct
  misc_feature 1..29: note = Synthetic Construct
  source 1..29: mol_type = other DNA
ccaaaacagaaatgtccaacatatttagc

SEQ ID NO: 10587 - DNA, 28 bp, synthetic construct
  misc_feature 1..28: note = Synthetic Construct
  source 1..28: mol_type = other DNA
agatggataaggtgtgaggatttattga

SEQ ID NO: 10588 - DNA, 22 bp, synthetic construct
  misc_feature 1..22: note = Synthetic Construct
  source 1..22: mol_type = other DNA
cctgtcccccaagaatcttacc

SEQ ID NO: 10589 - DNA, 20 bp, synthetic construct
  misc_feature 1..20: note = Synthetic Construct
  source 1..20: mol_type = other DNA
ttctgctcgtgggctccttt

SEQ ID NO: 10590 - DNA, 21 bp, synthetic construct
  misc_feature 1..21: note = Synthetic Construct
  source 1..21: mol_type = other DNA
acaggaaggagccttgtgaag

SEQ ID NO: 10591 - DNA, 19 bp, synthetic construct
  misc_feature 1..19: note = Synthetic Construct
  source 1..19: mol_type = other DNA
aggcctgttcctgccttga

SEQ ID NO: 10592 - DNA, 22 bp, synthetic construct
  misc_feature 1..22: note = Synthetic Construct
  source 1..22: mol_type = other DNA
gtgaacgacggggatgtttaca

SEQ ID NO: 10593 - DNA, 24 bp, synthetic construct
  misc_feature 1..24: note = Synthetic Construct
  source 1..24: mol_type = other DNA
gagtggcaggatagggattaggtt

SEQ ID NO: 10594 - DNA, 21 bp, synthetic construct
  misc_feature 1..21: note = Synthetic Construct
  source 1..21: mol_type = other DNA
ctaaggaagtgtggccatgct

SEQ ID NO: 10595 - DNA, 24 bp, synthetic construct
  misc_feature 1..24: note = Synthetic Construct
  source 1..24: mol_type = other DNA
tcaatttcccaagagctggtaagg

SEQ ID NO: 10596 - DNA, 19 bp, synthetic construct
  misc_feature 1..19: note = Synthetic Construct
  source 1..19: mol_type = other DNA
tgggggctgcccatcaatt

SEQ ID NO: 10597 - DNA, 23 bp, synthetic construct
  misc_feature 1..23: note = Synthetic Construct
  source 1..23: mol_type = other DNA
gcattgattagggatgcgacctt

SEQ ID NO: 10598 - DNA, 21 bp, synthetic construct
  misc_feature 1..21: note = Synthetic Construct
  source 1..21: mol_type = other DNA
tcaggactccagtctcatgca

SEQ ID NO: 10599 - DNA, 19 bp, synthetic construct
  misc_feature 1..19: note = Synthetic Construct
  source 1..19: mol_type = other DNA
tccgcacaggaggctctgt

SEQ ID NO: 10600 - DNA, 24 bp, synthetic construct
  misc_feature 1..24: note = Synthetic Construct
  source 1..24: mol_type = other DNA
cctgctgcagagtccttcattctt

SEQ ID NO: 10601 - DNA, 21 bp, synthetic construct
  misc_feature 1..21: note = Synthetic Construct
  source 1..21: mol_type = other DNA
tttggccattcctccaacact

SEQ ID NO: 10602 - DNA, 24 bp, synthetic construct
  misc_feature 1..24: note = Synthetic Construct
  source 1..24: mol_type = other DNA
ctttcactgaagctctcctactgt

SEQ ID NO: 10603 - DNA, 25 bp, synthetic construct
  misc_feature 1..25: note = Synthetic Construct
  source 1..25: mol_type = other DNA
gtctaagtaagggtgtgatggtgtt

SEQ ID NO: 10604 - DNA, 30 bp, synthetic construct
  misc_feature 1..30: note = Synthetic Construct
  source 1..30: mol_type = other DNA
cacataaacagctggagaatgttaaagatg

SEQ ID NO: 10605 - DNA, 23 bp, synthetic construct
  misc_feature 1..23: note = Synthetic Construct
  source 1..23: mol_type = other DNA
gaggggtgtcaggtatgtttagg

SEQ ID NO: 10606 - DNA, 21 bp, synthetic construct
  misc_feature 1..21: note = Synthetic Construct
  source 1..21: mol_type = other DNA
ctgggttatggcatgcaagga

SEQ ID NO: 10607 - DNA, 27 bp, synthetic construct
  misc_feature 1..27: note = Synthetic Construct
  source 1..27: mol_type = other DNA
gggaaacatacactttaggtgctctgt

SEQ ID NO: 10608 - DNA, 24 bp, synthetic construct
  misc_feature 1..24: note = Synthetic Construct
  source 1..24: mol_type = other DNA
gggaatctgaactcctgagtgtgt

SEQ ID NO: 10609 - DNA, 25 bp, synthetic construct
  misc_feature 1..25: note = Synthetic Construct
  source 1..25: mol_type = other DNA
cctggaaagggtaaaacttgctgat

SEQ ID NO: 10610 - DNA, 22 bp, synthetic construct
  misc_feature 1..22: note = Synthetic Construct
  source 1..22: mol_type = other DNA
gactcagcatgactccaatgca

SEQ ID NO: 10611 - DNA, 25 bp, synthetic construct
  misc_feature 1..25: note = Synthetic Construct
  source 1..25: mol_type = other DNA
gctcaccagcttgctttagaactga

SEQ ID NO: 10612 - DNA, 22 bp, synthetic construct
  misc_feature 1..22: note = Synthetic Construct
  source 1..22: mol_type = other DNA
tcctgctctggctctattctgt

SEQ ID NO: 10613 - DNA, 28 bp, synthetic construct
  misc_feature 1..28: note = Synthetic Construct
  source 1..28: mol_type = other DNA
ggggttaatggtctgtagactgaaatca

SEQ ID NO: 10614 - DNA, 30 bp, synthetic construct
  misc_feature 1..30: note = Synthetic Construct
  source 1..30: mol_type = other DNA
cagcttggtagagattttaggaagaatgtt

SEQ ID NO: 10615 - DNA, 25 bp, synthetic construct
  misc_feature 1..25: note = Synthetic Construct
  source 1..25: mol_type = other DNA
tgggactaggacctagagaaatagg

SEQ ID NO: 10616 - DNA, 19 bp, synthetic construct
  misc_feature 1..19: note = Synthetic Construct
  source 1..19: mol_type = other DNA
gcgtgggaccctctcttct

SEQ ID NO: 10617 - DNA, 22 bp, synthetic construct
  misc_feature 1..22: note = Synthetic Construct
  source 1..22: mol_type = other DNA
tggacctgggtctttcagaagt

SEQ ID NO: 10618 - DNA, 21 bp, synthetic construct
  misc_feature 1..21: note = Synthetic Construct
  source 1..21: mol_type = other DNA
agcttgactttggagcttgct

SEQ ID NO: 10619 - DNA, 21 bp, synthetic construct
  misc_feature 1..21: note = Synthetic Construct
  source 1..21: mol_type = other DNA
tgctcaagggaaggagttgtg

SEQ ID NO: 10620 - DNA, 29 bp, synthetic construct
  misc_feature 1..29: note = Synthetic Construct
  source 1..29: mol_type = other DNA
gggaataggagttagatgaactggaattg

SEQ ID NO: 10621 - DNA, 21 bp, synthetic construct
  misc_feature 1..21: note = Synthetic Construct
  source 1..21: mol_type = other DNA
aagagggagcaaagccttctc

SEQ ID NO: 10622 - DNA, 26 bp, synthetic construct
  misc_feature 1..26: note = Synthetic Construct
  source 1..26: mol_type = other DNA
gagcacctgtccatttgtatttaggt

SEQ ID NO: 10623 - DNA, 28 bp, synthetic construct
  misc_feature 1..28: note = Synthetic Construct
  source 1..28: mol_type = other DNA
cgtgagcatttctaaatgattgtggaat

SEQ ID NO: 10624 - DNA, 20 bp, synthetic construct
  misc_feature 1..20: note = Synthetic Construct
  source 1..20: mol_type = other DNA
tgggagggtggttccaaaga

SEQ ID NO: 10625 - DNA, 20 bp, synthetic construct
  misc_feature 1..20: note = Synthetic Construct
  source 1..20: mol_type = other DNA
cagaacctgctgcagacact

SEQ ID NO: 10626 - DNA, 23 bp, synthetic construct
  misc_feature 1..23: note = Synthetic Construct
  source 1..23: mol_type = other DNA
gttctggtgtttctgaccctcaa

SEQ ID NO: 10627 - DNA, 21 bp, synthetic construct
  misc_feature 1..21: note = Synthetic Construct
  source 1..21: mol_type = other DNA
tccaagccctggcctaaaagt

SEQ ID NO: 10628 - DNA, 22 bp, synthetic construct
  misc_feature 1..22: note = Synthetic Construct
  source 1..22: mol_type = other DNA
agcagctcctgtagtccttgaa

SEQ ID NO: 10629 - DNA, 26 bp, synthetic construct
  misc_feature 1..26: note = Synthetic Construct
  source 1..26: mol_type = other DNA
gtgagaaccaagaccttctaatcagt

SEQ ID NO: 10630 - DNA, 21 bp, synthetic construct
  misc_feature 1..21: note = Synthetic Construct
  source 1..21: mol_type = other DNA
gcaggaagcaactttgtgctt

SEQ ID NO: 10631 - DNA, 24 bp, synthetic construct
  misc_feature 1..24: note = Synthetic Construct
  source 1..24: mol_type = other DNA
ccagaagggattaagcacaaagtg

SEQ ID NO: 10632 - DNA, 21 bp, synthetic construct
  misc_feature 1..21: note = Synthetic Construct
  source 1..21: mol_type = other DNA
accaacacctgcctcattggt

SEQ ID NO: 10633 - DNA, 22 bp, synthetic construct
  misc_feature 1..22: note = Synthetic Construct
  source 1..22: mol_type = other DNA
ctcttcagttgcgccttttgag

SEQ ID NO: 10634 - DNA, 25 bp, synthetic construct
  misc_feature 1..25: note = Synthetic Construct
  source 1..25: mol_type = other DNA
agccattgtatcttttgcagttacc

SEQ ID NO: 10635 - DNA, 27 bp, synthetic construct
  misc_feature 1..27: note = Synthetic Construct
  source 1..27: mol_type = other DNA
ggaaccttgagaagtcttcatcatttc

SEQ ID NO: 10636 - DNA, 21 bp, synthetic construct
  misc_feature 1..21: note = Synthetic Construct
  source 1..21: mol_type = other DNA
tgctgccactgtgacaaagca

SEQ ID NO: 10637 - DNA, 27 bp, synthetic construct
  misc_feature 1..27: note = Synthetic Construct
  source 1..27: mol_type = other DNA
ctgtttccctatctgaatccctgttac

SEQ ID NO: 10638 - DNA, 30 bp, synthetic construct
  misc_feature 1..30: note = Synthetic Construct
  source 1..30: mol_type = other DNA
aagaaacaaaacaaaacattaagctgtctt

SEQ ID NO: 10639 - DNA, 23 bp, synthetic construct
  misc_feature 1..23: note = Synthetic Construct
  source 1..23: mol_type = other DNA
agaacactagcaggcagtaagga

SEQ ID NO: 10640 - DNA, 26 bp, synthetic construct
  misc_feature 1..26: note = Synthetic Construct
  source 1..26: mol_type = other DNA
ccaaaccaactgaaaacctgtattgg

SEQ ID NO: 10641 - DNA, 25 bp, synthetic construct
  misc_feature 1..25: note = Synthetic Construct
  source 1..25: mol_type = other DNA
caggagaccaggtttctagtttctg

SEQ ID NO: 10642 - DNA, 27 bp, synthetic construct
  misc_feature 1..27: note = Synthetic Construct
  source 1..27: mol_type = other DNA
ttagtgtatggggtctagaatggattg

SEQ ID NO: 10643 - DNA, 20 bp, synthetic construct
  misc_feature 1..20: note = Synthetic Construct
  source 1..20: mol_type = other DNA
gcctctatgccaggccaagt

SEQ ID NO: 10644 - DNA, 20 bp, synthetic construct
  misc_feature 1..20: note = Synthetic Construct
  source 1..20: mol_type = other DNA
tgggagcatggcctgatgga

SEQ ID NO: 10645 - DNA, 22 bp, synthetic construct
  misc_feature 1..22: note = Synthetic Construct
  source 1..22: mol_type = other DNA
tgccattcctcactcagtgcat

SEQ ID NO: 10646 - DNA, 21 bp, synthetic construct
  misc_feature 1..21: note = Synthetic Construct
  source 1..21: mol_type = other DNA
ccattgacatgtggccttcga

SEQ ID NO: 10647 - DNA, 19 bp, synthetic construct
  misc_feature 1..19: note = Synthetic Construct
  source 1..19: mol_type = other DNA
agcacctgcaaaccgttga

SEQ ID NO: 10648 - DNA, 23 bp, synthetic construct
  misc_feature 1..23: note = Synthetic Construct
  source 1..23: mol_type = other DNA
gaggagcaggagagatgaatctg

SEQ ID NO: 10649 - DNA, 22 bp, synthetic construct
  misc_feature 1..22: note = Synthetic Construct
  source 1..22: mol_type = other DNA
agtcaagcccctcttccatagg

SEQ ID NO: 10650 - DNA, 23 bp, synthetic construct
  misc_feature 1..23: note = Synthetic Construct
  source 1..23: mol_type = other DNA
ggacagacatattggtccccatt

SEQ ID NO: 10651 - DNA, 24 bp, synthetic construct
  misc_feature 1..24: note = Synthetic Construct
  source 1..24: mol_type = other DNA
ggagaagggtgagaaaagaacaga

SEQ ID NO: 10652 - DNA, 24 bp, synthetic construct
  misc_feature 1..24: note = Synthetic Construct
  source 1..24: mol_type = other DNA
ggtggaaggtcacgaacatcaaac

SEQ ID NO: 10653 - DNA, 30 bp, synthetic construct
  misc_feature 1..30: note = Synthetic Construct
  source 1..30: mol_type = other DNA
cataaaagtagggttgtaacggaaatacag

SEQ ID NO: 10654 - DNA, 18 bp, synthetic construct
  misc_feature 1..18: note = Synthetic Construct
  source 1..18: mol_type = other DNA
gctggctggctccaagct

SEQ ID NO: 10655 - DNA, 24 bp, synthetic construct
  misc_feature 1..24: note = Synthetic Construct
  source 1..24: mol_type = other DNA
gcaccctttccccagagctttaaa

SEQ ID NO: 10656 - DNA, 26 bp, synthetic construct
  misc_feature 1..26: note = Synthetic Construct
  source 1..26: mol_type = other DNA
agctgtagagtgagacttaggaatca

SEQ ID NO: 10657 - DNA, 28 bp, synthetic construct
  misc_feature 1..28: note = Synthetic Construct
  source 1..28: mol_type = other DNA
ttcctataactaactcgctcagtttaca

SEQ ID NO: 10658 - DNA, 24 bp, synthetic construct
  misc_feature 1..24: note = Synthetic Construct
  source 1..24: mol_type = other DNA
gtggcttcaggatttagagaaggt

SEQ ID NO: 10659 - DNA, 22 bp, synthetic construct
  misc_feature 1..22: note = Synthetic Construct
  source 1..22: mol_type = other DNA
tgttttacagagctgggggttt

SEQ ID NO: 10660 - DNA, 24 bp, synthetic construct
  misc_feature 1..24: note = Synthetic Construct
  source 1..24: mol_type = other DNA
cctgtctgtaggaccaggtttcta

SEQ ID NO: 10661 - DNA, 26 bp, synthetic construct
  misc_feature 1..26: note = Synthetic Construct
  source 1..26: mol_type = other DNA
acacagctccaagtaaatgataggaa

SEQ ID NO: 10662 - DNA, 22 bp, synthetic construct
  misc_feature 1..22: note = Synthetic Construct
  source 1..22: mol_type = other DNA
gggggcttaagcaagaaacact

SEQ ID NO: 10663 - DNA, 25 bp, synthetic construct
  misc_feature 1..25: note = Synthetic Construct
  source 1..25: mol_type = other DNA
gtctcaaacacaccatgctcttttc

SEQ ID NO: 10664 - DNA, 19 bp, synthetic construct
  misc_feature 1..19: note = Synthetic Construct
  source 1..19: mol_type = other DNA
tgctccagtggtccttcca

SEQ ID NO: 10665 - DNA, 21 bp, synthetic construct
  misc_feature 1..21: note = Synthetic Construct
  source 1..21: mol_type = other DNA
acagcagggttgaggaatgga

SEQ ID NO: 10666 - DNA, 30 bp, synthetic construct
  misc_feature 1..30: note = Synthetic Construct
  source 1..30: mol_type = other DNA
tgttcaaacatacagtatagtctacatggt

SEQ ID NO: 10667 - DNA, 20 bp, synthetic construct
  misc_feature 1..20: note = Synthetic Construct
  source 1..20: mol_type = other DNA
agccgcttccacctcttttg

SEQ ID NO: 10668 - DNA, 22 bp, synthetic construct
  misc_feature 1..22: note = Synthetic Construct
  source 1..22: mol_type = other DNA
aaagatggctggtgcagtagga

SEQ ID NO: 10669 - DNA, 22 bp, synthetic construct
  misc_feature 1..22: note = Synthetic Construct
  source 1..22: mol_type = other DNA
cagactcaccctccctccttac

SEQ ID NO: 10670 - DNA, 23 bp, synthetic construct
  misc_feature 1..23: note = Synthetic Construct
  source 1..23: mol_type = other DNA
cgattatgaggcccaccaaggta

SEQ ID NO: 10671 - DNA, 21 bp, synthetic construct
  misc_feature 1..21: note = Synthetic Construct
  source 1..21: mol_type = other DNA
gcccatctgctccttcctact

SEQ ID NO: 10672 - DNA, 25 bp, synthetic construct
  misc_feature 1..25: note = Synthetic Construct
  source 1..25: mol_type = other DNA
ggcagaaatcattgatgctgtgact

SEQ ID NO: 10673 - DNA, 20 bp, synthetic construct
  misc_feature 1..20: note = Synthetic Construct
  source 1..20: mol_type = other DNA
agtcagccactgggaaggaa

SEQ ID NO: 10674 - DNA, 25 bp, synthetic construct
  misc_feature 1..25: note = Synthetic Construct
  source 1..25: mol_type = other DNA
gaaccctcctctgaacctgaataag

SEQ ID NO: 10675 - DNA, 25 bp, synthetic construct
  misc_feature 1..25: note = Synthetic Construct
  source 1..25: mol_type = other DNA
caactgaaaaggactagaggtagca

SEQ ID NO: 10676 - DNA, 23 bp, synthetic construct
  misc_feature 1..23: note = Synthetic Construct
  source 1..23: mol_type = other DNA
tcctccttcatcccaatcaagga

SEQ ID NO: 10677 - DNA, 20 bp, synthetic construct
  misc_feature 1..20: note = Synthetic Construct
  source 1..20: mol_type = other DNA
ccccaaacaaggaggcagaa

SEQ ID NO: 10678 - DNA, 25 bp, synthetic construct
  misc_feature 1..25: note = Synthetic Construct
  source 1..25: mol_type = other DNA
ccatctccatgttgcagaaggactt

SEQ ID NO: 10679 - DNA, 27 bp, synthetic construct
  misc_feature 1..27: note = Synthetic Construct
  source 1..27: mol_type = other DNA
cgtgctagagatacagtagctgtcaag

SEQ ID NO: 10680 - DNA, 20 bp, synthetic construct
  misc_feature 1..20: note = Synthetic Construct
  source 1..20: mol_type = other DNA
aggatcccgccacaaaagga

SEQ ID NO: 10681 - DNA, 23 bp, synthetic construct
  misc_feature 1..23: note = Synthetic Construct
  source 1..23: mol_type = other DNA
acagattggaactgccacagaac

SEQ ID NO: 10682 - DNA, 22 bp, synthetic construct
  misc_feature 1..22: note = Synthetic Construct
  source 1..22: mol_type = other DNA
aggtggggaagatcagctatgg

SEQ ID NO: 10683 - DNA, 30 bp, synthetic construct
  misc_feature 1..30: note = Synthetic Construct
  source 1..30: mol_type = other DNA
cagtgtggaaaatactattccaaagataca

SEQ ID NO: 10684 - DNA, 20 bp, synthetic construct
  misc_feature 1..20: note = Synthetic Construct
  source 1..20: mol_type = other DNA
atctcagggtcctgcaagga

SEQ ID NO: 10685 - DNA, 23 bp, synthetic construct
  misc_feature 1..23: note = Synthetic Construct
  source 1..23: mol_type = other DNA
tcctagtcatcttggcagtgtct

SEQ ID NO: 10686 - DNA, 23 bp, synthetic construct
  misc_feature 1..23: note = Synthetic Construct
  source 1..23: mol_type = other DNA
acccaggattggtcactgaagga

SEQ ID NO: 10687 - DNA, 24 bp, synthetic construct
  misc_feature 1..24: note = Synthetic Construct
  source 1..24: mol_type = other DNA
ggaccatggttgatagcaagtact

SEQ ID NO: 10688 - DNA, 24 bp, synthetic construct
  misc_feature 1..24: note = Synthetic Construct
  source 1..24: mol_type = other DNA
caggcaagtcaattttccatttgc

SEQ ID NO: 10689 - DNA, 24 bp, synthetic construct
  misc_feature 1..24: note = Synthetic Construct
  source 1..24: mol_type = other DNA
gtccttgccttacagagcttaagg

SEQ ID NO: 10690 - DNA, 23 bp, synthetic construct
  misc_feature 1..23: note = Synthetic Construct
  source 1..23: mol_type = other DNA
tccgagtccaccaaatcctagga

SEQ ID NO: 10691 - DNA, 23 bp, synthetic construct
  misc_feature 1..23: note = Synthetic Construct
  source 1..23: mol_type = other DNA
atctgccttgtgctagacatgaa

SEQ ID NO: 10692 - DNA, 26 bp, synthetic construct
  misc_feature 1..26: note = Synthetic Construct
  source 1..26: mol_type = other DNA
ccctcacacctcaggatgtttttctc

SEQ ID NO: 10693 - DNA, 22 bp, synthetic construct
  misc_feature 1..22: note = Synthetic Construct
  source 1..22: mol_type = other DNA
gccttggttcttgtcctacagt

SEQ ID NO: 10694 - DNA, 24 bp, synthetic construct
  misc_feature 1..24: note = Synthetic Construct
  source 1..24: mol_type = other DNA
tgctgcagacacttaatacacact

SEQ ID NO: 10695 - DNA, 19 bp, synthetic construct
  misc_feature 1..19: note = Synthetic Construct
  source 1..19: mol_type = other DNA
ttgggtgccgtggctcaca

SEQ ID NO: 10696 - DNA, 29 bp, synthetic construct
  misc_feature 1..29: note = Synthetic Construct
  source 1..29: mol_type = other DNA
tttaaacattccaatttagcacgtttcaa

SEQ ID NO: 10697 - DNA, 20 bp, synthetic construct
  misc_feature 1..20: note = Synthetic Construct
  source 1..20: mol_type = other DNA
tcaggtgcctggcagtaagt

SEQ ID NO: 10698 - DNA, 24 bp, synthetic construct
  misc_feature 1..24: note = Synthetic Construct
  source 1..24: mol_type = other DNA
gatttgctgaacgagatggatcct

SEQ ID NO: 10699 - DNA, 30 bp, synthetic construct
  misc_feature 1..30: note = Synthetic Construct
  source 1..30: mol_type = other DNA
gcagatcatatcatggaggaatcattgtgt

SEQ ID NO: 10700 - DNA, 25 bp, synthetic construct
  misc_feature 1..25: note = Synthetic Construct
  source 1..25: mol_type = other DNA
ccacaacagtgtatctgatcacaga

SEQ ID NO: 10701 - DNA, 20 bp, synthetic construct
  misc_feature 1..20: note = Synthetic Construct
  source 1..20: mol_type = other DNA
ttcgctgctgcttctccttt

SEQ ID NO: 10702 - DNA, 23 bp, synthetic construct
  misc_feature 1..23: note = Synthetic Construct
  source 1..23: mol_type = other DNA
aaggtgtgagtaggtgggtctga

SEQ ID NO: 10703 - DNA, 20 bp, synthetic construct
  misc_feature 1..20: note = Synthetic Construct
  source 1..20: mol_type = other DNA
tgcagccgagaccccaagaa

SEQ ID NO: 10704 - DNA, 22 bp, synthetic construct
  misc_feature 1..22: note = Synthetic Construct
  source 1..22: mol_type = other DNA
agagtgcatgaggcttggatct

SEQ ID NO: 10705 - DNA, 29 bp, synthetic construct
  misc_feature 1..29: note = Synthetic Construct
  source 1..29: mol_type = other DNA
ttttgggggaaattgacaactttagatta

SEQ ID NO: 10706 - DNA, 22 bp, synthetic construct
  misc_feature 1..22: note = Synthetic Construct
  source 1..22: mol_type = other DNA
cctttgctcagcaactgaacag

SEQ ID NO: 10707 - DNA, 22 bp, synthetic construct
  misc_feature 1..22: note = Synthetic Construct
  source 1..22: mol_type = other DNA
catcgaatctccacacccacat

SEQ ID NO: 10708 - DNA, 21 bp, synthetic construct
  misc_feature 1..21: note = Synthetic Construct
  source 1..21: mol_type = other DNA
ccatcactgactgcgtggtaa

SEQ ID NO: 10709 - DNA, 23 bp, synthetic construct
  misc_feature 1..23: note = Synthetic Construct
  source 1..23: mol_type = other DNA
caccataccccatgaagagttca

SEQ ID NO: 10710 - DNA, 22 bp, synthetic construct
  misc_feature 1..22: note = Synthetic Construct
  source 1..22: mol_type = other DNA
ctgggccaattccttgtgaaga

SEQ ID NO: 10711 - DNA, 29 bp, synthetic construct
  misc_feature 1..29: note = Synthetic Construct
  source 1..29: mol_type = other DNA
tgaaattcgagagagagcttacatttcta

SEQ ID NO: 10712 - DNA, 21 bp, synthetic construct
  misc_feature 1..21: note = Synthetic Construct
  source 1..21: mol_type = other DNA
ctctcagccagctacctagga

SEQ ID NO: 10713 - DNA, 21 bp, synthetic construct
  misc_feature 1..21: note = Synthetic Construct
  source 1..21: mol_type = other DNA
acatcctcttgtcccctgcat

SEQ ID NO: 10714 - DNA, 21 bp, synthetic construct
  misc_feature 1..21: note = Synthetic Construct
  source 1..21: mol_type = other DNA
taggtctgcccgccttacagt

SEQ ID NO: 10715 - DNA, 23 bp, synthetic construct
  misc_feature 1..23: note = Synthetic Construct
  source 1..23: mol_type = other DNA
agagtccaggcttctctctctct

SEQ ID NO: 10716 - DNA, 24 bp, synthetic construct
  misc_feature 1..24: note = Synthetic Construct
  source 1..24: mol_type = other DNA
ggcagagctcatctttgaaatgag

SEQ ID NO: 10717 - DNA, 24 bp, synthetic construct
  misc_feature 1..24: note = Synthetic Construct
  source 1..24: mol_type = other DNA
tgagagaacagggcaaggtaaaac

SEQ ID NO: 10718 - DNA, 20 bp, synthetic construct
  misc_feature 1..20: note = Synthetic Construct
  source 1..20: mol_type = other DNA
tctccccaccgacaaacctt

SEQ ID NO: 10719 - DNA, 22 bp, synthetic construct
  misc_feature 1..22: note = Synthetic Construct
  source 1..22: mol_type = other DNA
gttcacagggaaagtgctgagt

SEQ ID NO: 10720 - DNA, 24 bp, synthetic construct
  misc_feature 1..24: note = Synthetic Construct
  source 1..24: mol_type = other DNA
ccctctgttttaggaagagaagca

SEQ ID NO: 10721 - DNA, 26 bp, synthetic construct
  misc_feature 1..26: note = Synthetic Construct
  source 1..26: mol_type = other DNA
atctctggtaatggcttaagaaacca

SEQ ID NO: 10722 - DNA, 24 bp, synthetic construct
  misc_feature 1..24: note = Synthetic Construct
  source 1..24: mol_type = other DNA
ctaggtcactgtggaagacacttt

SEQ ID NO: 10723 - DNA, 23 bp, synthetic construct
  misc_feature 1..23: note = Synthetic Construct
  source 1..23: mol_type = other DNA
gaatttgcacagcgctttatggt

SEQ ID NO: 10724 - DNA, 20 bp, synthetic construct
  misc_feature 1..20: note = Synthetic Construct
  source 1..20: mol_type = other DNA
ccccggtgcatttcctagga

SEQ ID NO: 10725 - DNA, 21 bp, synthetic construct
  misc_feature 1..21: note = Synthetic Construct
  source 1..21: mol_type = other DNA
gcccatcagctgtctgtttgc

SEQ ID NO: 10726 - DNA, 24 bp, synthetic construct
  misc_feature 1..24: note = Synthetic Construct
  source 1..24: mol_type = other DNA
ccacatgctttgtcactggcatac

SEQ ID NO: 10727 - DNA, 28 bp, synthetic construct
  misc_feature 1..28: note = Synthetic Construct
  source 1..28: mol_type = other DNA
ctcttagggatccaagaatagttgttga

SEQ ID NO: 10728 - DNA, 26 bp, synthetic construct
  misc_feature 1..26: note = Synthetic Construct
  source 1..26: mol_type = other DNA
ggattgaaaagagcagggatgacaga

SEQ ID NO: 10729 - DNA, 21 bp, synthetic construct
  misc_feature 1..21: note = Synthetic Construct
  source 1..21: mol_type = other DNA
tcccctggaggaatggtttct

SEQ ID NO: 10730 - DNA, 18 bp, synthetic construct
  misc_feature 1..18: note = Synthetic Construct
  source 1..18: mol_type = other DNA
tccaagggtgcccagtga

SEQ ID NO: 10731 - DNA, 21 bp, synthetic construct
  misc_feature 1..21: note = Synthetic Construct
  source 1..21: mol_type = other DNA
cccagtgtagaccgtcatgga

SEQ ID NO: 10732 - DNA, 28 bp, synthetic construct
  misc_feature 1..28: note = Synthetic Construct
  source 1..28: mol_type = other DNA
tgtgagtgtcccaaactttaagatacaa

SEQ ID NO: 10733 - DNA, 30 bp, synthetic construct
  misc_feature 1..30: note = Synthetic Construct
  source 1..30: mol_type = other DNA
gggtgtgaatgaactatttacatgaagaag

SEQ ID NO: 10734 - DNA, 18 bp, synthetic construct
  misc_feature 1..18: note = Synthetic Construct
  source 1..18: mol_type = other DNA
cctgcccgtccacctaca

SEQ ID NO: 10735 - DNA, 24 bp, synthetic construct
  misc_feature 1..24: note = Synthetic Construct
  source 1..24: mol_type = other DNA
gggcaagtagtgtttcgtggctta

SEQ ID NO: 10736 - DNA, 24 bp, synthetic construct
  misc_feature 1..24: note = Synthetic Construct
  source 1..24: mol_type = other DNA
cccctagccttgaattgcctctat

SEQ ID NO: 10737 - DNA, 22 bp, synthetic construct
  misc_feature 1..22: note = Synthetic Construct
  source 1..22: mol_type = other DNA
ttccctaagtgtgggccaaagg

SEQ ID NO: 10738 - DNA, 30 bp, synthetic construct
  misc_feature 1..30: note = Synthetic Construct
  source 1..30: mol_type = other DNA
ctttgaattcagccttccttacataattct

SEQ ID NO: 10739 - DNA, 24 bp, synthetic construct
  misc_feature 1..24: note = Synthetic Construct
  source 1..24: mol_type = other DNA
agtgattgtctggaacatgcaaga

SEQ ID NO: 10740 - DNA, 24 bp, synthetic construct
  misc_feature 1..24: note = Synthetic Construct
  source 1..24: mol_type = other DNA
cacaggctcatcagacaagaggat

SEQ ID NO: 10741 - DNA, 23 bp, synthetic construct
  misc_feature 1..23: note = Synthetic Construct
  source 1..23: mol_type = other DNA
tggcaaagaggctaaggacattg

SEQ ID NO: 10742 - DNA, 21 bp, synthetic construct
  misc_feature 1..21: note = Synthetic Construct
  source 1..21: mol_type = other DNA
ccctggcatcataggggctta

SEQ ID NO: 10743 - DNA, 24 bp, synthetic construct
  misc_feature 1..24: note = Synthetic Construct
  source 1..24: mol_type = other DNA
agaagtggtaccattttgctcagt

SEQ ID NO: 10744 - DNA, 18 bp, synthetic construct
  misc_feature 1..18: note = Synthetic Construct
  source 1..18: mol_type = other DNA
aggtgcatggccctctct

SEQ ID NO: 10745 - DNA, 27 bp, synthetic construct
  misc_feature 1..27: note = Synthetic Construct
  source 1..27: mol_type = other DNA
caggataaccaaagtacaaaggaccat

SEQ ID NO: 10746 - DNA, 22 bp, synthetic construct
  misc_feature 1..22: note = Synthetic Construct
  source 1..22: mol_type = other DNA
cctcaatcacctgtcccttgtt

SEQ ID NO: 10747 - DNA, 27 bp, synthetic construct
  misc_feature 1..27: note = Synthetic Construct
  source 1..27: mol_type = other DNA
ggtgtcaagtcaaattaacttgccatt

SEQ ID NO: 10748 - DNA, 24 bp, synthetic construct
  misc_feature 1..24: note = Synthetic Construct
  source 1..24: mol_type = other DNA
ccacttgtctgtcccttcttagct

SEQ ID NO: 10749 - DNA, 22 bp, synthetic construct
  misc_feature 1..22: note = Synthetic Construct
  source 1..22: mol_type = other DNA
gggggaaagctggtgttctact

SEQ ID NO: 10750 - DNA, 30 bp, synthetic construct
  misc_feature 1..30: note = Synthetic Construct
  source 1..30: mol_type = other DNA
cccaagtactactaatacattaccctcact

SEQ ID NO: 10751 - DNA, 29 bp, synthetic construct
  misc_feature 1..29: note = Synthetic Construct
  source 1..29: mol_type = other DNA
ggaaagctattgaatggttataacgacat

SEQ ID NO: 10752 - DNA, 26 bp, synthetic construct
  misc_feature 1..26: note = Synthetic Construct
  source 1..26: mol_type = other DNA
cgtagatttggatggaagtgggagta

SEQ ID NO: 10753 - DNA, 29 bp, synthetic construct
  misc_feature 1..29: note = Synthetic Construct
  source 1..29: mol_type = other DNA
tcattccagctctaagtaatagcttactg

SEQ ID NO: 10754 - DNA, 25 bp, synthetic construct
  misc_feature 1..25: note = Synthetic Construct
  source 1..25: mol_type = other DNA
cagcataaggtagtctacccaccaa

SEQ ID NO: 10755 - DNA, 19 bp, synthetic construct
  misc_feature 1..19: note = Synthetic Construct
  source 1..19: mol_type = other DNA
accaggggcctgagaactg

SEQ ID NO: 10756 - DNA, 22 bp, synthetic construct
  misc_feature 1..22: note = Synthetic Construct
  source 1..22: mol_type = other DNA
ctgtggtgattcctgtgtgtct

SEQ ID NO: 10757 - DNA, 26 bp, synthetic construct
  misc_feature 1..26: note = Synthetic Construct
  source 1..26: mol_type = other DNA
gcaaataacctgaagacgctcatagg

SEQ ID NO: 10758 - DNA, 19 bp, synthetic construct
  misc_feature 1..19: note = Synthetic Construct
  source 1..19: mol_type = other DNA
gcaaggaaaggggcttcca

SEQ ID NO: 10759 - DNA, 24 bp, synthetic construct
  misc_feature 1..24: note = Synthetic Construct
  source 1..24: mol_type = other DNA
ggaggttctcctgaatgtgtgtag

SEQ ID NO: 10760 - DNA, 21 bp, synthetic construct
  misc_feature 1..21: note = Synthetic Construct
  source 1..21: mol_type = other DNA
agctcagccaaccacaatgtg

SEQ ID NO: 10761 - DNA, 24 bp, synthetic construct
  misc_feature 1..24: note = Synthetic Construct
  source 1..24: mol_type = other DNA
cacactggatgggatcatcaactc

SEQ ID NO: 10762 - DNA, 22 bp, synthetic construct
  misc_feature 1..22: note = Synthetic Construct
  source 1..22: mol_type = other DNA
aggcatgcaacctagcaatgag

SEQ ID NO: 10763 - DNA, 20 bp, synthetic construct
  misc_feature 1..20: note = Synthetic Construct
  source 1..20: mol_type = other DNA
ctgccagtcacagcttcagt

SEQ ID NO: 10764 - DNA, 27 bp, synthetic construct
  misc_feature 1..27: note = Synthetic Construct
  source 1..27: mol_type = other DNA
ccaagagctaaaattccgtgactctct

SEQ ID NO: 10765 - DNA, 27 bp, synthetic construct
  misc_feature 1..27: note = Synthetic Construct
  source 1..27: mol_type = other DNA
gctccggagttatttttaatgcacaac

SEQ ID NO: 10766 - DNA, 23 bp, synthetic construct
  misc_feature 1..23: note = Synthetic Construct
  source 1..23: mol_type = other DNA
agggatcataggggactgaatcc

SEQ ID NO: 10767 - DNA, 21 bp, synthetic construct
  misc_feature 1..21: note = Synthetic Construct
  source 1..21: mol_type = other DNA
accaggagacctcagcaacca

SEQ ID NO: 10768 - DNA, 27 bp, synthetic construct
  misc_feature 1..27: note = Synthetic Construct
  source 1..27: mol_type = other DNA
cagaacttgtgagcaaatgattgagtt

SEQ ID NO: 10769 - DNA, 26 bp, synthetic construct
  misc_feature 1..26: note = Synthetic Construct
  source 1..26: mol_type = other DNA
cccaggccaactaattttctcatctg

SEQ ID NO: 10770 - DNA, 26 bp, synthetic construct
  misc_feature 1..26: note = Synthetic Construct
  source 1..26: mol_type = other DNA
aattccaaaactggatggagaatgtg

SEQ ID NO: 10771 - DNA, 24 bp, synthetic construct
  misc_feature 1..24: note = Synthetic Construct
  source 1..24: mol_type = other DNA
cataggtgaagtgcttagcaatgg

SEQ ID NO: 10772 - DNA, 24 bp, synthetic construct
  misc_feature 1..24: note = Synthetic Construct
  source 1..24: mol_type = other DNA
gggctaaagtacaggttgttagca

SEQ ID NO: 10773 - DNA, 23 bp, synthetic construct
  misc_feature 1..23: note = Synthetic Construct
  source 1..23: mol_type = other DNA
gtcatcacccaatgagcctatga

SEQ ID NO: 10774 - DNA, 30 bp, synthetic construct
  misc_feature 1..30: note = Synthetic Construct
  source 1..30: mol_type = other DNA
ggcatgacttacaactacttaacaggttac

SEQ ID NO: 10775 - DNA, 22 bp, synthetic construct
  misc_feature 1..22: note = Synthetic Construct
  source 1..22: mol_type = other DNA
agagtcacctgtgagtgtggtt

SEQ ID NO: 10776 - DNA, 27 bp, synthetic construct
  misc_feature 1..27: note = Synthetic Construct
  source 1..27: mol_type = other DNA
gagcataaatggacaagaattctgctt

SEQ ID NO: 10777 - DNA, 25 bp, synthetic construct
  misc_feature 1..25: note = Synthetic Construct
  source 1..25: mol_type = other DNA
cctctcattactctcccttcactct

SEQ ID NO: 10778 - DNA, 23 bp, synthetic construct
  misc_feature 1..23: note = Synthetic Construct
  source 1..23: mol_type = other DNA
ggcactgaagaagcaaacagaca

SEQ ID NO: 10779 - DNA, 29 bp, synthetic construct
  misc_feature 1..29: note = Synthetic Construct
  source 1..29: mol_type = other DNA
ggagaaaaaacagggaggtttatttttca

SEQ ID NO: 10780 - DNA, 18 bp, synthetic construct
  misc_feature 1..18: note = Synthetic Construct
  source 1..18: mol_type = other DNA
ccttggccagctgggttt

SEQ ID NO: 10781 - DNA, 21 bp, synthetic construct
  misc_feature 1..21: note = Synthetic Construct
  source 1..21: mol_type = other DNA
atggggaggcctgtcttaaga

SEQ ID NO: 10782 - DNA, 21 bp, synthetic construct
  misc_feature 1..21: note = Synthetic Construct
  source 1..21: mol_type = other DNA
tgcctcctaacggccaaatag

SEQ ID NO: 10783 - DNA, 21 bp, synthetic construct
  misc_feature 1..21: note = Synthetic Construct
  source 1..21: mol_type = other DNA
ccaagtcttgggagggtcttg

SEQ ID NO: 10784 - DNA, 18 bp, synthetic construct
  misc_feature 1..18: note = Synthetic Construct
  source 1..18: mol_type = other DNA
cggcagtgggctttccaa

SEQ ID NO: 10785 - DNA, 22 bp, synthetic construct
  misc_feature 1..22: note = Synthetic Construct
  source 1..22: mol_type = other DNA
tgtgtgtctggtggctgataca

SEQ ID NO: 10786 - DNA, 20 bp, synthetic construct
  misc_feature 1..20: note = Synthetic Construct
  source 1..20: mol_type = other DNA
gatttggggtgccctttcct

SEQ ID NO: 10787 - DNA, 21 bp, synthetic construct
  misc_feature 1..21: note = Synthetic Construct
  source 1..21: mol_type = other DNA
gccagtgcagagaggagagaa

SEQ ID NO: 10788 - DNA, 27 bp, synthetic construct
  misc_feature 1..27: note = Synthetic Construct
  source 1..27: mol_type = other DNA
tcacctaagctggtaggataaaaacaa

SEQ ID NO: 10789 - DNA, 24 bp, synthetic construct
  misc_feature 1..24: note = Synthetic Construct
  source 1..24: mol_type = other DNA
gagatactgtacacccagcaactg

SEQ ID NO: 10790 - DNA, 28 bp, synthetic construct
  misc_feature 1..28: note = Synthetic Construct
  source 1..28: mol_type = other DNA
gaccttcatgcaaatactgtttctcaaa

SEQ ID NO: 10791 - DNA, 22 bp, synthetic construct
  misc_feature 1..22: note = Synthetic Construct
  source 1..22: mol_type = other DNA
cacccaagtactcatccaccaa

SEQ ID NO: 10792 - DNA, 26 bp, synthetic construct
  misc_feature 1..26: note = Synthetic Construct
  source 1..26: mol_type = other DNA
caaggcaaatgaagtcacttcctaag

SEQ ID NO: 10793 - DNA, 28 bp, synthetic construct
  misc_feature 1..28: note = Synthetic Construct
  source 1..28: mol_type = other DNA
ctgctaaagaaagggtctaaggtttaga

SEQ ID NO: 10794 - DNA, 24 bp, synthetic construct
  misc_feature 1..24: note = Synthetic Construct
  source 1..24: mol_type = other DNA
gtgtcatcacctagacttccagtt

SEQ ID NO: 10795 - DNA, 21 bp, synthetic construct
  misc_feature 1..21: note = Synthetic Construct
  source 1..21: mol_type = other DNA
atccactttcccagggccaaa

SEQ ID NO: 10796 - DNA, 22 bp, synthetic construct
  misc_feature 1..22: note = Synthetic Construct
  source 1..22: mol_type = other DNA
atgtgaggtagcctgtgttcag

SEQ ID NO: 10797 - DNA, 23 bp, synthetic construct
  misc_feature 1..23: note = Synthetic Construct
  source 1..23: mol_type = other DNA
ggagccagtaccaggatatgctt

SEQ ID NO: 10798 - DNA, 30 bp, synthetic construct
  misc_feature 1..30: note = Synthetic Construct
  source 1..30: mol_type = other DNA
tgagatgtaatatcatgaagttaggtgtgt

SEQ ID NO: 10799 - DNA, 22 bp, synthetic construct
  misc_feature 1..22: note = Synthetic Construct
  source 1..22: mol_type = other DNA
tgaaaacggcatccccttcaga

SEQ ID NO: 10800 - DNA, 20 bp, synthetic construct
  misc_feature 1..20: note = Synthetic Construct
  source 1..20: mol_type = other DNA
gcggcacagatggaaatgca

SEQ ID NO: 10801 - DNA, 20 bp, synthetic construct
  misc_feature 1..20: note = Synthetic Construct
  source 1..20: mol_type = other DNA
ttcaatgcaccgcccaactt

SEQ ID NO: 10802 - DNA, 20 bp, synthetic construct
  misc_feature 1..20: note = Synthetic Construct
  source 1..20: mol_type = other DNA
gaggaagagcaggccatcag

SEQ ID NO: 10803 - DNA, 24 bp, synthetic construct
  misc_feature 1..24: note = Synthetic Construct
  source 1..24: mol_type = other DNA
actgtctaggactcgaggaatgga

SEQ ID NO: 10804 - DNA, 20 bp, synthetic construct
  misc_feature 1..20: note = Synthetic Construct
  source 1..20: mol_type = other DNA
aggttgaccgccagattcct

SEQ ID NO: 10805 - DNA, 21 bp, synthetic construct
  misc_feature 1..21: note = Synthetic Construct
  source 1..21: mol_type = other DNA
acccaatctctgcccccagta

SEQ ID NO: 10806 - DNA, 24 bp, synthetic construct
  misc_feature 1..24: note = Synthetic Construct
  source 1..24: mol_type = other DNA
tgaacaatgagggtttgtgtgaca

SEQ ID NO: 10807 - DNA, 21 bp, synthetic construct
  misc_feature 1..21: note = Synthetic Construct
  source 1..21: mol_type = other DNA
tctccagctctgggcctttaa

SEQ ID NO: 10808 - DNA, 22 bp, synthetic construct
  misc_feature 1..22: note = Synthetic Construct
  source 1..22: mol_type = other DNA
aaagagctgcaggtcatccttt

SEQ ID NO: 10809 - DNA, 22 bp, synthetic construct
  misc_feature 1..22: note = Synthetic Construct
  source 1..22: mol_type = other DNA
gagggacagcctggtattttgt

SEQ ID NO: 10810 - DNA, 29 bp, synthetic construct
  misc_feature 1..29: note = Synthetic Construct
  source 1..29: mol_type = other DNA
cctgttgtactgaaagaagggatgatgag

SEQ ID NO: 10811 - DNA, 23 bp, synthetic construct
  misc_feature 1..23: note = Synthetic Construct
  source 1..23: mol_type = other DNA
tcctcaaatccccccatctgtgt

SEQ ID NO: 10812 - DNA, 27 bp, synthetic construct
  misc_feature 1..27: note = Synthetic Construct
  source 1..27: mol_type = other DNA
gagtagctgctccaaatatctgaagag

SEQ ID NO: 10813 - DNA, 19 bp, synthetic construct
  misc_feature 1..19: note = Synthetic Construct
  source 1..19: mol_type = other DNA
acctcgactggcctctgtt

SEQ ID NO: 10814 - DNA, 20 bp, synthetic construct
  misc_feature 1..20: note = Synthetic Construct
  source 1..20: mol_type = other DNA
ttgcgtgtacctgggttgct

SEQ ID NO: 10815 - DNA, 28 bp, synthetic construct
  misc_feature 1..28: note = Synthetic Construct
  source 1..28: mol_type = other DNA
ctccaaaatcagagtaaattcagttgct

SEQ ID NO: 10816 - DNA, 19 bp, synthetic construct
  misc_feature 1..19: note = Synthetic Construct
  source 1..19: mol_type = other DNA
ccagtgcctggctctcctt

SEQ ID NO: 10817 - DNA, 24 bp, synthetic construct
  misc_feature 1..24: note = Synthetic Construct
  source 1..24: mol_type = other DNA
agtctgggtacaagctcaagttag

SEQ ID NO: 10818 - DNA, 27 bp, synthetic construct
  misc_feature 1..27: note = Synthetic Construct
  source 1..27: mol_type = other DNA
ggtaaccaagaggtaagacagttttcc

SEQ ID NO: 10819 - DNA, 24 bp, synthetic construct
  misc_feature 1..24: note = Synthetic Construct
  source 1..24: mol_type = other DNA
catcttgatttgatggcagagcaa

SEQ ID NO: 10820 - DNA, 24 bp, synthetic construct
  misc_feature 1..24: note = Synthetic Construct
  source 1..24: mol_type = other DNA
accagatgatcaggagcacagaca

SEQ ID NO: 10821 - DNA, 21 bp, synthetic construct
  misc_feature 1..21: note = Synthetic Construct
  source 1..21: mol_type = other DNA
tcaatcccagctgcagtggtt

SEQ ID NO: 10822 - DNA, 22 bp, synthetic construct
  misc_feature 1..22: note = Synthetic Construct
  source 1..22: mol_type = other DNA
gctccacagaagctagctagga

SEQ ID NO: 10823 - DNA, 28 bp, synthetic construct
  misc_feature 1..28: note = Synthetic Construct
  source 1..28: mol_type = other DNA
catttgtgttaataaacggcaagaacat

SEQ ID NO: 10824 - DNA, 24 bp, synthetic construct
  misc_feature 1..24: note = Synthetic Construct
  source 1..24: mol_type = other DNA
cctgagccttgtgatcttctggat

SEQ ID NO: 10825 - DNA, 23 bp, synthetic construct
  misc_feature 1..23: note = Synthetic Construct
  source 1..23: mol_type = other DNA
tgggccaagtcatgtaatgagtt

SEQ ID NO: 10826 - DNA, 20 bp, synthetic construct
  misc_feature 1..20: note = Synthetic Construct
  source 1..20: mol_type = other DNA
ggcgagagagagccctctac

SEQ ID NO: 10827 - DNA, 28 bp, synthetic construct
  misc_feature 1..28: note = Synthetic Construct
  source 1..28: mol_type = other DNA
tgaactatgctcattttaccaagaagga

SEQ ID NO: 10828 - DNA, 23 bp, synthetic construct
  misc_feature 1..23: note = Synthetic Construct
  source 1..23: mol_type = other DNA
ccaccaacacccttctctactgt

SEQ ID NO: 10829 - DNA, 24 bp, synthetic construct
  misc_feature 1..24: note = Synthetic Construct
  source 1..24: mol_type = other DNA
tgttggtttcctcaagttgtctga

SEQ ID NO: 10830 - DNA, 23 bp, synthetic construct
  misc_feature 1..23: note = Synthetic Construct
  source 1..23: mol_type = other DNA
ccctgtcttcatccatagcgttt

SEQ ID NO: 10831 - DNA, 26 bp, synthetic construct
  misc_feature 1..26: note = Synthetic Construct
  source 1..26: mol_type = other DNA
ggtgacactcagaacaatgtgcattc

SEQ ID NO: 10832 - DNA, 24 bp, synthetic construct
  misc_feature 1..24: note = Synthetic Construct
  source 1..24: mol_type = other DNA
tctttgccataattgggcatgaac

SEQ ID NO: 10833 - DNA, 22 bp, synthetic construct
  misc_feature 1..22: note = Synthetic Construct
  source 1..22: mol_type = other DNA
agcaacagaggaaagacaagct

SEQ ID NO: 10834 - DNA, 24 bp, synthetic construct
  misc_feature 1..24: note = Synthetic Construct
  source 1..24: mol_type = other DNA
gcccttgatgctgtggaatccatt

SEQ ID NO: 10835 - DNA, 27 bp, synthetic construct
  misc_feature 1..27: note = Synthetic Construct
  source 1..27: mol_type = other DNA
gactatgtctggtgcatttaaattgga

SEQ ID NO: 10836 - DNA, 22 bp, synthetic construct
  misc_feature 1..22: note = Synthetic Construct
  source 1..22: mol_type = other DNA
caatgggcacagaactgttcag

SEQ ID NO: 10837 - DNA, 20 bp, synthetic construct
  misc_feature 1..20: note = Synthetic Construct
  source 1..20: mol_type = other DNA
ccagcaggggccattatagc

SEQ ID NO: 10838 - DNA, 23 bp, synthetic construct
  misc_feature 1..23: note = Synthetic Construct
  source 1..23: mol_type = other DNA
gccttaagtcccagtgatctgtt

SEQ ID NO: 10839 - DNA, 25 bp, synthetic construct
  misc_feature 1..25: note = Synthetic Construct
  source 1..25: mol_type = other DNA
ccattgtatagccccaatcctagct

SEQ ID NO: 10840 - DNA, 27 bp, synthetic construct
  misc_feature 1..27: note = Synthetic Construct
  source 1..27: mol_type = other DNA
gactgcacctctaacttagataatgct

SEQ ID NO: 10841 - DNA, 26 bp, synthetic construct
  misc_feature 1..26: note = Synthetic Construct
  source 1..26: mol_type = other DNA
caggaagtgaaagctatggcagaatt

SEQ ID NO: 10842 - DNA, 24 bp, synthetic construct
  misc_feature 1..24: note = Synthetic Construct
  source 1..24: mol_type = other DNA
ccagatatgcgcacttctctctca

SEQ ID NO: 10843 - DNA, 18 bp, synthetic construct
  misc_feature 1..18: note = Synthetic Construct
  source 1..18: mol_type = other DNA
agtgctgggcctggaaga

SEQ ID NO: 10844 - DNA, 28 bp, synthetic construct
  misc_feature 1..28: note = Synthetic Construct
  source 1..28: mol_type = other DNA
gggggcatttttatgatagctgcttttc

SEQ ID NO: 10845 - DNA, 23 bp, synthetic construct
  misc_feature 1..23: note = Synthetic Construct
  source 1..23: mol_type = other DNA
cctgtttcacagacgtggaaagg

SEQ ID NO: 10846 - DNA, 25 bp, synthetic construct
  misc_feature 1..25: note = Synthetic Construct
  source 1..25: mol_type = other DNA
ggctgagaggctgtgttttagaaac

SEQ ID NO: 10847 - DNA, 22 bp, synthetic construct
  misc_feature 1..22: note = Synthetic Construct
  source 1..22: mol_type = other DNA
tcagtagctggggcttgtatgt

SEQ ID NO: 10848 - DNA, 24 bp, synthetic construct
  misc_feature 1..24: note = Synthetic Construct
  source 1..24: mol_type = other DNA
cacaagtaatgcttctggctttcc

SEQ ID NO: 10849 - DNA, 25 bp, synthetic construct
  misc_feature 1..25: note = Synthetic Construct
  source 1..25: mol_type = other DNA
tgctttcctgatcatgttgattcct

SEQ ID NO: 10850 - DNA, 23 bp, synthetic construct
  misc_feature 1..23: note = Synthetic Construct
  source 1..23: mol_type = other DNA
gtacaagacaaagggcctgatgt

SEQ ID NO: 10851 - DNA, 24 bp, synthetic construct
  misc_feature 1..24: note = Synthetic Construct
  source 1..24: mol_type = other DNA
caacctccgttcctcaaacataac

SEQ ID NO: 10852 - DNA, 25 bp, synthetic construct
  misc_feature 1..25: note = Synthetic Construct
  source 1..25: mol_type = other DNA
gagttttctttgggaagcaagttca

SEQ ID NO: 10853 - DNA, 20 bp, synthetic construct
  misc_feature 1..20: note = Synthetic Construct
  source 1..20: mol_type = other DNA
tccagccatccccaccaaga

SEQ ID NO: 10854 - DNA, 26 bp, synthetic construct
  misc_feature 1..26: note = Synthetic Construct
  source 1..26: mol_type = other DNA
gggtaccttgactctggaactgagat

SEQ ID NO: 10855 - DNA, 21 bp, synthetic construct
  misc_feature 1..21: note = Synthetic Construct
  source 1..21: mol_type = other DNA
ccccacccttccaagacatca

SEQ ID NO: 10856 - DNA, 28 bp, synthetic construct
  misc_feature 1..28: note = Synthetic Construct
  source 1..28: mol_type = other DNA
gcaaggagctacaaataatctggattcc

SEQ ID NO: 10857 - DNA, 20 bp, synthetic construct
  misc_feature 1..20: note = Synthetic Construct
  source 1..20: mol_type = other DNA
ctctgcagccatgtctggaa

SEQ ID NO: 10858 - DNA, 21 bp, synthetic construct
  misc_feature 1..21: note = Synthetic Construct
  source 1..21: mol_type = other DNA
tgttagaggagcccccagcat

SEQ ID NO: 10859 - DNA, 22 bp, synthetic construct
  misc_feature 1..22: note = Synthetic Construct
  source 1..22: mol_type = other DNA
agaaccatagtgcctggaatgc

SEQ ID NO: 10860 - DNA, 21 bp, synthetic construct
  misc_feature 1..21: note = Synthetic Construct
  source 1..21: mol_type = other DNA
gggaccaaagtcaaggcatgt

SEQ ID NO: 10861 - DNA, 22 bp, synthetic construct
  misc_feature 1..22: note = Synthetic Construct
  source 1..22: mol_type = other DNA
gccgagctaggaattcttctca

SEQ ID NO: 10862 - DNA, 18 bp, synthetic construct
  misc_feature 1..18: note = Synthetic Construct
  source 1..18: mol_type = other DNA
tggggcaaagggcatcag

SEQ ID NO: 10863 - DNA, 22 bp, synthetic construct
  misc_feature 1..22: note = Synthetic Construct
  source 1..22: mol_type = other DNA
tttcccaggtcaccttgactgt

SEQ ID NO: 10864 - DNA, 18 bp, synthetic construct
  misc_feature 1..18: note = Synthetic Construct
  source 1..18: mol_type = other DNA
tcacccccgtctcttgct

SEQ ID NO: 10865 - DNA, 24 bp, synthetic construct
  misc_feature 1..24: note = Synthetic Construct
  source 1..24: mol_type = other DNA
agcccacactaggatgtttatcac

SEQ ID NO: 10866 - DNA, 21 bp, synthetic construct
  misc_feature 1..21: note = Synthetic Construct
  source 1..21: mol_type = other DNA
tcactcttgggagcagaagga

SEQ ID NO: 10867 - DNA, 22 bp, synthetic construct
  misc_feature 1..22: note = Synthetic Construct
  source 1..22: mol_type = other DNA
aattgccttggtgggaccctta

SEQ ID NO: 10868 - DNA, 26 bp, synthetic construct
  misc_feature 1..26: note = Synthetic Construct
  source 1..26: mol_type = other DNA
ccacctgatttttagaaaccctgcat

SEQ ID NO: 10869 - DNA, 21 bp, synthetic construct
  misc_feature 1..21: note = Synthetic Construct
  source 1..21: mol_type = other DNA
caccctgtgatgcactgactt

SEQ ID NO: 10870 - DNA, 22 bp, synthetic construct
  misc_feature 1..22: note = Synthetic Construct
  source 1..22: mol_type = other DNA
cacatgcctggtggttaatgct

SEQ ID NO: 10871 - DNA, 19 bp, synthetic construct
  misc_feature 1..19: note = Synthetic Construct
  source 1..19: mol_type = other DNA
aggggccccagtgcacact

SEQ ID NO: 10872 - DNA, 24 bp, synthetic construct
  misc_feature 1..24: note = Synthetic Construct
  source 1..24: mol_type = other DNA
acaggtttgtcttaggaggtagga

SEQ ID NO: 10873 - DNA, 21 bp, synthetic construct
  misc_feature 1..21: note = Synthetic Construct
  source 1..21: mol_type = other DNA
tcagagcctgggatgcaatgg

SEQ ID NO: 10874 - DNA, 19 bp, synthetic construct
  misc_feature 1..19: note = Synthetic Construct
  source 1..19: mol_type = other DNA
gatggccaccgctgagaag

SEQ ID NO: 10875 - DNA, 22 bp, synthetic construct
  misc_feature 1..22: note = Synthetic Construct
  source 1..22: mol_type = other DNA
ttttgccttggagcatgtacct

SEQ ID NO: 10876 - DNA, 21 bp, synthetic construct
  misc_feature 1..21: note = Synthetic Construct
  source 1..21: mol_type = other DNA
accatgctacaggccaccata

SEQ ID NO: 10877 - DNA, 26 bp, synthetic construct
  misc_feature 1..26: note = Synthetic Construct
  source 1..26: mol_type = other DNA
cattaaatggctacacagtccatgtc

SEQ ID NO: 10878 - DNA, 24 bp, synthetic construct
  misc_feature 1..24: note = Synthetic Construct
  source 1..24: mol_type = other DNA
tggggggggtgatattacaagact

SEQ ID NO: 10879 - DNA, 22 bp, synthetic construct
  misc_feature 1..22: note = Synthetic Construct
  source 1..22: mol_type = other DNA
gctggccactgttaaaaaccaa

SEQ ID NO: 10880 - DNA, 26 bp, synthetic construct
  misc_feature 1..26: note = Synthetic Construct
  source 1..26: mol_type = other DNA
aattcatttgtgtttcccctcttctc

SEQ ID NO: 10881 - DNA, 27 bp, synthetic construct
  misc_feature 1..27: note = Synthetic Construct
  source 1..27: mol_type = other DNA
gggttagagtttttaagggttttggaa

SEQ ID NO: 10882 - DNA, 23 bp, synthetic construct
  misc_feature 1..23: note = Synthetic Construct
  source 1..23: mol_type = other DNA
gccacaaccagcttcttttactt

SEQ ID NO: 10883 - DNA, 18 bp, synthetic construct
  misc_feature 1..18: note = Synthetic Construct
  source 1..18: mol_type = other DNA
cagggcctggcacactgt

SEQ ID NO: 10884 - DNA, 21 bp, synthetic construct
  misc_feature 1..21: note = Synthetic Construct
  source 1..21: mol_type = other DNA
acaggggtagagagaccgttt

SEQ ID NO: 10885 - DNA, 26 bp, synthetic construct
  misc_feature 1..26: note = Synthetic Construct
  source 1..26: mol_type = other DNA
tcaacacctgtaggtaataacttgct

SEQ ID NO: 10886 - DNA, 22 bp, synthetic construct
  misc_feature 1..22: note = Synthetic Construct
  source 1..22: mol_type = other DNA
cacaagtcagtgtgccaaggaa

SEQ ID NO: 10887 - DNA, 24 bp, synthetic construct
  misc_feature 1..24: note = Synthetic Construct
  source 1..24: mol_type = other DNA
gctctcccttcttccttgggataa

SEQ ID NO: 10888 - DNA, 22 bp, synthetic construct
  misc_feature 1..22: note = Synthetic Construct
  source 1..22: mol_type = other DNA
tgtcccaggtccttcagaaaca

SEQ ID NO: 10889 - DNA, 20 bp, synthetic construct
  misc_feature 1..20: note = Synthetic Construct
  source 1..20: mol_type = other DNA
ttcccaatggccgaaaacca

SEQ ID NO: 10890 - DNA, 29 bp, synthetic construct
  misc_feature 1..29: note = Synthetic Construct
  source 1..29: mol_type = other DNA
gcctgatgtatttactcctagagctgtag

SEQ ID NO: 10891 - DNA, 23 bp, synthetic construct
  misc_feature 1..23: note = Synthetic Construct
  source 1..23: mol_type = other DNA
ttgtggctagacagcatgaatca

SEQ ID NO: 10892 - DNA, 24 bp, synthetic construct
  misc_feature 1..24: note = Synthetic Construct
  source 1..24: mol_type = other DNA
agcagggctaccattgaacttagg

SEQ ID NO: 10893 - DNA, 28 bp, synthetic construct
  misc_feature 1..28: note = Synthetic Construct
  source 1..28: mol_type = other DNA
actattaatagcaccgtaggtccctact

SEQ ID NO: 10894 - DNA, 22 bp, synthetic construct
  misc_feature 1..22: note = Synthetic Construct
  source 1..22: mol_type = other DNA
cggaatgcctccagactgaatt

SEQ ID NO: 10895 - DNA, 23 bp, synthetic construct
  misc_feature 1..23: note = Synthetic Construct
  source 1..23: mol_type = other DNA
ggctgtagggagagtgatctcaa

SEQ ID NO: 10896 - DNA, 24 bp, synthetic construct
  misc_feature 1..24: note = Synthetic Construct
  source 1..24: mol_type = other DNA
cccagaagtactcatcaccattga

SEQ ID NO: 10897 - DNA, 25 bp, synthetic construct
  misc_feature 1..25: note = Synthetic Construct
  source 1..25: mol_type = other DNA
gggccaagaaaaatcctgagtgttg

SEQ ID NO: 10898 - DNA, 26 bp, synthetic construct
  misc_feature 1..26: note = Synthetic Construct
  source 1..26: mol_type = other DNA
gagaaagacagtctttgtacctttgg

SEQ ID NO: 10899 - DNA, 29 bp, synthetic construct
  misc_feature 1..29: note = Synthetic Construct
  source 1..29: mol_type = other DNA
ttgtctctgaatatgaatagcatccttct

SEQ ID NO: 10900 - DNA, 23 bp, synthetic construct
  misc_feature 1..23: note = Synthetic Construct
  source 1..23: mol_type = other DNA
tggtggactggtttttcctgatg

SEQ ID NO: 10901 - DNA, 29 bp, synthetic construct
  misc_feature 1..29: note = Synthetic Construct
  source 1..29: mol_type = other DNA
gagaaatggaatttaaaagttgggtgctt

SEQ ID NO: 10902 - DNA, 23 bp, synthetic construct
  misc_feature 1..23: note = Synthetic Construct
  source 1..23: mol_type = other DNA
gggttgatgtgaggatcagtcaa

SEQ ID NO: 10903 - DNA, 22 bp, synthetic construct
  misc_feature 1..22: note = Synthetic Construct
  source 1..22: mol_type = other DNA
tggagtcaggtccaatcacatg

SEQ ID NO: 10904 - DNA, 30 bp, synthetic construct
  misc_feature 1..30: note = Synthetic Construct
  source 1..30: mol_type = other DNA
gcttcttgagtacagtttttctcaatctgt

SEQ ID NO: 10905 - DNA, 23 bp, synthetic construct
  misc_feature 1..23: note = Synthetic Construct
  source 1..23: mol_type = other DNA
tggctctccaacatatgttcaca

SEQ ID NO: 10906 - DNA, 21 bp, synthetic construct
  misc_feature 1..21: note = Synthetic Construct
  source 1..21: mol_type = other DNA
ctgtctagtggcatgctcaca

SEQ ID NO: 10907 - DNA, 24 bp, synthetic construct
  misc_feature 1..24: note = Synthetic Construct
  source 1..24: mol_type = other DNA
cactaagtcgaggcttgactctgt

SEQ ID NO: 10908 - DNA, 21 bp, synthetic construct
  misc_feature 1..21: note = Synthetic Construct
  source 1..21: mol_type = other DNA
tttgctccacactgcatttgg

SEQ ID NO: 10909 - DNA, 22 bp, synthetic construct
  misc_feature 1..22: note = Synthetic Construct
  source 1..22: mol_type = other DNA
tgggatagagtgggcagtttct

SEQ ID NO: 10910 - DNA, 20 bp, synthetic construct
  misc_feature 1..20: note = Synthetic Construct
  source 1..20: mol_type = other DNA
accaaccgaggtcgctcctt

SEQ ID NO: 10911 - DNA, 30 bp, synthetic construct
  misc_feature 1..30: note = Synthetic Construct
  source 1..30: mol_type = other DNA
acttaccttttatcttatttccagggaaga

SEQ ID NO: 10912 - DNA, 28 bp, synthetic construct
  misc_feature 1..28: note = Synthetic Construct
  source 1..28: mol_type = other DNA
ggagccaagtttatgcttgatcttaagg

SEQ ID NO: 10913 - DNA, 21 bp, synthetic construct
  misc_feature 1..21: note = Synthetic Construct
  source 1..21: mol_type = other DNA
aactggcagcaggaagagtca

SEQ ID NO: 10914 - DNA, 19 bp, synthetic construct
  misc_feature 1..19: note = Synthetic Construct
  source 1..19: mol_type = other DNA
ggggagccagccactaagg

SEQ ID NO: 10915 - DNA, 20 bp, synthetic construct
  misc_feature 1..20: note = Synthetic Construct
  source 1..20: mol_type = other DNA
atggggcctcggtgaattgt

SEQ ID NO: 10916 - DNA, 29 bp, synthetic construct
  misc_feature 1..29: note = Synthetic Construct
  source 1..29: mol_type = other DNA
gggagactcaagtagaacatgtctgtagt

SEQ ID NO: 10917 - DNA, 24 bp, synthetic construct
  misc_feature 1..24: note = Synthetic Construct
  source 1..24: mol_type = other DNA
gggtcttaaaagccccacattctt

SEQ ID NO: 10918 - DNA, 22 bp, synthetic construct
  misc_feature 1..22: note = Synthetic Construct
  source 1..22: mol_type = other DNA
tggacacacctgctaggagaca

SEQ ID NO: 10919 - DNA, 30 bp, synthetic construct
  misc_feature 1..30: note = Synthetic Construct
  source 1..30: mol_type = other DNA
ctgctttgcatatatggtgagaaatacata

SEQ ID NO: 10920 - DNA, 26 bp, synthetic construct
  misc_feature 1..26: note = Synthetic Construct
  source 1..26: mol_type = other DNA
cccttgaactgtggactatcctgatc

SEQ ID NO: 10921 - DNA, 26 bp, synthetic construct
  misc_feature 1..26: note = Synthetic Construct
  source 1..26: mol_type = other DNA
ggttctcaggaaggcatcatgctata

SEQ ID NO: 10922 - DNA, 25 bp, synthetic construct
  misc_feature 1..25: note = Synthetic Construct
  source 1..25: mol_type = other DNA
gagtgagttgcctaaccttcaaaga

SEQ ID NO: 10923 - DNA, 25 bp, synthetic construct
  misc_feature 1..25: note = Synthetic Construct
  source 1..25: mol_type = other DNA
gtgtggaggtggtttagtacaaaca

SEQ ID NO: 10924 - DNA, 29 bp, synthetic construct
  misc_feature 1..29: note = Synthetic Construct
  source 1..29: mol_type = other DNA
gctgttggaatagaaattagcactaagtc

SEQ ID NO: 10925 - DNA, 26 bp, synthetic construct
  misc_feature 1..26: note = Synthetic Construct
  source 1..26: mol_type = other DNA
caatacattcatcaccccttctcgat

SEQ ID NO: 10926 - DNA, 21 bp, synthetic construct
  misc_feature 1..21: note = Synthetic Construct
  source 1..21: mol_type = other DNA
gccaaagaggagccctttcaa

SEQ ID NO: 10927 - DNA, 30 bp, synthetic construct
  misc_feature 1..30: note = Synthetic Construct
  source 1..30: mol_type = other DNA
gcaagtgcttattgaatgctttctaagtgt

SEQ ID NO: 10928 - DNA, 24 bp, synthetic construct
  misc_feature 1..24: note = Synthetic Construct
  source 1..24: mol_type = other DNA
cactgtcttcccagcccttaatct

SEQ ID NO: 10929 - DNA, 27 bp, synthetic construct
  misc_feature 1..27: note = Synthetic Construct
  source 1..27: mol_type = other DNA
tcacaatcagatgacactgagacttag

SEQ ID NO: 10930 - DNA, 18 bp, synthetic construct
  misc_feature 1..18: note = Synthetic Construct
  source 1..18: mol_type = other DNA
cccagaccaggccttcca

SEQ ID NO: 10931 - DNA, 22 bp, synthetic construct
  misc_feature 1..22: note = Synthetic Construct
  source 1..22: mol_type = other DNA
ggtaaaagctggccatccatgt

SEQ ID NO: 10932 - DNA, 25 bp, synthetic construct
  misc_feature 1..25: note = Synthetic Construct
  source 1..25: mol_type = other DNA
cactcttatcaagcaggatgttcca

SEQ ID NO: 10933 - DNA, 23 bp, synthetic construct
  misc_feature 1..23: note = Synthetic Construct
  source 1..23: mol_type = other DNA
tgacattcagcatttcccttcgt

SEQ ID NO: 10934 - DNA, 25 bp, synthetic construct
  misc_feature 1..25: note = Synthetic Construct
  source 1..25: mol_type = other DNA
cagatccatattctgacgacctgat

SEQ ID NO: 10935 - DNA, 22 bp, synthetic construct
  misc_feature 1..22: note = Synthetic Construct
  source 1..22: mol_type = other DNA
ctcaacagctttggtgcagatg

SEQ ID NO: 10936 - DNA, 25 bp, synthetic construct
  misc_feature 1..25: note = Synthetic Construct
  source 1..25: mol_type = other DNA
ggtagcagaccttcactatgtagtc

SEQ ID NO: 10937 - DNA, 24 bp, synthetic construct
  misc_feature 1..24: note = Synthetic Construct
  source 1..24: mol_type = other DNA
cttccaagggatttccaccagaag

SEQ ID NO: 10938 - DNA, 29 bp, synthetic construct
  misc_feature 1..29: note = Synthetic Construct
  source 1..29: mol_type = other DNA
ccctgacaatgataatacctctgcttgag

SEQ ID NO: 10939 - DNA, 28 bp, synthetic construct
  misc_feature 1..28: note = Synthetic Construct
  source 1..28: mol_type = other DNA
gtcagttaccctttccaatcatatgact

SEQ ID NO: 10940 - DNA, 19 bp, synthetic construct
  misc_feature 1..19: note = Synthetic Construct
  source 1..19: mol_type = other DNA
aggcctgcctctcctaagc

SEQ ID NO: 10941 - DNA, 24 bp, synthetic construct
  misc_feature 1..24: note = Synthetic Construct
  source 1..24: mol_type = other DNA
ggaagaggaagggtctcattttcc

SEQ ID NO: 10942 - DNA, 21 bp, synthetic construct
  misc_feature 1..21: note = Synthetic Construct
  source 1..21: mol_type = other DNA
catgcaggagagcaccacttt

SEQ ID NO: 10943 - DNA, 22 bp, synthetic construct
  misc_feature 1..22: note = Synthetic Construct
  source 1..22: mol_type = other DNA
aaattcgacagcctcccagaca

SEQ ID NO: 10944 - DNA, 24 bp, synthetic construct
  misc_feature 1..24: note = Synthetic Construct
  source 1..24: mol_type = other DNA
ctctatctgtgaagcagcagagtt

SEQ ID NO: 10945 - DNA, 27 bp, synthetic construct
  misc_feature 1..27: note = Synthetic Construct
  source 1..27: mol_type = other DNA
caactgtagagttccatcaagagtcat

SEQ ID NO: 10946 - DNA, 25 bp, synthetic construct
  misc_feature 1..25: note = Synthetic Construct
  source 1..25: mol_type = other DNA
acgtcaaccttgtttatctcccata

SEQ ID NO: 10947 - DNA, 18 bp, synthetic construct
  misc_feature 1..18: note = Synthetic Construct
  source 1..18: mol_type = other DNA
agtccctgggccttgtca

SEQ ID NO: 10948 - DNA, 25 bp, synthetic construct
  misc_feature 1..25: note = Synthetic Construct
  source 1..25: mol_type = other DNA
aggaagaccctgtatctacaaaacc

SEQ ID NO: 10949 - DNA, 28 bp, synthetic construct
  misc_feature 1..28: note = Synthetic Construct
  source 1..28: mol_type = other DNA
gacctgagaaagcatgatatgtctttca

SEQ ID NO: 10950 - DNA, 22 bp, synthetic construct
  misc_feature 1..22: note = Synthetic Construct
  source 1..22: mol_type = other DNA
ccccttgcaccactcaaatcta

SEQ ID NO: 10951 - DNA, 24 bp, synthetic construct
  misc_feature 1..24: note = Synthetic Construct
  source 1..24: mol_type = other DNA
cctgtttattcctcccctgatcct

SEQ ID NO: 10952 - DNA, 26 bp, synthetic construct
  misc_feature 1..26: note = Synthetic Construct
  source 1..26: mol_type = other DNA
tgtggtctcacatatagtctgttctg

SEQ ID NO: 10953 - DNA, 29 bp, synthetic construct
  misc_feature 1..29: note = Synthetic Construct
  source 1..29: mol_type = other DNA
cgtcgattcttcttttgtacctagagaga

SEQ ID NO: 10954 - DNA, 21 bp, synthetic construct
  misc_feature 1..21: note = Synthetic Construct
  source 1..21: mol_type = other DNA
gcctttgcaatggaggatgct

SEQ ID NO: 10955 - DNA, 30 bp, synthetic construct
  misc_feature 1..30: note = Synthetic Construct
  source 1..30: mol_type = other DNA
ggagcaagaaaatgagtacaattccttcta

SEQ ID NO: 10956 - DNA, 27 bp, synthetic construct
  misc_feature 1..27: note = Synthetic Construct
  source 1..27: mol_type = other DNA
gttttgttttcaacaacccacttttga

SEQ ID NO: 10957 - DNA, 24 bp, synthetic construct
  misc_feature 1..24: note = Synthetic Construct
  source 1..24: mol_type = other DNA
ggagccaggtgacaaaagtcaaag

SEQ ID NO: 10958 - DNA, 21 bp, synthetic construct
  misc_feature 1..21: note = Synthetic Construct
  source 1..21: mol_type = other DNA
acagggcagaaccagaagact

SEQ ID NO: 10959 - DNA, 23 bp, synthetic construct
  misc_feature 1..23: note = Synthetic Construct
  source 1..23: mol_type = other DNA
ggcttcagcaaatgcatcagaca

SEQ ID NO: 10960 - DNA, 21 bp, synthetic construct
  misc_feature 1..21: note = Synthetic Construct
  source 1..21: mol_type = other DNA
tgggagctgcaggactaagca

SEQ ID NO: 10961 - DNA, 26 bp, synthetic construct
  misc_feature 1..26: note = Synthetic Construct
  source 1..26: mol_type = other DNA
gaaatctatcacctcatttgcaccaa

SEQ ID NO: 10962 - DNA, 23 bp, synthetic construct
  misc_feature 1..23: note = Synthetic Construct
  source 1..23: mol_type = other DNA
agcctaggtgacaagagtgaaac

SEQ ID NO: 10963 - DNA, 30 bp, synthetic construct
  misc_feature 1..30: note = Synthetic Construct
  source 1..30: mol_type = other DNA
aatcatatctgcttcaaattgtttgatcac

SEQ ID NO: 10964 - DNA, 28 bp, synthetic construct
  misc_feature 1..28: note = Synthetic Construct
  source 1..28: mol_type = other DNA
gctctaagacataagtccttctctcagt

SEQ ID NO: 10965 - DNA, 30 bp, synthetic construct
  misc_feature 1..30: note = Synthetic Construct
  source 1..30: mol_type = other DNA
ggaatatgtttttgctgactccaaagtaag

SEQ ID NO: 10966 - DNA, 22 bp, synthetic construct
  misc_feature 1..22: note = Synthetic Construct
  source 1..22: mol_type = other DNA
gctcagccaagggtaactcttt

SEQ ID NO: 10967 - DNA, 22 bp, synthetic construct
  misc_feature 1..22: note = Synthetic Construct
  source 1..22: mol_type = other DNA
cctcctgtcccttctcttctca

SEQ ID NO: 10968 - DNA, 26 bp, synthetic construct
  misc_feature 1..26: note = Synthetic Construct
  source 1..26: mol_type = other DNA
ggtttttggagtctgaatgaaaaacg

SEQ ID NO: 10969 - DNA, 22 bp, synthetic construct
  misc_feature 1..22: note = Synthetic Construct
  source 1..22: mol_type = other DNA
cttccatccatccccaccaaag

SEQ ID NO: 10970 - DNA, 29 bp, synthetic construct
  misc_feature 1..29: note = Synthetic Construct
  source 1..29: mol_type = other DNA
cataagcagaacaagtagagtcattttga

SEQ ID NO: 10971 - DNA, 25 bp, synthetic construct
  misc_feature 1..25: note = Synthetic Construct
  source 1..25: mol_type = other DNA
gagggaaatgcagctttgttatgaa

SEQ ID NO: 10972 - DNA, 25 bp, synthetic construct
  misc_feature 1..25: note = Synthetic Construct
  source 1..25: mol_type = other DNA
caatggcaaattctcgggactatac

SEQ ID NO: 10973 - DNA, 28 bp, synthetic construct
  misc_feature 1..28: note = Synthetic Construct
  source 1..28: mol_type = other DNA
aaaatgtttgagtccctatccactaaac

SEQ ID NO: 10974 - DNA, 23 bp, synthetic construct
  misc_feature 1..23: note = Synthetic Construct
  source 1..23: mol_type = other DNA
gagaataagggcatgccatctga

SEQ ID NO: 10975 - DNA, 19 bp, synthetic construct
  misc_feature 1..19: note = Synthetic Construct
  source 1..19: mol_type = other DNA
ttgggggctttggcaactg

SEQ ID NO: 10976 - DNA, 26 bp, synthetic construct
  misc_feature 1..26: note = Synthetic Construct
  source 1..26: mol_type = other DNA
ggctcacattctctggagaataaacc

SEQ ID NO: 10977 - DNA, 24 bp, synthetic construct
  misc_feature 1..24: note = Synthetic Construct
  source 1..24: mol_type = other DNA
gggaggtagagtgttttcaagaca

SEQ ID NO: 10978 - DNA, 19 bp, synthetic construct
  misc_feature 1..19: note = Synthetic Construct
  source 1..19: mol_type = other DNA
tggcctgtggatgttgcaa

SEQ ID NO: 10979 - DNA, 29 bp, synthetic construct
  misc_feature 1..29: note = Synthetic Construct
  source 1..29: mol_type = other DNA
gagggttgatcattttggatttcatactg

SEQ ID NO: 10980 - DNA, 21 bp, synthetic construct
  misc_feature 1..21: note = Synthetic Construct
  source 1..21: mol_type = other DNA
tgcctgtggcttggagcaaat

SEQ ID NO: 10981 - DNA, 19 bp, synthetic construct
  misc_feature 1..19: note = Synthetic Construct
  source 1..19: mol_type = other DNA
cctgccacccagtcctgaa

SEQ ID NO: 10982 - DNA, 22 bp, synthetic construct
  misc_feature 1..22: note = Synthetic Construct
  source 1..22: mol_type = other DNA
agcgtgtttgccctcaagttga

SEQ ID NO: 10983 - DNA, 21 bp, synthetic construct
  misc_feature 1..21: note = Synthetic Construct
  source 1..21: mol_type = other DNA
tcagaaggcatggaccacact

SEQ ID NO: 10984 - DNA, 25 bp, synthetic construct
  misc_feature 1..25: note = Synthetic Construct
  source 1..25: mol_type = other DNA
cgcagtattggatgcttttgtctca

SEQ ID NO: 10985 - DNA, 21 bp, synthetic construct
  misc_feature 1..21: note = Synthetic Construct
  source 1..21: mol_type = other DNA
tggcccaggagagcattttca

SEQ ID NO: 10986 - DNA, 30 bp, synthetic construct
  misc_feature 1..30: note = Synthetic Construct
  source 1..30: mol_type = other DNA
cagagaccttcgattaatgttctatagaga

SEQ ID NO: 10987 - DNA, 25 bp, synthetic construct
  misc_feature 1..25: note = Synthetic Construct
  source 1..25: mol_type = other DNA
ctcttggcccaaaagtaagagatct

SEQ ID NO: 10988 - DNA, 27 bp, synthetic construct
  misc_feature 1..27: note = Synthetic Construct
  source 1..27: mol_type = other DNA
ggaaggtcctgattcctagtattttgg

SEQ ID NO: 10989 - DNA, 23 bp, synthetic construct
  misc_feature 1..23: note = Synthetic Construct
  source 1..23: mol_type = other DNA
gatgggagcagcaatgtttcttc

SEQ ID NO: 10990 - DNA, 22 bp, synthetic construct
  misc_feature 1..22: note = Synthetic Construct
  source 1..22: mol_type = other DNA
aggggagatgtgttcgggaaaa

SEQ ID NO: 10991 - DNA, 25 bp, synthetic construct
  misc_feature 1..25: note = Synthetic Construct
  source 1..25: mol_type = other DNA
ggtgaggacaatacagcatgatagg

SEQ ID NO: 10992 - DNA, 29 bp, synthetic construct
  misc_feature 1..29: note = Synthetic Construct
  source 1..29: mol_type = other DNA
tgcattccatatttagtcagagactacag

SEQ ID NO: 10993 - DNA, 30 bp, synthetic construct
  misc_feature 1..30: note = Synthetic Construct
  source 1..30: mol_type = other DNA
gcttgtcataaatgcaaagaatcctacttc

SEQ ID NO: 10994 - DNA, 26 bp, synthetic construct
  misc_feature 1..26: note = Synthetic Construct
  source 1..26: mol_type = other DNA
gcaatccaatcctgctccttagaaca

SEQ ID NO: 10995 - DNA, 22 bp, synthetic construct
  misc_feature 1..22: note = Synthetic Construct
  source 1..22: mol_type = other DNA
ccaagtatcagggcagggaaag

SEQ ID NO: 10996 - DNA, 27 bp, synthetic construct
  misc_feature 1..27: note = Synthetic Construct
  source 1..27: mol_type = other DNA
cactttttggagcggaatttactaagt

SEQ ID NO: 10997 - DNA, 26 bp, synthetic construct
  misc_feature 1..26: note = Synthetic Construct
  source 1..26: mol_type = other DNA
cccaagtaaggcataatctccaatgc

SEQ ID NO: 10998 - DNA, 26 bp, synthetic construct
  misc_feature 1..26: note = Synthetic Construct
  source 1..26: mol_type = other DNA
ggaaagcagtacttgtgacaaacttg

SEQ ID NO: 10999 - DNA, 28 bp, synthetic construct
  misc_feature 1..28: note = Synthetic Construct
  source 1..28: mol_type = other DNA
gactttgtggagtaaaatcttcattcct

SEQ ID NO: 11000 - DNA, 21 bp, synthetic construct
  misc_feature 1..21: note = Synthetic Construct
  source 1..21: mol_type = other DNA
ggagactggtttggggctgaa

SEQ ID NO: 11001 - DNA, 25 bp, synthetic construct
  misc_feature 1..25: note = Synthetic Construct
  source 1..25: mol_type = other DNA
aggaccactgtatcactacaaatcc

SEQ ID NO: 11002 - DNA, 30 bp, synthetic construct
  misc_feature 1..30: note = Synthetic Construct
  source 1..30: mol_type = other DNA
agacttttcatccatctgaatactactcaa

SEQ ID NO: 11003 - DNA, 25 bp, synthetic construct
  misc_feature 1..25: note = Synthetic Construct
  source 1..25: mol_type = other DNA
gaggtgtgttttttacccagattcc

SEQ ID NO: 11004 - DNA, 18 bp, synthetic construct
  misc_feature 1..18: note = Synthetic Construct
  source 1..18: mol_type = other DNA
agcaggcccagtgtacct

SEQ ID NO: 11005 - DNA, 22 bp, synthetic construct
  misc_feature 1..22: note = Synthetic Construct
  source 1..22: mol_type = other DNA
tcttgcctggagtaccaaagtc

SEQ ID NO: 11006 - DNA, 25 bp, synthetic construct
  misc_feature 1..25: note = Synthetic Construct
  source 1..25: mol_type = other DNA
gtaagggaggatggtgattgattca

SEQ ID NO: 11007 - DNA, 27 bp, synthetic construct
  misc_feature 1..27: note = Synthetic Construct
  source 1..27: mol_type = other DNA
cctgatagcctgttcttcatacaaaag

SEQ ID NO: 11008 - DNA, 24 bp, synthetic construct
  misc_feature 1..24: note = Synthetic Construct
  source 1..24: mol_type = other DNA
tccaacctggagtttcagaatcac

SEQ ID NO: 11009 - DNA, 23 bp, synthetic construct
  misc_feature 1..23: note = Synthetic Construct
  source 1..23: mol_type = other DNA
acccaagacctcacagagtagtt

SEQ ID NO: 11010 - DNA, 24 bp, synthetic construct
  misc_feature 1..24: note = Synthetic Construct
  source 1..24: mol_type = other DNA
acgttaacatcacagctagggaat

SEQ ID NO: 11011 - DNA, 19 bp, synthetic construct
  misc_feature 1..19: note = Synthetic Construct
  source 1..19: mol_type = other DNA
ccagcgtgggtttggagaa

SEQ ID NO: 11012 - DNA, 20 bp, synthetic construct
  misc_feature 1..20: note = Synthetic Construct
  source 1..20: mol_type = other DNA
ttgcccacctctgtctcact

SEQ ID NO: 11013 - DNA, 18 bp, synthetic construct
  misc_feature 1..18: note = Synthetic Construct
  source 1..18: mol_type = other DNA
accacctgcctccacact

SEQ ID NO: 11014 - DNA, 22 bp, synthetic construct
  misc_feature 1..22: note = Synthetic Construct
  source 1..22: mol_type = other DNA
aggccaggtacatggtgatgtt

SEQ ID NO: 11015 - DNA, 25 bp, synthetic construct
  misc_feature 1..25: note = Synthetic Construct
  source 1..25: mol_type = other DNA
ccatagcagctgaggataaaacaga

SEQ ID NO: 11016 - DNA, 20 bp, synthetic construct
  misc_feature 1..20: note = Synthetic Construct
  source 1..20: mol_type = other DNA
cctcactgtgctccagcttt

SEQ ID NO: 11017 - DNA, 24 bp, synthetic construct
  misc_feature 1..24: note = Synthetic Construct
  source 1..24: mol_type = other DNA
ggtttggttgcgttgcaataaatg

SEQ ID NO: 11018 - DNA, 24 bp, synthetic construct
  misc_feature 1..24: note = Synthetic Construct
  source 1..24: mol_type = other DNA
ccagcctcagctctagaaaagtga

SEQ ID NO: 11019 - DNA, 24 bp, synthetic construct
  misc_feature 1..24: note = Synthetic Construct
  source 1..24: mol_type = other DNA
gctgttggcttgatttccctgact

SEQ ID NO: 11020 - DNA, 29 bp, synthetic construct
  misc_feature 1..29: note = Synthetic Construct
  source 1..29: mol_type = other DNA
gatggaattaattgaaactacagccttca

SEQ ID NO: 11021 - DNA, 26 bp, synthetic construct
  misc_feature 1..26: note = Synthetic Construct
  source 1..26: mol_type = other DNA
gtgtggcttgtcaatacatgctatca

SEQ ID NO: 11022 - DNA, 23 bp, synthetic construct
  misc_feature 1..23: note = Synthetic Construct
  source 1..23: mol_type = other DNA
tggtccatctggcactgtatcca

SEQ ID NO: 11023 - DNA, 27 bp, synthetic construct
  misc_feature 1..27: note = Synthetic Construct
  source 1..27: mol_type = other DNA
ggtggcagagttttgagaagttatgtg

SEQ ID NO: 11024 - DNA, 22 bp, synthetic construct
  misc_feature 1..22: note = Synthetic Construct
  source 1..22: mol_type = other DNA
gattttgcacaaggggaaagca

SEQ ID NO: 11025 - DNA, 24 bp, synthetic construct
  misc_feature 1..24: note = Synthetic Construct
  source 1..24: mol_type = other DNA
cccttatcttggttgctctgcatt

SEQ ID NO: 11026 - DNA, 23 bp, synthetic construct
  misc_feature 1..23: note = Synthetic Construct
  source 1..23: mol_type = other DNA
ctgggaggttcaggaagtttgag

SEQ ID NO: 11027 - DNA, 26 bp, synthetic construct
  misc_feature 1..26: note = Synthetic Construct
  source 1..26: mol_type = other DNA
gctgaatgactgtaaatctgccatca

SEQ ID NO: 11028 - DNA, 26 bp, synthetic construct
  misc_feature 1..26: note = Synthetic Construct
  source 1..26: mol_type = other DNA
aaatctccaaggaaaagagccttttc

SEQ ID NO: 11029 - DNA, 25 bp, synthetic construct
  misc_feature 1..25: note = Synthetic Construct
  source 1..25: mol_type = other DNA
ttggaagaagcaatgatctcaacac

SEQ ID NO: 11030 - DNA, 21 bp, synthetic construct
  misc_feature 1..21: note = Synthetic Construct
  source 1..21: mol_type = other DNA
tgtggctgtagaggctgagaa

SEQ ID NO: 11031 - DNA, 26 bp, synthetic construct
  misc_feature 1..26: note = Synthetic Construct
  source 1..26: mol_type = other DNA
agattcaatctagtcaagctgtcctt

SEQ ID NO: 11032 - DNA, 26 bp, synthetic construct
  misc_feature 1..26: note = Synthetic Construct
  source 1..26: mol_type = other DNA
gactcacacacaaaatacttcatggt

SEQ ID NO: 11033 - DNA, 19 bp, synthetic construct
  misc_feature 1..19: note = Synthetic Construct
  source 1..19: mol_type = other DNA
agccacgcttgtgctctga

SEQ ID NO: 11034 - DNA, 26 bp, synthetic construct
  misc_feature 1..26: note = Synthetic Construct
  source 1..26: mol_type = other DNA
gggtttgctctagggaaatgtaactt

SEQ ID NO: 11035 - DNA, 24 bp, synthetic construct
  misc_feature 1..24: note = Synthetic Construct
  source 1..24: mol_type = other DNA
agctgggttctgaaggatgaagag

SEQ ID NO: 11036 - DNA, 22 bp, synthetic construct
  misc_feature 1..22: note = Synthetic Construct
  source 1..22: mol_type = other DNA
aggaaaacagtgagcagttgca

SEQ ID NO: 11037 - DNA, 26 bp, synthetic construct
  misc_feature 1..26: note = Synthetic Construct
  source 1..26: mol_type = other DNA
cttttgcaggagctattgcagttaat

SEQ ID NO: 11038 - DNA, 20 bp, synthetic construct
  misc_feature 1..20: note = Synthetic Construct
  source 1..20: mol_type = other DNA
tgcacttccatgcagctgat

SEQ ID NO: 11039 - DNA, 24 bp, synthetic construct
  misc_feature 1..24: note = Synthetic Construct
  source 1..24: mol_type = other DNA
gctccttgcatggataaccagaaa

SEQ ID NO: 11040 - DNA, 25 bp, synthetic construct
  misc_feature 1..25: note = Synthetic Construct
  source 1..25: mol_type = other DNA
cccaaacttcatggtcatacttcca

SEQ ID NO: 11041 - DNA, 29 bp, synthetic construct
  misc_feature 1..29: note = Synthetic Construct
  source 1..29: mol_type = other DNA
gtgtctatagccctttagtttgttcattt

SEQ ID NO: 11042 - DNA, 19 bp, synthetic construct
  misc_feature 1..19: note = Synthetic Construct
  source 1..19: mol_type = other DNA
agggttccgtgagcacctt

SEQ ID NO: 11043 - DNA, 20 bp, synthetic construct
  misc_feature 1..20: note = Synthetic Construct
  source 1..20: mol_type = other DNA
actccctgcacacacacact

SEQ ID NO: 11044 - DNA, 27 bp, synthetic construct
  misc_feature 1..27: note = Synthetic Construct
  source 1..27: mol_type = other DNA
ccccttatctaaacctctacctaacca

SEQ ID NO: 11045 - DNA, 24 bp, synthetic construct
  misc_feature 1..24: note = Synthetic Construct
  source 1..24: mol_type = other DNA
tcctcgacagaagggatgacaact

SEQ ID NO: 11046 - DNA, 24 bp, synthetic construct
  misc_feature 1..24: note = Synthetic Construct
  source 1..24: mol_type = other DNA
ggcatttttgacagctgcatggaa

SEQ ID NO: 11047 - DNA, 27 bp, synthetic construct
  misc_feature 1..27: note = Synthetic Construct
  source 1..27: mol_type = other DNA
gcaataaaaattcaaacaggcatcagt

SEQ ID NO: 11048 - DNA, 22 bp, synthetic construct
  misc_feature 1..22: note = Synthetic Construct
  source 1..22: mol_type = other DNA
tcccagttccatggccatagtt

SEQ ID NO: 11049 - DNA, 21 bp, synthetic construct
  misc_feature 1..21: note = Synthetic Construct
  source 1..21: mol_type = other DNA
agctcttcaccaggaccatgt

SEQ ID NO: 11050 - DNA, 21 bp, synthetic construct
  misc_feature 1..21: note = Synthetic Construct
  source 1..21: mol_type = other DNA
aggcaacccaggtatctctgt

SEQ ID NO: 11051 - DNA, 22 bp, synthetic construct
  misc_feature 1..22: note = Synthetic Construct
  source 1..22: mol_type = other DNA
gccagcagcatagcatttccaa

SEQ ID NO: 11052 - DNA, 29 bp, synthetic construct
  misc_feature 1..29: note = Synthetic Construct
  source 1..29: mol_type = other DNA
ccttcctatctcttcgcacatttaattgt

SEQ ID NO: 11053 - DNA, 24 bp, synthetic construct
  misc_feature 1..24: note = Synthetic Construct
  source 1..24: mol_type = other DNA
gttaaacagcagggaatggaatgg

SEQ ID NO: 11054 - DNA, 27 bp, synthetic construct
  misc_feature 1..27: note = Synthetic Construct
  source 1..27: mol_type = other DNA
gtgttctactgagacaagaagggaaaa

SEQ ID NO: 11055 - DNA, 23 bp, synthetic construct
  misc_feature 1..23: note = Synthetic Construct
  source 1..23: mol_type = other DNA
ctactgcaggtaaacagccctta

SEQ ID NO: 11056 - DNA, 22 bp, synthetic construct
  misc_feature 1..22: note = Synthetic Construct
  source 1..22: mol_type = other DNA
tgtaaggccctacccagatcca

SEQ ID NO: 11057 - DNA, 19 bp, synthetic construct
  misc_feature 1..19: note = Synthetic Construct
  source 1..19: mol_type = other DNA
gcccccttgccatgtgatg

SEQ ID NO: 11058 - DNA, 22 bp, synthetic construct
  misc_feature 1..22: note = Synthetic Construct
  source 1..22: mol_type = other DNA
gtgaccaccacactgatgtcaa

SEQ ID NO: 11059 - DNA, 24 bp, synthetic construct
  misc_feature 1..24: note = Synthetic Construct
  source 1..24: mol_type = other DNA
ccctcaagcatgtatgagcaggta

SEQ ID NO: 11060 - DNA, 24 bp, synthetic construct
  misc_feature 1..24: note = Synthetic Construct
  source 1..24: mol_type = other DNA
ttgcatttctcgaatcccatttgg

SEQ ID NO: 11061 - DNA, 21 bp, synthetic construct
  misc_feature 1..21: note = Synthetic Construct
  source 1..21: mol_type = other DNA
agggtcacaacagcctttctc

SEQ ID NO: 11062 - DNA, 22 bp, synthetic construct
  misc_feature 1..22: note = Synthetic Construct
  source 1..22: mol_type = other DNA
gacttttgctgcagtgcatgag

SEQ ID NO: 11063 - DNA, 30 bp, synthetic construct
  misc_feature 1..30: note = Synthetic Construct
  source 1..30: mol_type = other DNA
gtccaaatttactcagaggtacagtgaatt

SEQ ID NO: 11064 - DNA, 23 bp, synthetic construct
  misc_feature 1..23: note = Synthetic Construct
  source 1..23: mol_type = other DNA
gacatctggaaccttctcatgca

SEQ ID NO: 11065 - DNA, 24 bp, synthetic construct
  misc_feature 1..24: note = Synthetic Construct
  source 1..24: mol_type = other DNA
cggcaagtgggaatgtgatctaca

SEQ ID NO: 11066 - DNA, 21 bp, synthetic construct
  misc_feature 1..21: note = Synthetic Construct
  source 1..21: mol_type = other DNA
atccatcctcagccacaagtg

SEQ ID NO: 11067 - DNA, 21 bp, synthetic construct
  misc_feature 1..21: note = Synthetic Construct
  source 1..21: mol_type = other DNA
cctcacagtcagtctgccttt

SEQ ID NO: 11068 - DNA, 25 bp, synthetic construct
  misc_feature 1..25: note = Synthetic Construct
  source 1..25: mol_type = other DNA
gcctccacaataagatgtctatcca

SEQ ID NO: 11069 - DNA, 21 bp, synthetic construct
  misc_feature 1..21: note = Synthetic Construct
  source 1..21: mol_type = other DNA
ggccacggcagaacattgtaa

SEQ ID NO: 11070 - DNA, 30 bp, synthetic construct
  misc_feature 1..30: note = Synthetic Construct
  source 1..30: mol_type = other DNA
aaaatgacagtaacatctgtatccaaaagt

SEQ ID NO: 11071 - DNA, 22 bp, synthetic construct
  misc_feature 1..22: note = Synthetic Construct
  source 1..22: mol_type = other DNA
gtgagctgtgatcacaccacta

SEQ ID NO: 11072 - DNA, 24 bp, synthetic construct
  misc_feature 1..24: note = Synthetic Construct
  source 1..24: mol_type = other DNA
ccaggatacagggtgatactagct

SEQ ID NO: 11073 - DNA, 22 bp, synthetic construct
  misc_feature 1..22: note = Synthetic Construct
  source 1..22: mol_type = other DNA
ggcttttcctgtggcttggtta

SEQ ID NO: 11074 - DNA, 24 bp, synthetic construct
  misc_feature 1..24: note = Synthetic Construct
  source 1..24: mol_type = other DNA
ccctaaacgtatgaccacaaactg

SEQ ID NO: 11075 - DNA, 22 bp, synthetic construct
  misc_feature 1..22: note = Synthetic Construct
  source 1..22: mol_type = other DNA
ggtaagctgagacccatttgct

SEQ ID NO: 11076 - DNA, 23 bp, synthetic construct
  misc_feature 1..23: note = Synthetic Construct
  source 1..23: mol_type = other DNA
tgatcctgtgttggctcaacatt

SEQ ID NO: 11077 - DNA, 23 bp, synthetic construct
  misc_feature 1..23: note = Synthetic Construct
  source 1..23: mol_type = other DNA
tgcgagaaagaactgaaccaagt

SEQ ID NO: 11078 - DNA, 18 bp, synthetic construct
  misc_feature 1..18: note = Synthetic Construct
  source 1..18: mol_type = other DNA
tcagtcctggccctgtgt

SEQ ID NO: 11079 - DNA, 30 bp, synthetic construct
  misc_feature 1..30: note = Synthetic Construct
  source 1..30: mol_type = other DNA
cctgacataaagtcttacgtcaatttactt

SEQ ID NO: 11080 - DNA, 20 bp, synthetic construct
  misc_feature 1..20: note = Synthetic Construct
  source 1..20: mol_type = other DNA
gctctgtgcctgctgatgtg

SEQ ID NO: 11081 - DNA, 30 bp, synthetic construct
  misc_feature 1..30: note = Synthetic Construct
  source 1..30: mol_type = other DNA
gagtttggaataaatacgacaaccacatac

SEQ ID NO: 11082 - DNA, 28 bp, synthetic construct
  misc_feature 1..28: note = Synthetic Construct
  source 1..28: mol_type = other DNA
ccctggattagtaagaatgggcttcaag

SEQ ID NO: 11083 - DNA, 22 bp, synthetic construct
  misc_feature 1..22: note = Synthetic Construct
  source 1..22: mol_type = other DNA
cctgtcaccaattggcaatacg

SEQ ID NO: 11084 - DNA, 22 bp, synthetic construct
  misc_feature 1..22: note = Synthetic Construct
  source 1..22: mol_type = other DNA
gagctgcctgtaacctcttctt

SEQ ID NO: 11085 - DNA, 21 bp, synthetic construct
  misc_feature 1..21: note = Synthetic Construct
  source 1..21: mol_type = other DNA
actgatggtgggcttcatgct

SEQ ID NO: 11086 - DNA, 22 bp, synthetic construct
  misc_feature 1..22: note = Synthetic Construct
  source 1..22: mol_type = other DNA
ccccaaagcaattctccctgta

SEQ ID NO: 11087 - DNA, 24 bp, synthetic construct
  misc_feature 1..24: note = Synthetic Construct
  source 1..24: mol_type = other DNA
gctccttttatgttgggggaaagg

SEQ ID NO: 11088 - DNA, 19 bp, synthetic construct
  misc_feature 1..19: note = Synthetic Construct
  source 1..19: mol_type = other DNA
tggggccaagcacttgcat

SEQ ID NO: 11089 - DNA, 20 bp, synthetic construct
  misc_feature 1..20: note = Synthetic Construct
  source 1..20: mol_type = other DNA
gggatccctggggagctatg

SEQ ID NO: 11090 - DNA, 22 bp, synthetic construct
  misc_feature 1..22: note = Synthetic Construct
  source 1..22: mol_type = other DNA
ttcagacccaagcactggagat

SEQ ID NO: 11091 - DNA, 28 bp, synthetic construct
  misc_feature 1..28: note = Synthetic Construct
  source 1..28: mol_type = other DNA
ctcttagatagttccagttctgtggtta

SEQ ID NO: 11092 - DNA, 24 bp, synthetic construct
  misc_feature 1..24: note = Synthetic Construct
  source 1..24: mol_type = other DNA
gccttccttctacaaaaccctgtt

SEQ ID NO: 11093 - DNA, 29 bp, synthetic construct
  misc_feature 1..29: note = Synthetic Construct
  source 1..29: mol_type = other DNA
tgaaactttaaattattccaggccttgag

SEQ ID NO: 11094 - DNA, 26 bp, synthetic construct
  misc_feature 1..26: note = Synthetic Construct
  source 1..26: mol_type = other DNA
gacagtggggaagaaaacatttttca

SEQ ID NO: 11095 - DNA, 26 bp, synthetic construct
  misc_feature 1..26: note = Synthetic Construct
  source 1..26: mol_type = other DNA
gccttctaaagtctcctcactttacc

SEQ ID NO: 11096 - DNA, 21 bp, synthetic construct
  misc_feature 1..21: note = Synthetic Construct
  source 1..21: mol_type = other DNA
agtgcctaccaggtgctaggt

SEQ ID NO: 11097 - DNA, 21 bp, synthetic construct
  misc_feature 1..21: note = Synthetic Construct
  source 1..21: mol_type = other DNA
gcagaatccagtgcagatcct

SEQ ID NO: 11098 - DNA, 21 bp, synthetic construct
  misc_feature 1..21: note = Synthetic Construct
  source 1..21: mol_type = other DNA
agggttcccaagtcagaaggt

SEQ ID NO: 11099 - DNA, 23 bp, synthetic construct
  misc_feature 1..23: note = Synthetic Construct
  source 1..23: mol_type = other DNA
aaggctgccttagggaactatgc

SEQ ID NO: 11100 - DNA, 19 bp, synthetic construct
  misc_feature 1..19: note = Synthetic Construct
  source 1..19: mol_type = other DNA
agtggctggtgggctgaca

SEQ ID NO: 11101 - DNA, 26 bp, synthetic construct
  misc_feature 1..26: note = Synthetic Construct
  source 1..26: mol_type = other DNA
tgaacatgccttgctagttattctct

SEQ ID NO: 11102 - DNA, 22 bp, synthetic construct
  misc_feature 1..22: note = Synthetic Construct
  source 1..22: mol_type = other DNA
acccctgcaagaggatgaagta

SEQ ID NO: 11103 - DNA, 28 bp, synthetic construct
  misc_feature 1..28: note = Synthetic Construct
  source 1..28: mol_type = other DNA
agtaaaaaactggctcctaaatctctct

SEQ ID NO: 11104 - DNA, 21 bp, synthetic construct
  misc_feature 1..21: note = Synthetic Construct
  source 1..21: mol_type = other DNA
ccaatccaacggaaccccata

SEQ ID NO: 11105 - DNA, 24 bp, synthetic construct
  misc_feature 1..24: note = Synthetic Construct
  source 1..24: mol_type = other DNA
ttgagaattgctcttggacacaga

SEQ ID NO: 11106 - DNA, 20 bp, synthetic construct
  misc_feature 1..20: note = Synthetic Construct
  source 1..20: mol_type = other DNA
cgtttccaggcacactgaga

SEQ ID NO: 11107 - DNA, 28 bp, synthetic construct
  misc_feature 1..28: note = Synthetic Construct
  source 1..28: mol_type = other DNA
gagtctccatccaaatgtatcctatcag

SEQ ID NO: 11108 - DNA, 21 bp, synthetic construct
  misc_feature 1..21: note = Synthetic Construct
  source 1..21: mol_type = other DNA
aggctcgggctataacagaga

SEQ ID NO: 11109 - DNA, 24 bp, synthetic construct
  misc_feature 1..24: note = Synthetic Construct
  source 1..24: mol_type = other DNA
ggaatcatccagcctgatggcaaa

SEQ ID NO: 11110 - DNA, 23 bp, synthetic construct
  misc_feature 1..23: note = Synthetic Construct
  source 1..23: mol_type = other DNA
aggcctatttcttcagccacatt

SEQ ID NO: 11111 - DNA, 20 bp, synthetic construct
  misc_feature 1..20: note = Synthetic Construct
  source 1..20: mol_type = other DNA
gctgtgaagacgcacatgga

SEQ ID NO: 11112 - DNA, 21 bp, synthetic construct
  misc_feature 1..21: note = Synthetic Construct
  source 1..21: mol_type = other DNA
catgtcacacagagcctcaca

SEQ ID NO: 11113 - DNA, 20 bp, synthetic construct
  misc_feature 1..20: note = Synthetic Construct
  source 1..20: mol_type = other DNA
tgcgggcatggtttggttct

SEQ ID NO: 11114 - DNA, 28 bp, synthetic construct
  misc_feature 1..28: note = Synthetic Construct
  source 1..28: mol_type = other DNA
ccaaagcaagacatagcaaatagttctt

SEQ ID NO: 11115 - DNA, 19 bp, synthetic construct
  misc_feature 1..19: note = Synthetic Construct
  source 1..19: mol_type = other DNA
cagccaccagcaagaccaa

SEQ ID NO: 11116 - DNA, 24 bp, synthetic construct
  misc_feature 1..24: note = Synthetic Construct
  source 1..24: mol_type = other DNA
cacggtggagataaaacccaactg

SEQ ID NO: 11117 - DNA, 24 bp, synthetic construct
  misc_feature 1..24: note = Synthetic Construct
  source 1..24: mol_type = other DNA
gacccttcaggctacaatctacac

SEQ ID NO: 11118 - DNA, 30 bp, synthetic construct
  misc_feature 1..30: note = Synthetic Construct
  source 1..30: mol_type = other DNA
gtcctagtatatacatgtaggagcccatac

SEQ ID NO: 11119 - DNA, 25 bp, synthetic construct
  misc_feature 1..25: note = Synthetic Construct
  source 1..25: mol_type = other DNA
gtggtacaaacatggctcactacag

SEQ ID NO: 11120 - DNA, 25 bp, synthetic construct
  misc_feature 1..25: note = Synthetic Construct
  source 1..25: mol_type = other DNA
ctgttatccccttctcccatcaatc

SEQ ID NO: 11121 - DNA, 23 bp, synthetic construct
  misc_feature 1..23: note = Synthetic Construct
  source 1..23: mol_type = other DNA
agcctctctctgccatacaggaa

SEQ ID NO: 11122 - DNA, 24 bp, synthetic construct
  misc_feature 1..24: note = Synthetic Construct
  source 1..24: mol_type = other DNA
acctgtaaagcacagtctctctca

SEQ ID NO: 11123 - DNA, 28 bp, synthetic construct
  misc_feature 1..28: note = Synthetic Construct
  source 1..28: mol_type = other DNA
cctcatggtcacctgataattccttcag

SEQ ID NO: 11124 - DNA, 18 bp, synthetic construct
  misc_feature 1..18: note = Synthetic Construct
  source 1..18: mol_type = other DNA
gcccaggctggtcacaaa

SEQ ID NO: 11125 - DNA, 23 bp, synthetic construct
  misc_feature 1..23: note = Synthetic Construct
  source 1..23: mol_type = other DNA
tgtgttgtgtgaggaagctatgg

SEQ ID NO: 11126 - DNA, 19 bp, synthetic construct
  misc_feature 1..19: note = Synthetic Construct
  source 1..19: mol_type = other DNA
agagcctgcgcccgacgta

SEQ ID NO: 11127 - DNA, 22 bp, synthetic construct
  misc_feature 1..22: note = Synthetic Construct
  source 1..22: mol_type = other DNA
aagctgaactgcagggaagatc

SEQ ID NO: 11128 - DNA, 21 bp, synthetic construct
  misc_feature 1..21: note = Synthetic Construct
  source 1..21: mol_type = other DNA
tgacagggcgcttcctttaga

SEQ ID NO: 11129 - DNA, 25 bp, synthetic construct
  misc_feature 1..25: note = Synthetic Construct
  source 1..25: mol_type = other DNA
cccacagtgtgtacttgagtatctc

SEQ ID NO: 11130 - DNA, 21 bp, synthetic construct
  misc_feature 1..21: note = Synthetic Construct
  source 1..21: mol_type = other DNA
tgctttcagccaaggcaactg

SEQ ID NO: 11131 - DNA, 19 bp, synthetic construct
  misc_feature 1..19: note = Synthetic Construct
  source 1..19: mol_type = other DNA
ggtcctgtccttgcaagca

SEQ ID NO: 11132 - DNA, 25 bp, synthetic construct
  misc_feature 1..25: note = Synthetic Construct
  source 1..25: mol_type = other DNA
gctccagtgaaaccacatttattcc

SEQ ID NO: 11133 - DNA, 21 bp, synthetic construct
  misc_feature 1..21: note = Synthetic Construct
  source 1..21: mol_type = other DNA
cccgatgaaaggaagcaacct

SEQ ID NO: 11134 - DNA, 25 bp, synthetic construct
  misc_feature 1..25: note = Synthetic Construct
  source 1..25: mol_type = other DNA
gacaaaagggctgttttcacagttc

SEQ ID NO: 11135 - DNA, 19 bp, synthetic construct
  misc_feature 1..19: note = Synthetic Construct
  source 1..19: mol_type = other DNA
tgtgcggcagatgctcagt

SEQ ID NO: 11136 - DNA, 22 bp, synthetic construct
  misc_feature 1..22: note = Synthetic Construct
  source 1..22: mol_type = other DNA
ggaaacgggcttagtgatgcta

SEQ ID NO: 11137 - DNA, 26 bp, synthetic construct
  misc_feature 1..26: note = Synthetic Construct
  source 1..26: mol_type = other DNA
gacagccacagtgcttagaaaaatat

SEQ ID NO: 11138 - DNA, 30 bp, synthetic construct
  misc_feature 1..30: note = Synthetic Construct
  source 1..30: mol_type = other DNA
ttactgatggagatagaagttagtttagca

SEQ ID NO: 11139 - DNA, 26 bp, synthetic construct
  misc_feature 1..26: note = Synthetic Construct
  source 1..26: mol_type = other DNA
cagcttaaagtaaaatgctccactga

SEQ ID NO: 11140 - DNA, 25 bp, synthetic construct
  misc_feature 1..25: note = Synthetic Construct
  source 1..25: mol_type = other DNA
gggaaatcacaaacggtagggtagt

SEQ ID NO: 11141 - DNA, 24 bp, synthetic construct
  misc_feature 1..24: note = Synthetic Construct
  source 1..24: mol_type = other DNA
tgagcatcaccatgtaaccaaagt

SEQ ID NO: 11142 - DNA, 29 bp, synthetic construct
  misc_feature 1..29: note = Synthetic Construct
  source 1..29: mol_type = other DNA
gaagacactctgaaaaacctatctactgt

SEQ ID NO: 11143 - DNA, 22 bp, synthetic construct
  misc_feature 1..22: note = Synthetic Construct
  source 1..22: mol_type = other DNA
gccatggtgacccaagtgttaa

SEQ ID NO: 11144 - DNA, 22 bp, synthetic construct
  misc_feature 1..22: note = Synthetic Construct
  source 1..22: mol_type = other DNA
tggctggaacttatgggtcaga

SEQ ID NO: 11145 - DNA, 27 bp, synthetic construct
  misc_feature 1..27: note = Synthetic Construct
  source 1..27: mol_type = other DNA
agataaccacgaaaaggtcattgagaa

SEQ ID NO: 11146 - DNA, 25 bp, synthetic construct
  misc_feature 1..25: note = Synthetic Construct
  source 1..25: mol_type = other DNA
ttatctctccagctgtgagaaactc

SEQ ID NO: 11147 - DNA, 25 bp, synthetic construct
  misc_feature 1..25: note = Synthetic Construct
  source 1..25: mol_type = other DNA
cacatccctgactctttggttatgt

SEQ ID NO: 11148 - DNA, 24 bp, synthetic construct
  misc_feature 1..24: note = Synthetic Construct
  source 1..24: mol_type = other DNA
gcctctgtcatggctatgtttgtg

SEQ ID NO: 11149 - DNA, 25 bp, synthetic construct
  misc_feature 1..25: note = Synthetic Construct
  source 1..25: mol_type = other DNA
gaagagcctgctttgacaaatactt

SEQ ID NO: 11150 - DNA, 22 bp, synthetic construct
  misc_feature 1..22: note = Synthetic Construct
  source 1..22: mol_type = other DNA
gcagaaccctggtttagaggaa

SEQ ID NO: 11151 - DNA, 26 bp, synthetic construct
  misc_feature 1..26: note = Synthetic Construct
  source 1..26: mol_type = other DNA
gggtgatcctgaaaaacactgtaagt

SEQ ID NO: 11152 - DNA, 19 bp, synthetic construct
  misc_feature 1..19: note = Synthetic Construct
  source 1..19: mol_type = other DNA
cccggctctgaggtttagc

SEQ ID NO: 11153 - DNA, 24 bp, synthetic construct
  misc_feature 1..24: note = Synthetic Construct
  source 1..24: mol_type = other DNA
gctggacacccctgatttaaggta

SEQ ID NO: 11154 - DNA, 28 bp, synthetic construct
  misc_feature 1..28: note = Synthetic Construct
  source 1..28: mol_type = other DNA
gctagcctggaaaatatttgtccaatag

SEQ ID NO: 11155 - DNA, 26 bp, synthetic construct
  misc_feature 1..26: note = Synthetic Construct
  source 1..26: mol_type = other DNA
gagcatgagagaatgtggttagactt

SEQ ID NO: 11156 - DNA, 21 bp, synthetic construct
  misc_feature 1..21: note = Synthetic Construct
  source 1..21: mol_type = other DNA
acagtcctctcctggctagtg

SEQ ID NO: 11157 - DNA, 21 bp, synthetic construct
  misc_feature 1..21: note = Synthetic Construct
  source 1..21: mol_type = other DNA
gctggctggctcatgaatcct

SEQ ID NO: 11158 - DNA, 23 bp, synthetic construct
  misc_feature 1..23: note = Synthetic Construct
  source 1..23: mol_type = other DNA
tgtaacgttccctctctctccaa

SEQ ID NO: 11159 - DNA, 27 bp, synthetic construct
  misc_feature 1..27: note = Synthetic Construct
  source 1..27: mol_type = other DNA
gtctacacaacattgctgattctgaga

SEQ ID NO: 11160 - DNA, 21 bp, synthetic construct
  misc_feature 1..21: note = Synthetic Construct
  source 1..21: mol_type = other DNA
atggccaaggttgggtttctg

SEQ ID NO: 11161 - DNA, 22 bp, synthetic construct
  misc_feature 1..22: note = Synthetic Construct
  source 1..22: mol_type = other DNA
ccaatcctgcaatgccaagttc

SEQ ID NO: 11162 - DNA, 19 bp, synthetic construct
  misc_feature 1..19: note = Synthetic Construct
  source 1..19: mol_type = other DNA
cagacaggcgagcgtatgg

SEQ ID NO: 11163 - DNA, 19 bp, synthetic construct
  misc_feature 1..19: note = Synthetic Construct
  source 1..19: mol_type = other DNA
gcatcggcagagagcttct

SEQ ID NO: 11164 - DNA, 27 bp, synthetic construct
  misc_feature 1..27: note = Synthetic Construct
  source 1..27: mol_type = other DNA
gtgagtaagagagccaagattcagatg

SEQ ID NO: 11165 - DNA, 25 bp, synthetic construct
  misc_feature 1..25: note = Synthetic Construct
  source 1..25: mol_type = other DNA
caaggagctttcattcccttaatcg

SEQ ID NO: 11166 - DNA, 22 bp, synthetic construct
  misc_feature 1..22: note = Synthetic Construct
  source 1..22: mol_type = other DNA
gccaggaatgatctggaaatgc

SEQ ID NO: 11167 - DNA, 29 bp, synthetic construct
  misc_feature 1..29: note = Synthetic Construct
  source 1..29: mol_type = other DNA
attacacaataattgcatcagatgttcct

SEQ ID NO: 11168 - DNA, 21 bp, synthetic construct
  misc_feature 1..21: note = Synthetic Construct
  source 1..21: mol_type = other DNA
tccccaaacaggcttgacagt

SEQ ID NO: 11169 - DNA, 24 bp, synthetic construct
  misc_feature 1..24: note = Synthetic Construct
  source 1..24: mol_type = other DNA
ctgtttctccaacctccagattgg

SEQ ID NO: 11170 - DNA, 23 bp, synthetic construct
  misc_feature 1..23: note = Synthetic Construct
  source 1..23: mol_type = other DNA
ccttggcatttgttggtggctaa

SEQ ID NO: 11171 - DNA, 26 bp, synthetic construct
  misc_feature 1..26: note = Synthetic Construct
  source 1..26: mol_type = other DNA
aaatgacaaacaaatgatgccaacac

SEQ ID NO: 11172 - DNA, 26 bp, synthetic construct
  misc_feature 1..26: note = Synthetic Construct
  source 1..26: mol_type = other DNA
aaaggtgtgctgataatgtgcataaa

SEQ ID NO: 11173 - DNA, 19 bp, synthetic construct
  misc_feature 1..19: note = Synthetic Construct
  source 1..19: mol_type = other DNA
agtatcccacgccctggtt

SEQ ID NO: 11174 - DNA, 19 bp, synthetic construct
  misc_feature 1..19: note = Synthetic Construct
  source 1..19: mol_type = other DNA
acctgtcgatgggcatggt

SEQ ID NO: 11175 - DNA, 23 bp, synthetic construct
  misc_feature 1..23: note = Synthetic Construct
  source 1..23: mol_type = other DNA
agggattcctaccaccagcttga

SEQ ID NO: 11176 - DNA, 22 bp, synthetic construct
  misc_feature 1..22: note = Synthetic Construct
  source 1..22: mol_type = other DNA
tgaccacttcctctcactgaca

SEQ ID NO: 11177 - DNA, 28 bp, synthetic construct
  misc_feature 1..28: note = Synthetic Construct
  source 1..28: mol_type = other DNA
gcctattataaccttctgcccacattcc

SEQ ID NO: 11178 - DNA, 24 bp, synthetic construct
  misc_feature 1..24: note = Synthetic Construct
  source 1..24: mol_type = other DNA
tctagactctgacagcctattggt

SEQ ID NO: 11179 - DNA, 22 bp, synthetic construct
  misc_feature 1..22: note = Synthetic Construct
  source 1..22: mol_type = other DNA
ttccctcgtgcttgtagtgaca

SEQ ID NO: 11180 - DNA, 20 bp, synthetic construct
  misc_feature 1..20: note = Synthetic Construct
  source 1..20: mol_type = other DNA
gccttctcagccttgtttgc

SEQ ID NO: 11181 - DNA, 26 bp, synthetic construct
  misc_feature 1..26: note = Synthetic Construct
  source 1..26: mol_type = other DNA
accgcagagtaatctatagtcacaga

SEQ ID NO: 11182 - DNA, 25 bp, synthetic construct
  misc_feature 1..25: note = Synthetic Construct
  source 1..25: mol_type = other DNA
tgatcccatcactggagctaaaaac

SEQ ID NO: 11183 - DNA, 23 bp, synthetic construct
  misc_feature 1..23: note = Synthetic Construct
  source 1..23: mol_type = other DNA
gggcaggacagttacataaacca

SEQ ID NO: 11184 - DNA, 26 bp, synthetic construct
  misc_feature 1..26: note = Synthetic Construct
  source 1..26: mol_type = other DNA
gacaaatctggctgtcatttctggat

SEQ ID NO: 11185 - DNA, 20 bp, synthetic construct
  misc_feature 1..20: note = Synthetic Construct
  source 1..20: mol_type = other DNA
tctgtggctctcaggcttct

SEQ ID NO: 11186 - DNA, 29 bp, synthetic construct
  misc_feature 1..29: note = Synthetic Construct
  source 1..29: mol_type = other DNA
tttttgagagaaggtcttactatgtcact

SEQ ID NO: 11187 - DNA, 22 bp, synthetic construct
  misc_feature 1..22: note = Synthetic Construct
  source 1..22: mol_type = other DNA
gacagagccaggattcaaagct

SEQ ID NO: 11188 - DNA, 28 bp, synthetic construct
  misc_feature 1..28: note = Synthetic Construct
  source 1..28: mol_type = other DNA
cactatttccttagcccttgatctatct

SEQ ID NO: 11189 - DNA, 18 bp, synthetic construct
  misc_feature 1..18: note = Synthetic Construct
  source 1..18: mol_type = other DNA
cgcctccgcccatgaaaa

SEQ ID NO: 11190 - DNA, 24 bp, synthetic construct
  misc_feature 1..24: note = Synthetic Construct
  source 1..24: mol_type = other DNA
ccccatcatacacaaaagcctttt

SEQ ID NO: 11191 - DNA, 22 bp, synthetic construct
  misc_feature 1..22: note = Synthetic Construct
  source 1..22: mol_type = other DNA
gagtggaccctcctaagtgttg

SEQ ID NO: 11192 - DNA, 25 bp, synthetic construct
  misc_feature 1..25: note = Synthetic Construct
  source 1..25: mol_type = other DNA
gcaatggcctagttaatgtgactct

SEQ ID NO: 11193 - DNA, 24 bp, synthetic construct
  misc_feature 1..24: note = Synthetic Construct
  source 1..24: mol_type = other DNA
gtaaacatgggctgatgaattgca

SEQ ID NO: 11194 - DNA, 25 bp, synthetic construct
  misc_feature 1..25: note = Synthetic Construct
  source 1..25: mol_type = other DNA
actcttggatgctgctacaatttgt

SEQ ID NO: 11195 - DNA, 29 bp, synthetic construct
  misc_feature 1..29: note = Synthetic Construct
  source 1..29: mol_type = other DNA
ggagcaggtaagctatgaatatgataggt

SEQ ID NO: 11196 - DNA, 24 bp, synthetic construct
  misc_feature 1..24: note = Synthetic Construct
  source 1..24: mol_type = other DNA
gccctgtgaatgtcgtgaatccta

SEQ ID NO: 11197 - DNA, 25 bp, synthetic construct
  misc_feature 1..25: note = Synthetic Construct
  source 1..25: mol_type = other DNA
ccatgtaagtccatggtgacttctc

SEQ ID NO: 11198 - DNA, 20 bp, synthetic construct
  misc_feature 1..20: note = Synthetic Construct
  source 1..20: mol_type = other DNA
acccacgggcagaactaagt

SEQ ID NO: 11199 - DNA, 19 bp, synthetic construct
  misc_feature 1..19: note = Synthetic Construct
  source 1..19: mol_type = other DNA
tgaggcatgcggtgtagct

SEQ ID NO: 11200 - DNA, 21 bp, synthetic construct
  misc_feature 1..21: note = Synthetic Construct
  source 1..21: mol_type = other DNA
tcaccaagcacagagcatgag

SEQ ID NO: 11201 - DNA, 21 bp, synthetic construct
  misc_feature 1..21: note = Synthetic Construct
  source 1..21: mol_type = other DNA
tctccgaggtcagaggactct

SEQ ID NO: 11202 - DNA, 22 bp, synthetic construct
  misc_feature 1..22: note = Synthetic Construct
  source 1..22: mol_type = other DNA
tcaaagggctcggagatttcac

SEQ ID NO: 11203 - DNA, 22 bp, synthetic construct
  misc_feature 1..22: note = Synthetic Construct
  source 1..22: mol_type = other DNA
ctgcttttcccctctcaaagct

SEQ ID NO: 11204 - DNA, 26 bp, synthetic construct
  misc_feature 1..26: note = Synthetic Construct
  source 1..26: mol_type = other DNA
gttcattgtggggaattctttgagtt

SEQ ID NO: 11205 - DNA, 22 bp, synthetic construct
  misc_feature 1..22: note = Synthetic Construct
  source 1..22: mol_type = other DNA
cagcactgctaacacctggatt

SEQ ID NO: 11206 - DNA, 24 bp, synthetic construct
  misc_feature 1..24: note = Synthetic Construct
  source 1..24: mol_type = other DNA
agtaatgtgggacatgggtaacag

SEQ ID NO: 11207 - DNA, 26 bp, synthetic construct
  misc_feature 1..26: note = Synthetic Construct
  source 1..26: mol_type = other DNA
ttgcatccaaatagttcgattggttt

SEQ ID NO: 11208 - DNA, 22 bp, synthetic construct
  misc_feature 1..22: note = Synthetic Construct
  source 1..22: mol_type = other DNA
gggggcatttctctctcctttt

SEQ ID NO: 11209 - DNA, 25 bp, synthetic construct
  misc_feature 1..25: note = Synthetic Construct
  source 1..25: mol_type = other DNA
gcttccatcaactcctagccaaaca

SEQ ID NO: 11210 - DNA, 24 bp, synthetic construct
  misc_feature 1..24: note = Synthetic Construct
  source 1..24: mol_type = other DNA
ggggcgacagaatgacagtctaaa

SEQ ID NO: 11211 - DNA, 20 bp, synthetic construct
  misc_feature 1..20: note = Synthetic Construct
  source 1..20: mol_type = other DNA
accctgcccagtctgtgctt

SEQ ID NO: 11212 - DNA, 25 bp, synthetic construct
  misc_feature 1..25: note = Synthetic Construct
  source 1..25: mol_type = other DNA
gatccagggtagctttgaaaatcag

SEQ ID NO: 11213 - DNA, 26 bp, synthetic construct
  misc_feature 1..26: note = Synthetic Construct
  source 1..26: mol_type = other DNA
aggactttcttcccccttttatccta

SEQ ID NO: 11214 - DNA, 24 bp, synthetic construct
  misc_feature 1..24: note = Synthetic Construct
  source 1..24: mol_type = other DNA
cagtctaggaatcctggcaagatc

SEQ ID NO: 11215 - DNA, 19 bp, synthetic construct
  misc_feature 1..19: note = Synthetic Construct
  source 1..19: mol_type = other DNA
tgcaagggcccatctcaag

SEQ ID NO: 11216 - DNA, 21 bp, synthetic construct
  misc_feature 1..21: note = Synthetic Construct
  source 1..21: mol_type = other DNA
aacgactcaccgactgcagaa

SEQ ID NO: 11217 - DNA, 30 bp, synthetic construct
  misc_feature 1..30: note = Synthetic Construct
  source 1..30: mol_type = other DNA
ctggaaatcaaagattttactgttgaatcc

SEQ ID NO: 11218 - DNA, 27 bp, synthetic construct
  misc_feature 1..27: note = Synthetic Construct
  source 1..27: mol_type = other DNA
caccttctgactatactcacacacaaa

SEQ ID NO: 11219 - DNA, 26 bp, synthetic construct
  misc_feature 1..26: note = Synthetic Construct
  source 1..26: mol_type = other DNA
gcagggtatagcttagcataatgaga

SEQ ID NO: 11220 - DNA, 26 bp, synthetic construct
  misc_feature 1..26: note = Synthetic Construct
  source 1..26: mol_type = other DNA
ccacaaacaaacctccagggtagtag

SEQ ID NO: 11221 - DNA, 28 bp, synthetic construct
  misc_feature 1..28: note = Synthetic Construct
  source 1..28: mol_type = other DNA
gagctctaaagtagaagaggaagcttag

SEQ ID NO: 11222 - DNA, 24 bp, synthetic construct
  misc_feature 1..24: note = Synthetic Construct
  source 1..24: mol_type = other DNA
tggtgcagagattgaggcatcttg

SEQ ID NO: 11223 - DNA, 20 bp, synthetic construct
  misc_feature 1..20: note = Synthetic Construct
  source 1..20: mol_type = other DNA
accttggaagaggcctgagt

SEQ ID NO: 11224 - DNA, 24 bp, synthetic construct
  misc_feature 1..24: note = Synthetic Construct
  source 1..24: mol_type = other DNA
ggtgctttgacaccaagagatcgt

SEQ ID NO: 11225 - DNA, 18 bp, synthetic construct
  misc_feature 1..18: note = Synthetic Construct
  source 1..18: mol_type = other DNA
ccgcagttggtgggaact

SEQ ID NO: 11226 - DNA, 27 bp, synthetic construct
  misc_feature 1..27: note = Synthetic Construct
  source 1..27: mol_type = other DNA
actaaacattccctaggtctctaaagc

SEQ ID NO: 11227 - DNA, 25 bp, synthetic construct
  misc_feature 1..25: note = Synthetic Construct
  source 1..25: mol_type = other DNA
gtgcggcctgaaagaaatatactct

SEQ ID NO: 11228 - DNA, 23 bp, synthetic construct
  misc_feature 1..23: note = Synthetic Construct
  source 1..23: mol_type = other DNA
gtctggactgtgtttgagaaggt

SEQ ID NO: 11229 - DNA, 26 bp, synthetic construct
  misc_feature 1..26: note = Synthetic Construct
  source 1..26: mol_type = other DNA
cacaaacacaaaccagaaatcctttg

SEQ ID NO: 11230 - DNA, 27 bp, synthetic construct
  misc_feature 1..27: note = Synthetic Construct
  source 1..27: mol_type = other DNA
ggaatcaagacaacttcaaagcgaaac

SEQ ID NO: 11231 - DNA, 25 bp, synthetic construct
  misc_feature 1..25: note = Synthetic Construct
  source 1..25: mol_type = other DNA
acagctatgaactcatgaccagttg

SEQ ID NO: 11232 - DNA, 29 bp, synthetic construct
  misc_feature 1..29: note = Synthetic Construct
  source 1..29: mol_type = other DNA
tcctggataagggttctaacattttgtag

SEQ ID NO: 11233 - DNA, 21 bp, synthetic construct
  misc_feature 1..21: note = Synthetic Construct
  source 1..21: mol_type = other DNA
ctgaacagggtgagggaggta

SEQ ID NO: 11234 - DNA, 27 bp, synthetic construct
  misc_feature 1..27: note = Synthetic Construct
  source 1..27: mol_type = other DNA
tctccatccaagcataaaatcctatca

SEQ ID NO: 11235 - DNA, 24 bp, synthetic construct
  misc_feature 1..24: note = Synthetic Construct
  source 1..24: mol_type = other DNA
acctcttccagcccacattttacg

SEQ ID NO: 11236 - DNA, 27 bp, synthetic construct
  misc_feature 1..27: note = Synthetic Construct
  source 1..27: mol_type = other DNA
tttacagtgtgttctatggagttttgg

SEQ ID NO: 11237 - DNA, 22 bp, synthetic construct
  misc_feature 1..22: note = Synthetic Construct
  source 1..22: mol_type = other DNA
aaggagcactaggcctccaaaa

SEQ ID NO: 11238 - DNA, 22 bp, synthetic construct
  misc_feature 1..22: note = Synthetic Construct
  source 1..22: mol_type = other DNA
ggagacacggcatcatttagca

SEQ ID NO: 11239 - DNA, 23 bp, synthetic construct
  misc_feature 1..23: note = Synthetic Construct
  source 1..23: mol_type = other DNA
agatgcccacagaactaaagctt

SEQ ID NO: 11240 - DNA, 25 bp, synthetic construct
  misc_feature 1..25: note = Synthetic Construct
  source 1..25: mol_type = other DNA
gagtgctatgtcctaagcatcatgt

SEQ ID NO: 11241 - DNA, 22 bp, synthetic construct
  misc_feature 1..22: note = Synthetic Construct
  source 1..22: mol_type = other DNA
ttgtcactgcaccaaggttctg

SEQ ID NO: 11242 - DNA, 20 bp, synthetic construct
  misc_feature 1..20: note = Synthetic Construct
  source 1..20: mol_type = other DNA
tgacgtgatggggagatggt

SEQ ID NO: 11243 - DNA, 21 bp, synthetic construct
  misc_feature 1..21: note = Synthetic Construct
  source 1..21: mol_type = other DNA
tgaccagcaatgctcccctat

SEQ ID NO: 11244 - DNA, 22 bp, synthetic construct
  misc_feature 1..22: note = Synthetic Construct
  source 1..22: mol_type = other DNA
gcacccaggtcaaaacccaaaa

SEQ ID NO: 11245 - DNA, 21 bp, synthetic construct
  misc_feature 1..21: note = Synthetic Construct
  source 1..21: mol_type = other DNA
cccagccactgatctccattt

SEQ ID NO: 11246 - DNA, 26 bp, synthetic construct
  misc_feature 1..26: note = Synthetic Construct
  source 1..26: mol_type = other DNA
gctcctaaatggcagtcattcaaacc

SEQ ID NO: 11247 - DNA, 23 bp, synthetic construct
  misc_feature 1..23: note = Synthetic Construct
  source 1..23: mol_type = other DNA
agggaggtggtaggaagtaagag

SEQ ID NO: 11248 - DNA, 20 bp, synthetic construct
  misc_feature 1..20: note = Synthetic Construct
  source 1..20: mol_type = other DNA
ccacaggcctagtgggttca

SEQ ID NO: 11249 - DNA, 25 bp, synthetic construct
  misc_feature 1..25: note = Synthetic Construct
  source 1..25: mol_type = other DNA
cccaggtatgtgactggacttcaaa

SEQ ID NO: 11250 - DNA, 18 bp, synthetic construct
  misc_feature 1..18: note = Synthetic Construct
  source 1..18: mol_type = other DNA
cagccagccccacactac

SEQ ID NO: 11251 - DNA, 23 bp, synthetic construct
  misc_feature 1..23: note = Synthetic Construct
  source 1..23: mol_type = other DNA
ggaggtattcccagaacacatgt

SEQ ID NO: 11252 - DNA, 24 bp, synthetic construct
  misc_feature 1..24: note = Synthetic Construct
  source 1..24: mol_type = other DNA
ctggaactttaacctgagcctaca

SEQ ID NO: 11253 - DNA, 24 bp, synthetic construct
  misc_feature 1..24: note = Synthetic Construct
  source 1..24: mol_type = other DNA
gagtctctggctgtgaagaaaaca

SEQ ID NO: 11254 - DNA, 26 bp, synthetic construct
  misc_feature 1..26: note = Synthetic Construct
  source 1..26: mol_type = other DNA
cctttctctactttacctgcaaaacc

SEQ ID NO: 11255 - DNA, 22 bp, synthetic construct
  misc_feature 1..22: note = Synthetic Construct
  source 1..22: mol_type = other DNA
cctgagtgtgagctgatttgca

SEQ ID NO: 11256 - DNA, 21 bp, synthetic construct
  misc_feature 1..21: note = Synthetic Construct
  source 1..21: mol_type = other DNA
agggcagggttagacatgaga

SEQ ID NO: 11257 - DNA, 24 bp, synthetic construct
  misc_feature 1..24: note = Synthetic Construct
  source 1..24: mol_type = other DNA
tttgaactccctctgctagattcc

SEQ ID NO: 11258 - DNA, 21 bp, synthetic construct
  misc_feature 1..21: note = Synthetic Construct
  source 1..21: mol_type = other DNA
catcccgtctttctcctgcat

SEQ ID NO: 11259 - DNA, 19 bp, synthetic construct
  misc_feature 1..19: note = Synthetic Construct
  source 1..19: mol_type = other DNA
ggcatggtggcatcttggt

SEQ ID NO: 11260 - DNA, 19 bp, synthetic construct
  misc_feature 1..19: note = Synthetic Construct
  source 1..19: mol_type = other DNA
agcgccaacctgacaagtg

SEQ ID NO: 11261 - DNA, 22 bp, synthetic construct
  misc_feature 1..22: note = Synthetic Construct
  source 1..22: mol_type = other DNA
agaagacacacgaacccacatc

SEQ ID NO: 11262 - DNA, 28 bp, synthetic construct
  misc_feature 1..28: note = Synthetic Construct
  source 1..28: mol_type = other DNA
gcaagacagttctgaaatcacagacttc

SEQ ID NO: 11263 - DNA, 21 bp, synthetic construct
  misc_feature 1..21: note = Synthetic Construct
  source 1..21: mol_type = other DNA
tgggtttgtcctggcctgata

SEQ ID NO: 11264 - DNA, 23 bp, synthetic construct
  misc_feature 1..23: note = Synthetic Construct
  source 1..23: mol_type = other DNA
acccaggtttcaacagaactgaa

SEQ ID NO: 11265 - DNA, 26 bp, synthetic construct
  misc_feature 1..26: note = Synthetic Construct
  source 1..26: mol_type = other DNA
gtgttttctgtaaaggactgcagagt

SEQ ID NO: 11266 - DNA, 26 bp, synthetic construct
  misc_feature 1..26: note = Synthetic Construct
  source 1..26: mol_type = other DNA
gcataaccaaagtgttgcagtaaaag

SEQ ID NO: 11267 - DNA, 29 bp, synthetic construct
  misc_feature 1..29: note = Synthetic Construct
  source 1..29: mol_type = other DNA
cctgtttcctaatttcaaggatgctgttg

SEQ ID NO: 11268 - DNA, 25 bp, synthetic construct
  misc_feature 1..25: note = Synthetic Construct
  source 1..25: mol_type = other DNA
cttccatctttcagcaccatttcac

SEQ ID NO: 11269 - DNA, 25 bp, synthetic construct
  misc_feature 1..25: note = Synthetic Construct
  source 1..25: mol_type = other DNA
caagtgtttctttacctccagcaaa

SEQ ID NO: 11270 - DNA, 22 bp, synthetic construct
  misc_feature 1..22: note = Synthetic Construct
  source 1..22: mol_type = other DNA
tggtggtgctggctgttatagt

SEQ ID NO: 11271 - DNA, 24 bp, synthetic construct
  misc_feature 1..24: note = Synthetic Construct
  source 1..24: mol_type = other DNA
gctggaatgcctctcaaagatgct

SEQ ID NO: 11272 - DNA, 24 bp, synthetic construct
  misc_feature 1..24: note = Synthetic Construct
  source 1..24: mol_type = other DNA
tcccttctctctccttccataagc

SEQ ID NO: 11273 - DNA, 21 bp, synthetic construct
  misc_feature 1..21: note = Synthetic Construct
  source 1..21: mol_type = other DNA
tgcagaggctgtaggatagca

SEQ ID NO: 11274 - DNA, 19 bp, synthetic construct
  misc_feature 1..19: note = Synthetic Construct
  source 1..19: mol_type = other DNA
ggcatggctgtcccttcct

SEQ ID NO: 11275 - DNA, 25 bp, synthetic construct
  misc_feature 1..25: note = Synthetic Construct
  source 1..25: mol_type = other DNA
ccggtacaattcgacttgactgaac

SEQ ID NO: 11276 - DNA, 21 bp, synthetic construct
  misc_feature 1..21: note = Synthetic Construct
  source 1..21: mol_type = other DNA
gaaaccaggacaagcgtcact

SEQ ID NO: 11277 - DNA, 23 bp, synthetic construct
  misc_feature 1..23: note = Synthetic Construct
  source 1..23: mol_type = other DNA
gtctgcagcaaatacagcttcag

SEQ ID NO: 11278 - DNA, 25 bp, synthetic construct
  misc_feature 1..25: note = Synthetic Construct
  source 1..25: mol_type = other DNA
ggcaaacaaactgaacactcattgg

SEQ ID NO: 11279 - DNA, 27 bp, synthetic construct
  misc_feature 1..27: note = Synthetic Construct
  source 1..27: mol_type = other DNA
cacgtaaaatgaaattggttccatgtg

SEQ ID NO: 11280 - DNA, 24 bp, synthetic construct
  misc_feature 1..24: note = Synthetic Construct
  source 1..24: mol_type = other DNA
gctcaaacagtttgatctcaacca

SEQ ID NO: 11281 - DNA, 24 bp, synthetic construct
  misc_feature 1..24: note = Synthetic Construct
  source 1..24: mol_type = other DNA
cagcctttttctgtcagagatgga

SEQ ID NO: 11282 - DNA, 30 bp, synthetic construct
  misc_feature 1..30: note = Synthetic Construct
  source 1..30: mol_type = other DNA
gcagcagatttcatcttaaatcatcagaag

SEQ ID NO: 11283 - DNA, 24 bp, synthetic construct
  misc_feature 1..24: note = Synthetic Construct
  source 1..24: mol_type = other DNA
cctagtgctttgttcacccttttc

SEQ ID NO: 11284 - DNA, 20 bp, synthetic construct
  misc_feature 1..20: note = Synthetic Construct
  source 1..20: mol_type = other DNA
ctggctgggttgtgatagca

SEQ ID NO: 11285 - DNA, 22 bp, synthetic construct
  misc_feature 1..22: note = Synthetic Construct
  source 1..22: mol_type = other DNA
aggaagccaggagtctcaacca

SEQ ID NO: 11286 - DNA, 28 bp, synthetic construct
  misc_feature 1..28: note = Synthetic Construct
  source 1..28: mol_type = other DNA
ggaaacttgaagcgaagagtttatctgt

SEQ ID NO: 11287 - DNA, 23 bp, synthetic construct
  misc_feature 1..23: note = Synthetic Construct
  source 1..23: mol_type = other DNA
cttcctgaagacaatggcagaga

SEQ ID NO: 11288 - DNA, 21 bp, synthetic construct
  misc_feature 1..21: note = Synthetic Construct
  source 1..21: mol_type = other DNA
tggtggggccattcctatagt

SEQ ID NO: 11289 - DNA, 22 bp, synthetic construct
  misc_feature 1..22: note = Synthetic Construct
  source 1..22: mol_type = other DNA
ctttctgcctgccctttttgtg

SEQ ID NO: 11290 - DNA, 26 bp, synthetic construct
  misc_feature 1..26: note = Synthetic Construct
  source 1..26: mol_type = other DNA
gcgctgagccaatttttgtagagatg

SEQ ID NO: 11291 - DNA, 22 bp, synthetic construct
  misc_feature 1..22: note = Synthetic Construct
  source 1..22: mol_type = other DNA
ggtttgcagtgggttcttgatg

SEQ ID NO: 11292 - DNA, 22 bp, synthetic construct
  misc_feature 1..22: note = Synthetic Construct
  source 1..22: mol_type = other DNA
ggagcattccctgtcacaaacc

SEQ ID NO: 11293 - DNA, 23 bp, synthetic construct
  misc_feature 1..23: note = Synthetic Construct
  source 1..23: mol_type = other DNA
ggctgtattctggtgtcctggta

SEQ ID NO: 11294 - DNA, 27 bp, synthetic construct
  misc_feature 1..27: note = Synthetic Construct
  source 1..27: mol_type = other DNA
ggagcactcccactaataaaagtgttc

SEQ ID NO: 11295 - DNA, 22 bp, synthetic construct
  misc_feature 1..22: note = Synthetic Construct
  source 1..22: mol_type = other DNA
cgcatcgtgaagcttgggttaa

SEQ ID NO: 11296 - DNA, 27 bp, synthetic construct
  misc_feature 1..27: note = Synthetic Construct
  source 1..27: mol_type = other DNA
gcaggaggttattaaaggcaaaaacct

SEQ ID NO: 11297 - DNA, 18 bp, synthetic construct
  misc_feature 1..18: note = Synthetic Construct
  source 1..18: mol_type = other DNA
ggccccaggatgcaggat

SEQ ID NO: 11298 - DNA, 25 bp, synthetic construct
  misc_feature 1..25: note = Synthetic Construct
  source 1..25: mol_type = other DNA
acagtatcaagagttggttggctaa

SEQ ID NO: 11299 - DNA, 26 bp, synthetic construct
  misc_feature 1..26: note = Synthetic Construct
  source 1..26: mol_type = other DNA
gaaattttgaaatgcagctggacaaa

SEQ ID NO: 11300 - DNA, 25 bp, synthetic construct
  misc_feature 1..25: note = Synthetic Construct
  source 1..25: mol_type = other DNA
ctcccaacaaagctgaaagaaaacc

SEQ ID NO: 11301 - DNA, 19 bp, synthetic construct
  misc_feature 1..19: note = Synthetic Construct
  source 1..19: mol_type = other DNA
agtcgcgtagggtgttgga

SEQ ID NO: 11302 - DNA, 29 bp, synthetic construct
  misc_feature 1..29: note = Synthetic Construct
  source 1..29: mol_type = other DNA
ctgttgaaaatgtgaagatgaatctctga

SEQ ID NO: 11303 - DNA, 27 bp, synthetic construct
  misc_feature 1..27: note = Synthetic Construct
  source 1..27: mol_type = other DNA
catgtggtagcttgggttaataatgtg

SEQ ID NO: 11304 - DNA, 25 bp, synthetic construct
  misc_feature 1..25: note = Synthetic Construct
  source 1..25: mol_type = other DNA
gctccagcagaccttcttcatttac

SEQ ID NO: 11305 - DNA, 26 bp, synthetic construct
  misc_feature 1..26: note = Synthetic Construct
  source 1..26: mol_type = other DNA
ggctttggatcaaaggatgagtttgg

SEQ ID NO: 11306 - DNA, 28 bp, synthetic construct
  misc_feature 1..28: note = Synthetic Construct
  source 1..28: mol_type = other DNA
caattattcctattcactccttggcatt

SEQ ID NO: 11307 - DNA, 26 bp, synthetic construct
  misc_feature 1..26: note = Synthetic Construct
  source 1..26: mol_type = other DNA
aaacaggattctcaggaacatgtttc

SEQ ID NO: 11308 - DNA, 22 bp, synthetic construct
  misc_feature 1..22: note = Synthetic Construct
  source 1..22: mol_type = other DNA
caaacagctgcctctgttacct

SEQ ID NO: 11309 - DNA, 24 bp, synthetic construct
  misc_feature 1..24: note = Synthetic Construct
  source 1..24: mol_type = other DNA
cctcagtgtcccaaaatggtgcta

SEQ ID NO: 11310 - DNA, 26 bp, synthetic construct
  misc_feature 1..26: note = Synthetic Construct
  source 1..26: mol_type = other DNA
actttcttcactagtttcagcagcta

SEQ ID NO: 11311 - DNA, 24 bp, synthetic construct
  misc_feature 1..24: note = Synthetic Construct
  source 1..24: mol_type = other DNA
gctgcttctgaaaagttgcatagc

SEQ ID NO: 11312 - DNA, 24 bp, synthetic construct
  misc_feature 1..24: note = Synthetic Construct
  source 1..24: mol_type = other DNA
ccctcttctgaagctgagatacca

SEQ ID NO: 11313 - DNA, 19 bp, synthetic construct
  misc_feature 1..19: note = Synthetic Construct
  source 1..19: mol_type = other DNA
tggggggtggactggatga

SEQ ID NO: 11314 - DNA, 23 bp, synthetic construct
  misc_feature 1..23: note = Synthetic Construct
  source 1..23: mol_type = other DNA
agggagagggggtcttttatctc

SEQ ID NO: 11315 - DNA, 26 bp, synthetic construct
  misc_feature 1..26: note = Synthetic Construct
  source 1..26: mol_type = other DNA
ggtcagctgtatccaaactgttcttc

SEQ ID NO: 11316 - DNA, 25 bp, synthetic construct
  misc_feature 1..25: note = Synthetic Construct
  source 1..25: mol_type = other DNA
gcagggctaccattatgttgtcaga

SEQ ID NO: 11317 - DNA, 20 bp, synthetic construct
  misc_feature 1..20: note = Synthetic Construct
  source 1..20: mol_type = other DNA
caccgcatcacagtggaaga

SEQ ID NO: 11318 - DNA, 22 bp, synthetic construct
  misc_feature 1..22: note = Synthetic Construct
  source 1..22: mol_type = other DNA
gactttggttgcaccggaaaag

SEQ ID NO: 11319 - DNA, 26 bp, synthetic construct
  misc_feature 1..26: note = Synthetic Construct
  source 1..26: mol_type = other DNA
ggaaaccattaaggtcacagaaatgg

SEQ ID NO: 11320 - DNA, 22 bp, synthetic construct
  misc_feature 1..22: note = Synthetic Construct
  source 1..22: mol_type = other DNA
gggaaaggtttgggtcatgaca

SEQ ID NO: 11321 - DNA, 22 bp, synthetic construct
  misc_feature 1..22: note = Synthetic Construct
  source 1..22: mol_type = other DNA
ctgctgtcattgttgtgccttt

SEQ ID NO: 11322 - DNA, 25 bp, synthetic construct
  misc_feature 1..25: note = Synthetic Construct
  source 1..25: mol_type = other DNA
gccaaggtgttacccaagagtcatt

SEQ ID NO: 11323 - DNA, 29 bp, synthetic construct
  misc_feature 1..29: note = Synthetic Construct
  source 1..29: mol_type = other DNA
gaaaagtcatttgtccagtagagtttctc

SEQ ID NO: 11324 - DNA, 26 bp, synthetic construct
  misc_feature 1..26: note = Synthetic Construct
  source 1..26: mol_type = other DNA
catgaccaataaggactccagtactg

SEQ ID NO: 11325 - DNA, 22 bp, synthetic construct
  misc_feature 1..22: note = Synthetic Construct
  source 1..22: mol_type = other DNA
gctcctaagctagcagtatgca

SEQ ID NO: 11326 - DNA, 22 bp, synthetic construct
  misc_feature 1..22: note = Synthetic Construct
  source 1..22: mol_type = other DNA
ggttaggtcttgttgccttcgt

SEQ ID NO: 11327 - DNA, 25 bp, synthetic construct
  misc_feature 1..25: note = Synthetic Construct
  source 1..25: mol_type = other DNA
cgctgcctgcaatgaattgttagag

SEQ ID NO: 11328 - DNA, 22 bp, synthetic construct
  misc_feature 1..22: note = Synthetic Construct
  source 1..22: mol_type = other DNA
ggtagctgcagatcttggtgaa

SEQ ID NO: 11329 - DNA, 23 bp, synthetic construct
  misc_feature 1..23: note = Synthetic Construct
  source 1..23: mol_type = other DNA
actgtttgacatgcactgaacag

SEQ ID NO: 11330 - DNA, 24 bp, synthetic construct
  misc_feature 1..24: note = Synthetic Construct
  source 1..24: mol_type = other DNA
tgtctgaccacagtggaatatcac

SEQ ID NO: 11331 - DNA, 25 bp, synthetic construct
  misc_feature 1..25: note = Synthetic Construct
  source 1..25: mol_type = other DNA
tgaaggtacaacaggagaagaagtc

SEQ ID NO: 11332 - DNA, 22 bp, synthetic construct
  misc_feature 1..22: note = Synthetic Construct
  source 1..22: mol_type = other DNA
actgagactcagacagcgaagt

SEQ ID NO: 11333 - DNA, 23 bp, synthetic construct
  misc_feature 1..23: note = Synthetic Construct
  source 1..23: mol_type = other DNA
ctgtgagggagacagtctaatcg

SEQ ID NO: 11334 - DNA, 26 bp, synthetic construct
  misc_feature 1..26: note = Synthetic Construct
  source 1..26: mol_type = other DNA
ctgagttagaaaagacagaccttcct

SEQ ID NO: 11335 - DNA, 26 bp, synthetic construct
  misc_feature 1..26: note = Synthetic Construct
  source 1..26: mol_type = other DNA
aaactggacactgaacttcagatttc

SEQ ID NO: 11336 - DNA, 23 bp, synthetic construct
  misc_feature 1..23: note = Synthetic Construct
  source 1..23: mol_type = other DNA
gcaaatgcaggccttagggaaag

SEQ ID NO: 11337 - DNA, 22 bp, synthetic construct
  misc_feature 1..22: note = Synthetic Construct
  source 1..22: mol_type = other DNA
tggtgctgttgctatccatgca

SEQ ID NO: 11338 - DNA, 30 bp, synthetic construct
  misc_feature 1..30: note = Synthetic Construct
  source 1..30: mol_type = other DNA
ccctgtatagatcatggattattcattcca

SEQ ID NO: 11339 - DNA, 21 bp, synthetic construct
  misc_feature 1..21: note = Synthetic Construct
  source 1..21: mol_type = other DNA
agcagttggtttggcatcctt

SEQ ID NO: 11340 - DNA, 23 bp, synthetic construct
  misc_feature 1..23: note = Synthetic Construct
  source 1..23: mol_type = other DNA
cacctttttggactgctggctta

SEQ ID NO: 11341 - DNA, 22 bp, synthetic construct
  misc_feature 1..22: note = Synthetic Construct
  source 1..22: mol_type = other DNA
gctagctcaagccctgcatttt

SEQ ID NO: 11342 - DNA, 28 bp, synthetic construct
  misc_feature 1..28: note = Synthetic Construct
  source 1..28: mol_type = other DNA
ggacagagattagagccactcatgtaat

SEQ ID NO: 11343 - DNA, 23 bp, synthetic construct
  misc_feature 1..23: note = Synthetic Construct
  source 1..23: mol_type = other DNA
tctctttggagtctggggaggta

SEQ ID NO: 11344 - DNA, 27 bp, synthetic construct
  misc_feature 1..27: note = Synthetic Construct
  source 1..27: mol_type = other DNA
ggcatctttttttcccagggataatct

SEQ ID NO: 11345 - DNA, 26 bp, synthetic construct
  misc_feature 1..26: note = Synthetic Construct
  source 1..26: mol_type = other DNA
ggcaacaaaattcttcacacctccat

SEQ ID NO: 11346 - DNA, 25 bp, synthetic construct
  misc_feature 1..25: note = Synthetic Construct
  source 1..25: mol_type = other DNA
cccattttggcctgacaaagtactg

SEQ ID NO: 11347 - DNA, 22 bp, synthetic construct
  misc_feature 1..22: note = Synthetic Construct
  source 1..22: mol_type = other DNA
acctttgaaagcaggggatcag

SEQ ID NO: 11348 - DNA, 25 bp, synthetic construct
  misc_feature 1..25: note = Synthetic Construct
  source 1..25: mol_type = other DNA
tctgaaaccggtcttttgttaacag

SEQ ID NO: 11349 - DNA, 24 bp, synthetic construct
  misc_feature 1..24: note = Synthetic Construct
  source 1..24: mol_type = other DNA
gttcagactacggtgaaagtgttg

SEQ ID NO: 11350 - DNA, 27 bp, synthetic construct
  misc_feature 1..27: note = Synthetic Construct
  source 1..27: mol_type = other DNA
ggattttccacacaagactgttttaga

SEQ ID NO: 11351 - DNA, 23 bp, synthetic construct
  misc_feature 1..23: note = Synthetic Construct
  source 1..23: mol_type = other DNA
ctccaggtatcagagaggcttca

SEQ ID NO: 11352 - DNA, 22 bp, synthetic construct
  misc_feature 1..22: note = Synthetic Construct
  source 1..22: mol_type = other DNA
accggctgttttgagagacagt

SEQ ID NO: 11353 - DNA, 27 bp, synthetic construct
  misc_feature 1..27: note = Synthetic Construct
  source 1..27: mol_type = other DNA
ccccctagtaccctgacaatgtattca

SEQ ID NO: 11354 - DNA, 19 bp, synthetic construct
  misc_feature 1..19: note = Synthetic Construct
  source 1..19: mol_type = other DNA
ggcagcaggtaggctttga

SEQ ID NO: 11355 - DNA, 25 bp, synthetic construct
  misc_feature 1..25: note = Synthetic Construct
  source 1..25: mol_type = other DNA
ggcttgctaagtcagttaagaaacg

SEQ ID NO: 11356 - DNA, 22 bp, synthetic construct
  misc_feature 1..22: note = Synthetic Construct
  source 1..22: mol_type = other DNA
tgtcaaagctggggctagatga

SEQ ID NO: 11357 - DNA, 22 bp, synthetic construct
  misc_feature 1..22: note = Synthetic Construct
  source 1..22: mol_type = other DNA
cgcctttgcctgagttttgctt

SEQ ID NO: 11358 - DNA, 23 bp, synthetic construct
  misc_feature 1..23: note = Synthetic Construct
  source 1..23: mol_type = other DNA
gctggccttgggtttctgttaaa

SEQ ID NO: 11359 - DNA, 20 bp, synthetic construct
  misc_feature 1..20: note = Synthetic Construct
  source 1..20: mol_type = other DNA
tcacgtcccgatggtttcct

SEQ ID NO: 11360 - DNA, 23 bp, synthetic construct
  misc_feature 1..23: note = Synthetic Construct
  source 1..23: mol_type = other DNA
gtgtttcactggcatgaatgtca

SEQ ID NO: 11361 - DNA, 23 bp, synthetic construct
  misc_feature 1..23: note = Synthetic Construct
  source 1..23: mol_type = other DNA
ttgtccctgtgagaccatcaaaa

SEQ ID NO: 11362 - DNA, 22 bp, synthetic construct
  misc_feature 1..22: note = Synthetic Construct
  source 1..22: mol_type = other DNA
aggagccatctgcctattgttg

SEQ ID NO: 11363 - DNA, 27 bp, synthetic construct
  misc_feature 1..27: note = Synthetic Construct
  source 1..27: mol_type = other DNA
ctttttggcaagaaatgacttccaatg

SEQ ID NO: 11364 - DNA, 24 bp, synthetic construct
  misc_feature 1..24: note = Synthetic Construct
  source 1..24: mol_type = other DNA
caccaaaactgcgagagtataggt

SEQ ID NO: 11365 - DNA, 20 bp, synthetic construct
  misc_feature 1..20: note = Synthetic Construct
  source 1..20: mol_type = other DNA
cgggtgagggaagactcctt

SEQ ID NO: 11366 - DNA, 20 bp, synthetic construct
  misc_feature 1..20: note = Synthetic Construct
  source 1..20: mol_type = other DNA
acgttgagcccgagttactg

SEQ ID NO: 11367 - DNA, 23 bp, synthetic construct
  misc_feature 1..23: note = Synthetic Construct
  source 1..23: mol_type = other DNA
gagcaacatgaggatgtctgttg

SEQ ID NO: 11368 - DNA, 24 bp, synthetic construct
  misc_feature 1..24: note = Synthetic Construct
  source 1..24: mol_type = other DNA
aggctgagagggagtagcatactt

SEQ ID NO: 11369 - DNA, 26 bp, synthetic construct
  misc_feature 1..26: note = Synthetic Construct
  source 1..26: mol_type = other DNA
gtgaaatcatggacaaaagcttgatg

SEQ ID NO: 11370 - DNA, 25 bp, synthetic construct
  misc_feature 1..25: note = Synthetic Construct
  source 1..25: mol_type = other DNA
tcctcctttgttcaggtaagtcaaa

SEQ ID NO: 11371 - DNA, 18 bp, synthetic construct
  misc_feature 1..18: note = Synthetic Construct
  source 1..18: mol_type = other DNA
caccaaggccaccacaca

SEQ ID NO: 11372 - DNA, 21 bp, synthetic construct
  misc_feature 1..21: note = Synthetic Construct
  source 1..21: mol_type = other DNA
tcagggctgcaagttcttcca

SEQ ID NO: 11373 - DNA, 21 bp, synthetic construct
  misc_feature 1..21: note = Synthetic Construct
  source 1..21: mol_type = other DNA
ctggagttcttgggccatcag

SEQ ID NO: 11374 - DNA, 18 bp, synthetic construct
  misc_feature 1..18: note = Synthetic Construct
  source 1..18: mol_type = other DNA
tgcagctgggaccaggaa

SEQ ID NO: 11375 - DNA, 24 bp, synthetic construct
  misc_feature 1..24: note = Synthetic Construct
  source 1..24: mol_type = other DNA
gcaatcccttgatcctggttagga

SEQ ID NO: 11376 - DNA, 22 bp, synthetic construct
  misc_feature 1..22: note = Synthetic Construct
  source 1..22: mol_type = other DNA
cttggttcagacccacaatgca

SEQ ID NO: 11377 - DNA, 21 bp, synthetic construct
  misc_feature 1..21: note = Synthetic Construct
  source 1..21: mol_type = other DNA
tttggctggcatcacccatca

SEQ ID NO: 11378 - DNA, 27 bp, synthetic construct
  misc_feature 1..27: note = Synthetic Construct
  source 1..27: mol_type = other DNA
gcacgatactgctaactgatctttttc

SEQ ID NO: 11379 - DNA, 18 bp, synthetic construct
  misc_feature 1..18: note = Synthetic Construct
  source 1..18: mol_type = other DNA
gaggcagtggcagtgtgt

SEQ ID NO: 11380 - DNA, 20 bp, synthetic construct
  misc_feature 1..20: note = Synthetic Construct
  source 1..20: mol_type = other DNA
gccctcggaccttagagaca

SEQ ID NO: 11381 - DNA, 25 bp, synthetic construct
  misc_feature 1..25: note = Synthetic Construct
  source 1..25: mol_type = other DNA
ccatttgagcccatttgttctcaga

SEQ ID NO: 11382 - DNA, 22 bp, synthetic construct
  misc_feature 1..22: note = Synthetic Construct
  source 1..22: mol_type = other DNA
tgtgcaaatcctggccttggat

SEQ ID NO: 11383 - DNA, 27 bp, synthetic construct
  misc_feature 1..27: note = Synthetic Construct
  source 1..27: mol_type = other DNA
ggacacagatgtagcaatggagtcttc

SEQ ID NO: 11384 - DNA, 22 bp, synthetic construct
  misc_feature 1..22: note = Synthetic Construct
  source 1..22: mol_type = other DNA
agtgacagcagagttggaatgg

SEQ ID NO: 11385 - DNA, 26 bp, synthetic construct
  misc_feature 1..26: note = Synthetic Construct
  source 1..26: mol_type = other DNA
tgtttgcattgatctctcctttcagt

SEQ ID NO: 11386 - DNA, 21 bp, synthetic construct
  misc_feature 1..21: note = Synthetic Construct
  source 1..21: mol_type = other DNA
gctgcaaccaggaaacaacct

SEQ ID NO: 11387 - DNA, 26 bp, synthetic construct
  misc_feature 1..26: note = Synthetic Construct
  source 1..26: mol_type = other DNA
gctaggtgtggtgtttcttgatagtt

SEQ ID NO: 11388 - DNA, 28 bp, synthetic construct
  misc_feature 1..28: note = Synthetic Construct
  source 1..28: mol_type = other DNA
gaaaaatttgaaagcacttttccactct

SEQ ID NO: 11389 - DNA, 26 bp, synthetic construct
  misc_feature 1..26: note = Synthetic Construct
  source 1..26: mol_type = other DNA
cctcagtagtcatcccctttgaggat

SEQ ID NO: 11390 - DNA, 25 bp, synthetic construct
  misc_feature 1..25: note = Synthetic Construct
  source 1..25: mol_type = other DNA
ccctcttccatattggtacccctaa

SEQ ID NO: 11391 - DNA, 22 bp, synthetic construct
  misc_feature 1..22: note = Synthetic Construct
  source 1..22: mol_type = other DNA
agttagggctggtgagaaaggt

SEQ ID NO: 11392 - DNA, 23 bp, synthetic construct
  misc_feature 1..23: note = Synthetic Construct
  source 1..23: mol_type = other DNA
cactggtcaaggatagtggttca

SEQ ID NO: 11393 - DNA, 20 bp, synthetic construct
  misc_feature 1..20: note = Synthetic Construct
  source 1..20: mol_type = other DNA
aggaaggaagccagcctttg

SEQ ID NO: 11394 - DNA, 27 bp, synthetic construct
  misc_feature 1..27: note = Synthetic Construct
  source 1..27: mol_type = other DNA
gacaatgaccatgtctgattcatcttg

SEQ ID NO: 11395 - DNA, 21 bp, synthetic construct
  misc_feature 1..21: note = Synthetic Construct
  source 1..21: mol_type = other DNA
caggaagtgaccccagtttgg

SEQ ID NO: 11396 - DNA, 25 bp, synthetic construct
  misc_feature 1..25: note = Synthetic Construct
  source 1..25: mol_type = other DNA
atgactactactgaagccagaactg

SEQ ID NO: 11397 - DNA, 23 bp, synthetic construct
  misc_feature 1..23: note = Synthetic Construct
  source 1..23: mol_type = other DNA
cacaagtggctgaatgtcaagag

SEQ ID NO: 11398 - DNA, 28 bp, synthetic construct
  misc_feature 1..28: note = Synthetic Construct
  source 1..28: mol_type = other DNA
agatttccatcctacaacacagatctac

SEQ ID NO: 11399 - DNA, 28 bp, synthetic construct
  misc_feature 1..28: note = Synthetic Construct
  source 1..28: mol_type = other DNA
ccttcatggcttttaatgagagaacatt

SEQ ID NO: 11400 - DNA, 22 bp, synthetic construct
  misc_feature 1..22: note = Synthetic Construct
  source 1..22: mol_type = other DNA
tcccttgatggctgtcatctga

SEQ ID NO: 11401 - DNA, 20 bp, synthetic construct
  misc_feature 1..20: note = Synthetic Construct
  source 1..20: mol_type = other DNA
atagccagccaccagtagca

SEQ ID NO: 11402 - DNA, 20 bp, synthetic construct
  misc_feature 1..20: note = Synthetic Construct
  source 1..20: mol_type = other DNA
agctgagctgcagggaacca

SEQ ID NO: 11403 - DNA, 21 bp, synthetic construct
  misc_feature 1..21: note = Synthetic Construct
  source 1..21: mol_type = other DNA
gcctcatttgggtcccagtgt

SEQ ID NO: 11404 - DNA, 24 bp, synthetic construct
  misc_feature 1..24: note = Synthetic Construct
  source 1..24: mol_type = other DNA
cacctgggatgacatagtgaaacc

SEQ ID NO: 11405 - DNA, 22 bp, synthetic construct
  misc_feature 1..22: note = Synthetic Construct
  source 1..22: mol_type = other DNA
aactacttgtccagggctttgg

SEQ ID NO: 11406 - DNA, 24 bp, synthetic construct
  misc_feature 1..24: note = Synthetic Construct
  source 1..24: mol_type = other DNA
cagcccagtacagacagctttatg

SEQ ID NO: 11407 - DNA, 24 bp, synthetic construct
  misc_feature 1..24: note = Synthetic Construct
  source 1..24: mol_type = other DNA
gggccttcatcttgcaccttagat

SEQ ID NO: 11408 - DNA, 24 bp, synthetic construct
  misc_feature 1..24: note = Synthetic Construct
  source 1..24: mol_type = other DNA
actggggaacatctgtcctttagg

SEQ ID NO: 11409 - DNA, 24 bp, synthetic construct
  misc_feature 1..24: note = Synthetic Construct
  source 1..24: mol_type = other DNA
gccttccactctcaacttcagatg

SEQ ID NO: 11410 - DNA, 20 bp, synthetic construct
  misc_feature 1..20: note = Synthetic Construct
  source 1..20: mol_type = other DNA
tcccctctggcccaggtaat

SEQ ID NO: 11411 - DNA, 22 bp, synthetic construct
  misc_feature 1..22: note = Synthetic Construct
  source 1..22: mol_type = other DNA
tcaagacacccctctcacttgt

SEQ ID NO: 11412 - DNA, 22 bp, synthetic construct
  misc_feature 1..22: note = Synthetic Construct
  source 1..22: mol_type = other DNA
ttcctagcttcctcccctttca

SEQ ID NO: 11413 - DNA, 24 bp, synthetic construct
  misc_feature 1..24: note = Synthetic Construct
  source 1..24: mol_type = other DNA
cctccctcaccatttctgttcttc

SEQ ID NO: 11414 - DNA, 21 bp, synthetic construct
  misc_feature 1..21: note = Synthetic Construct
  source 1..21: mol_type = other DNA
agacactggggagagggaaat

SEQ ID NO: 11415 - DNA, 23 bp, synthetic construct
  misc_feature 1..23: note = Synthetic Construct
  source 1..23: mol_type = other DNA
gcctgctttatgctagattgcaa

SEQ ID NO: 11416 - DNA, 21 bp, synthetic construct
  misc_feature 1..21: note = Synthetic Construct
  source 1..21: mol_type = other DNA
tgctgtgtgtgagagcaccta

SEQ ID NO: 11417 - DNA, 20 bp, synthetic construct
  misc_feature 1..20: note = Synthetic Construct
  source 1..20: mol_type = other DNA
acgtggaggccaaggacaga

SEQ ID NO: 11418 - DNA, 21 bp, synthetic construct
  misc_feature 1..21: note = Synthetic Construct
  source 1..21: mol_type = other DNA
tggcagaagcatggacaacct

SEQ ID NO: 11419 - DNA, 24 bp, synthetic construct
  misc_feature 1..24: note = Synthetic Construct
  source 1..24: mol_type = other DNA
tgagacaagggaaaagggaagaag

SEQ ID NO: 11420 - DNA, 24 bp, synthetic construct
  misc_feature 1..24: note = Synthetic Construct
  source 1..24: mol_type = other DNA
caaacaagcaaacaaatccacgtt

SEQ ID NO: 11421 - DNA, 22 bp, synthetic construct
  misc_feature 1..22: note = Synthetic Construct
  source 1..22: mol_type = other DNA
caaggcagcactgagttcaatg

SEQ ID NO: 11422 - DNA, 27 bp, synthetic construct
  misc_feature 1..27: note = Synthetic Construct
  source 1..27: mol_type = other DNA
ggttttcagtgtgaggttttacatacc

SEQ ID NO: 11423 - DNA, 20 bp, synthetic construct
  misc_feature 1..20: note = Synthetic Construct
  source 1..20: mol_type = other DNA
cagctcggctgttagcaact

SEQ ID NO: 11424 - DNA, 24 bp, synthetic construct
  misc_feature 1..24: note = Synthetic Construct
  source 1..24: mol_type = other DNA
gcgggatcaggtgtgaaggatttt

SEQ ID NO: 11425 - DNA, 24 bp, synthetic construct
  misc_feature 1..24: note = Synthetic Construct
  source 1..24: mol_type = other DNA
gtcggttcagctggatatctatgg

SEQ ID NO: 11426 - DNA, 20 bp, synthetic construct
  misc_feature 1..20: note = Synthetic Construct
  source 1..20: mol_type = other DNA
tctagggggagccactagga

SEQ ID NO: 11427 - DNA, 25 bp, synthetic construct
  misc_feature 1..25: note = Synthetic Construct
  source 1..25: mol_type = other DNA
cagcatctgaaagtgaacagtatcc

SEQ ID NO: 11428 - DNA, 26 bp, synthetic construct
  misc_feature 1..26: note = Synthetic Construct
  source 1..26: mol_type = other DNA
cctgcttcatacagggtaatgaagga

SEQ ID NO: 11429 - DNA, 28 bp, synthetic construct
  misc_feature 1..28: note = Synthetic Construct
  source 1..28: mol_type = other DNA
gtggtctgatttactacaagcatgattt

SEQ ID NO: 11430 - DNA, 26 bp, synthetic construct
  misc_feature 1..26: note = Synthetic Construct
  source 1..26: mol_type = other DNA
ggcaggcacctctattcatctatagg

SEQ ID NO: 11431 - DNA, 29 bp, synthetic construct
  misc_feature 1..29: note = Synthetic Construct
  source 1..29: mol_type = other DNA
gtgttgagaaaaatacaggctatcatggt

SEQ ID NO: 11432 - DNA, 24 bp, synthetic construct
  misc_feature 1..24: note = Synthetic Construct
  source 1..24: mol_type = other DNA
cgctgcagttgttatttctacagt

SEQ ID NO: 11433 - DNA, 23 bp, synthetic construct
  misc_feature 1..23: note = Synthetic Construct
  source 1..23: mol_type = other DNA
aaatgattgtcctggagctgcta

SEQ ID NO: 11434 - DNA, 24 bp, synthetic construct
  misc_feature 1..24: note = Synthetic Construct
  source 1..24: mol_type = other DNA
acagtcttccgtacactgatttca

SEQ ID NO: 11435 - DNA, 26 bp, synthetic construct
  misc_feature 1..26: note = Synthetic Construct
  source 1..26: mol_type = other DNA
ggaacattcactgctttgaaggttag

SEQ ID NO: 11436 - DNA, 23 bp, synthetic construct
  misc_feature 1..23: note = Synthetic Construct
  source 1..23: mol_type = other DNA
agcaaatcagtgacaccaactca

SEQ ID NO: 11437 - DNA, 24 bp, synthetic construct
  misc_feature 1..24: note = Synthetic Construct
  source 1..24: mol_type = other DNA
ccagctcagcactatgacttgctt

SEQ ID NO: 11438 - DNA, 26 bp, synthetic construct
  misc_feature 1..26: note = Synthetic Construct
  source 1..26: mol_type = other DNA
gtttctgtgagtgttttgtgggttta

SEQ ID NO: 11439 - DNA, 22 bp, synthetic construct
  misc_feature 1..22: note = Synthetic Construct
  source 1..22: mol_type = other DNA
agcgcctttgcctgagtttttg

SEQ ID NO: 11440 - DNA, 23 bp, synthetic construct
  misc_feature 1..23: note = Synthetic Construct
  source 1..23: mol_type = other DNA
gccagtcactctctgaaatgctt

SEQ ID NO: 11441 - DNA, 26 bp, synthetic construct
  misc_feature 1..26: note = Synthetic Construct
  source 1..26: mol_type = other DNA
gggtcaagacaaatatctgctttcac

SEQ ID NO: 11442 - DNA, 24 bp, synthetic construct
  misc_feature 1..24: note = Synthetic Construct
  source 1..24: mol_type = other DNA
tctgcaaggaccaggtaattttct

SEQ ID NO: 11443 - DNA, 22 bp, synthetic construct
  misc_feature 1..22: note = Synthetic Construct
  source 1..22: mol_type = other DNA
caagacccagagctgagatcag

SEQ ID NO: 11444 - DNA, 23 bp, synthetic construct
  misc_feature 1..23: note = Synthetic Construct
  source 1..23: mol_type = other DNA
tctcaacttggggaaactttgct

SEQ ID NO: 11445 - DNA, 21 bp, synthetic construct
  misc_feature 1..21: note = Synthetic Construct
  source 1..21: mol_type = other DNA
tgagcttggatggtgcccttt

SEQ ID NO: 11446 - DNA, 24 bp, synthetic construct
  misc_feature 1..24: note = Synthetic Construct
  source 1..24: mol_type = other DNA
agcaggtgagtaggagcaaagttg

SEQ ID NO: 11447 - DNA, 28 bp, synthetic construct
  misc_feature 1..28: note = Synthetic Construct
  source 1..28: mol_type = other DNA
gctagcagactaatacagttacccaaat

SEQ ID NO: 11448 - DNA, 19 bp, synthetic construct
  misc_feature 1..19: note = Synthetic Construct
  source 1..19: mol_type = other DNA
agctgggagtggggttagg

SEQ ID NO: 11449 - DNA, 22 bp, synthetic construct
  misc_feature 1..22: note = Synthetic Construct
  source 1..22: mol_type = other DNA
agggatctgtgtgctgtgttca

SEQ ID NO: 11450 - DNA, 23 bp, synthetic construct
  misc_feature 1..23: note = Synthetic Construct
  source 1..23: mol_type = other DNA
gggaacaaacttggtgctattgg

SEQ ID NO: 11451 - DNA, 27 bp, synthetic construct
  misc_feature 1..27: note = Synthetic Construct
  source 1..27: mol_type = other DNA
gggattcaatgtcatgaagagagtttt

SEQ ID NO: 11452 - DNA, 26 bp, synthetic construct
  misc_feature 1..26: note = Synthetic Construct
  source 1..26: mol_type = other DNA
gacaggcacccctttttatctatagg

SEQ ID NO: 11453 - DNA, 30 bp, synthetic construct
  misc_feature 1..30: note = Synthetic Construct
  source 1..30: mol_type = other DNA
accgactaattgaaacatgttataggagat

SEQ ID NO: 11454 - DNA, 21 bp, synthetic construct
  misc_feature 1..21: note = Synthetic Construct
  source 1..21: mol_type = other DNA
agggaaaggagtcagcgatga

SEQ ID NO: 11455 - DNA, 23 bp, synthetic construct
  misc_feature 1..23: note = Synthetic Construct
  source 1..23: mol_type = other DNA
gctcacagcttagacactctcaa

SEQ ID NO: 11456 - DNA, 21 bp, synthetic construct
  misc_feature 1..21: note = Synthetic Construct
  source 1..21: mol_type = other DNA
tgagcacgcatacaacttcct

SEQ ID NO: 11457 - DNA, 20 bp, synthetic construct
  misc_feature 1..20: note = Synthetic Construct
  source 1..20: mol_type = other DNA
gcagcctctgcctagtgtgt

SEQ ID NO: 11458 - DNA, 23 bp, synthetic construct
  misc_feature 1..23: note = Synthetic Construct
  source 1..23: mol_type = other DNA
gactaacaagcagccatctgaac

SEQ ID NO: 11459 - DNA, 25 bp, synthetic construct
  misc_feature 1..25: note = Synthetic Construct
  source 1..25: mol_type = other DNA
gtctcaagcacagagatatgcagat

SEQ ID NO: 11460 - DNA, 21 bp, synthetic construct
  misc_feature 1..21: note = Synthetic Construct
  source 1..21: mol_type = other DNA
aagaggtgcggccattaggaa

SEQ ID NO: 11461 - DNA, 28 bp, synthetic construct
  misc_feature 1..28: note = Synthetic Construct
  source 1..28: mol_type = other DNA
tctccttcactgtcagataaaatccaaa

SEQ ID NO: 11462 - DNA, 27 bp, synthetic construct
  misc_feature 1..27: note = Synthetic Construct
  source 1..27: mol_type = other DNA
atcgagaaaaatgatgagactgaaacc

SEQ ID NO: 11463 - DNA, 25 bp, synthetic construct
  misc_feature 1..25: note = Synthetic Construct
  source 1..25: mol_type = other DNA
ggttgggtttacttccttggacaga

SEQ ID NO: 11464 - DNA, 21 bp, synthetic construct
  misc_feature 1..21: note = Synthetic Construct
  source 1..21: mol_type = other DNA
accatcccctctctggttcat

SEQ ID NO: 11465 - DNA, 20 bp, synthetic construct
  misc_feature 1..20: note = Synthetic Construct
  source 1..20: mol_type = other DNA
gaatgcacagtggccaaagc

SEQ ID NO: 11466 - DNA, 24 bp, synthetic construct
  misc_feature 1..24: note = Synthetic Construct
  source 1..24: mol_type = other DNA
ggacggtaatctgtgtgagaacaa

SEQ ID NO: 11467 - DNA, 27 bp, synthetic construct
  misc_feature 1..27: note = Synthetic Construct
  source 1..27: mol_type = other DNA
gatcagaatgacaatagcccagttttc

SEQ ID NO: 11468 - DNA, 27 bp, synthetic construct
  misc_feature 1..27: note = Synthetic Construct
  source 1..27: mol_type = other DNA
gggagatttccagcactaaaattgaaa

SEQ ID NO: 11469 - DNA, 25 bp, synthetic construct
  misc_feature 1..25: note = Synthetic Construct
  source 1..25: mol_type = other DNA
gggactcaggaatggctgtaaaagt

SEQ ID NO: 11470 - DNA, 25 bp, synthetic construct
  misc_feature 1..25: note = Synthetic Construct
  source 1..25: mol_type = other DNA
cagtctcacttgatcctgctaagag

SEQ ID NO: 11471 - DNA, 18 bp, synthetic construct
  misc_feature 1..18: note = Synthetic Construct
  source 1..18: mol_type = other DNA
gccagcgtatgccagtgt

SEQ ID NO: 11472 - DNA, 22 bp, synthetic construct
  misc_feature 1..22: note = Synthetic Construct
  source 1..22: mol_type = other DNA
aagtcaggtagggctgccattt

SEQ ID NO: 11473 - DNA, 24 bp, synthetic construct
  misc_feature 1..24: note = Synthetic Construct
  source 1..24: mol_type = other DNA
ttttactaagggctgacactgtgt

SEQ ID NO: 11474 - DNA, 26 bp, synthetic construct
  misc_feature 1..26: note = Synthetic Construct
  source 1..26: mol_type = other DNA
ttagtcatctaggcatccttcaatcc

SEQ ID NO: 11475 - DNA, 23 bp, synthetic construct
  misc_feature 1..23: note = Synthetic Construct
  source 1..23: mol_type = other DNA
gcccataaaaactccaggactca

SEQ ID NO: 11476 - DNA, 27 bp, synthetic construct
  misc_feature 1..27: note = Synthetic Construct
  source 1..27: mol_type = other DNA
ggttactgaatggactatgtcctgtac

SEQ ID NO: 11477 - DNA, 23 bp, synthetic construct
  misc_feature 1..23: note = Synthetic Construct
  source 1..23: mol_type = other DNA
gagcctgaccacattttccatct

SEQ ID NO: 11478 - DNA, 22 bp, synthetic construct
  misc_feature 1..22: note = Synthetic Construct
  source 1..22: mol_type = other DNA
gggttgacaatgactgcatgct

SEQ ID NO: 11479 - DNA, 27 bp, synthetic construct
  misc_feature 1..27: note = Synthetic Construct
  source 1..27: mol_type = other DNA
gtcctgagatattcacttccctctaca

SEQ ID NO: 11480 - DNA, 24 bp, synthetic construct
  misc_feature 1..24: note = Synthetic Construct
  source 1..24: mol_type = other DNA
ccctgttggatttgacgatggaat

SEQ ID NO: 11481 - DNA, 26 bp, synthetic construct
  misc_feature 1..26: note = Synthetic Construct
  source 1..26: mol_type = other DNA
gttcagattgaatttgcctcatctca

SEQ ID NO: 11482 - DNA, 28 bp, synthetic construct
  misc_feature 1..28: note = Synthetic Construct
  source 1..28: mol_type = other DNA
ggaacttgggtaaattctaaacctagga

SEQ ID NO: 11483 - DNA, 22 bp, synthetic construct
  misc_feature 1..22: note = Synthetic Construct
  source 1..22: mol_type = other DNA
caggtggtgcactctccttatg

SEQ ID NO: 11484 - DNA, 21 bp, synthetic construct
  misc_feature 1..21: note = Synthetic Construct
  source 1..21: mol_type = other DNA
aatggagctcccagggaaagg

SEQ ID NO: 11485 - DNA, 29 bp, synthetic construct
  misc_feature 1..29: note = Synthetic Construct
  source 1..29: mol_type = other DNA
aggacttccttttgagaagtaaccatatt

SEQ ID NO: 11486 - DNA, 23 bp, synthetic construct
  misc_feature 1..23: note = Synthetic Construct
  source 1..23: mol_type = other DNA
actggatgtctctccaggagtca

SEQ ID NO: 11487 - DNA, 27 bp, synthetic construct
  misc_feature 1..27: note = Synthetic Construct
  source 1..27: mol_type = other DNA
tgggaaagtacaattgggtaactacac

SEQ ID NO: 11488 - DNA, 25 bp, synthetic construct
  misc_feature 1..25: note = Synthetic Construct
  source 1..25: mol_type = other DNA
gttttgctgtagtataaggcatgct

SEQ ID NO: 11489 - DNA, 24 bp, synthetic construct
  misc_feature 1..24: note = Synthetic Construct
  source 1..24: mol_type = other DNA
gtgtgcaactattaatcggttcgt

SEQ ID NO: 11490 - DNA, 29 bp, synthetic construct
  misc_feature 1..29: note = Synthetic Construct
  source 1..29: mol_type = other DNA
gacttcctgagtaccactatttggattat

SEQ ID NO: 11491 - DNA, 24 bp, synthetic construct
  misc_feature 1..24: note = Synthetic Construct
  source 1..24: mol_type = other DNA
gacaaacccactgaccttttcaag

SEQ ID NO: 11492 - DNA, 22 bp, synthetic construct
  misc_feature 1..22: note = Synthetic Construct
  source 1..22: mol_type = other DNA
ggtcacatgctctatggttcca

SEQ ID NO: 11493 - DNA, 22 bp, synthetic construct
  misc_feature 1..22: note = Synthetic Construct
  source 1..22: mol_type = other DNA
ccggctcttgctgtttctaagg

SEQ ID NO: 11494 - DNA, 28 bp, synthetic construct
  misc_feature 1..28: note = Synthetic Construct
  source 1..28: mol_type = other DNA
tctaggcactgtttagggatagtaaaag

SEQ ID NO: 11495 - DNA, 22 bp, synthetic construct
  misc_feature 1..22: note = Synthetic Construct
  source 1..22: mol_type = other DNA
tctggctcccgaatggatcaaa

SEQ ID NO: 11496 - DNA, 25 bp, synthetic construct
  misc_feature 1..25: note = Synthetic Construct
  source 1..25: mol_type = other DNA
cctctcccaatttcacagagtagtt

SEQ ID NO: 11497 - DNA, 22 bp, synthetic construct
  misc_feature 1..22: note = Synthetic Construct
  source 1..22: mol_type = other DNA
acaggataaggcacccatcatg

SEQ ID NO: 11498 - DNA, 24 bp, synthetic construct
  misc_feature 1..24: note = Synthetic Construct
  source 1..24: mol_type = other DNA
gcatgcttacccttgcaatttctg

SEQ ID NO: 11499 - DNA, 24 bp, synthetic construct
  misc_feature 1..24: note = Synthetic Construct
  source 1..24: mol_type = other DNA
ggttggacttgggaagaattcact

SEQ ID NO: 11500 - DNA, 22 bp, synthetic construct
  misc_feature 1..22: note = Synthetic Construct
  source 1..22: mol_type = other DNA
gaaggtggcttggctttcttca

SEQ ID NO: 11501 - DNA, 21 bp, synthetic construct
  misc_feature 1..21: note = Synthetic Construct
  source 1..21: mol_type = other DNA
tgcagcagagagcctggaatt

SEQ ID NO: 11502 - DNA, 21 bp, synthetic construct
  misc_feature 1..21: note = Synthetic Construct
  source 1..21: mol_type = other DNA
gccagcagcgttatgactcat

SEQ ID NO: 11503 - DNA, 28 bp, synthetic construct
  misc_feature 1..28: note = Synthetic Construct
  source 1..28: mol_type = other DNA
cattctgttttggtctgggttttatagt

SEQ ID NO: 11504 - DNA, 30 bp, synthetic construct
  misc_feature 1..30: note = Synthetic Construct
  source 1..30: mol_type = other DNA
ttaaagtcagccaattagcaacttttattg

SEQ ID NO: 11505 - DNA, 22 bp, synthetic construct
  misc_feature 1..22: note = Synthetic Construct
  source 1..22: mol_type = other DNA
ggttccatgtgggttcatcctt

SEQ ID NO: 11506 - DNA, 26 bp, synthetic construct
  misc_feature 1..26: note = Synthetic Construct
  source 1..26: mol_type = other DNA
ggggagtccatattatctgtcaactg

SEQ ID NO: 11507 - DNA, 26 bp, synthetic construct
  misc_feature 1..26: note = Synthetic Construct
  source 1..26: mol_type = other DNA
gaataaaactaggtggtcagcaagac

SEQ ID NO: 11508 - DNA, 27 bp, synthetic construct
  misc_feature 1..27: note = Synthetic Construct
  source 1..27: mol_type = other DNA
gcaagctattagcaaggcatattttgc

SEQ ID NO: 11509 - DNA, 21 bp, synthetic construct
  misc_feature 1..21: note = Synthetic Construct
  source 1..21: mol_type = other DNA
ggctgcacttcaaacaggttt

SEQ ID NO: 11510 - DNA, 25 bp, synthetic construct
  misc_feature 1..25: note = Synthetic Construct
  source 1..25: mol_type = other DNA
ttcagaaaacactccaggaatcagt

SEQ ID NO: 11511 - DNA, 24 bp, synthetic construct
  misc_feature 1..24: note = Synthetic Construct
  source 1..24: mol_type = other DNA
gcatggctactacttcccaaggaa

SEQ ID NO: 11512 - DNA, 20 bp, synthetic construct
  misc_feature 1..20: note = Synthetic Construct
  source 1..20: mol_type = other DNA
ccactgtggggtccaaggaa

SEQ ID NO: 11513 - DNA, 25 bp, synthetic construct
  misc_feature 1..25: note = Synthetic Construct
  source 1..25: mol_type = other DNA
cgtcaaccaaaagttacctctgaga

SEQ ID NO: 11514 - DNA, 26 bp, synthetic construct
  misc_feature 1..26: note = Synthetic Construct
  source 1..26: mol_type = other DNA
gtaacacctggaggactgataacaaa

SEQ ID NO: 11515 - DNA, 27 bp, synthetic construct
  misc_feature 1..27: note = Synthetic Construct
  source 1..27: mol_type = other DNA
ccaaatctggatttgcaggttttagct

SEQ ID NO: 11516 - DNA, 22 bp, synthetic construct
  misc_feature 1..22: note = Synthetic Construct
  source 1..22: mol_type = other DNA
tgctgaagtggctgctgttttc

SEQ ID NO: 11517 - DNA, 22 bp, synthetic construct
  misc_feature 1..22: note = Synthetic Construct
  source 1..22: mol_type = other DNA
gtgtcatggccataagcaggaa

SEQ ID NO: 11518 - DNA, 26 bp, synthetic construct
  misc_feature 1..26: note = Synthetic Construct
  source 1..26: mol_type = other DNA
tctctattggattgtgatgtgcaatg

SEQ ID NO: 11519 - DNA, 21 bp, synthetic construct
  misc_feature 1..21: note = Synthetic Construct
  source 1..21: mol_type = other DNA
agaagagtcctggctcacaga

SEQ ID NO: 11520 - DNA, 24 bp, synthetic construct
  misc_feature 1..24: note = Synthetic Construct
  source 1..24: mol_type = other DNA
tcatgctgagaaggtgagaattga

SEQ ID NO: 11521 - DNA, 20 bp, synthetic construct
  misc_feature 1..20: note = Synthetic Construct
  source 1..20: mol_type = other DNA
agctagctcggcctttcaca

SEQ ID NO: 11522 - DNA, 29 bp, synthetic construct
  misc_feature 1..29: note = Synthetic Construct
  source 1..29: mol_type = other DNA
gcctattttacaaggccttgataaaaatc

SEQ ID NO: 11523 - DNA, 29 bp, synthetic construct
  misc_feature 1..29: note = Synthetic Construct
  source 1..29: mol_type = other DNA
agttgggttaaaccatctaaaacatcaaa

SEQ ID NO: 11524 - DNA, 24 bp, synthetic construct
  misc_feature 1..24: note = Synthetic Construct
  source 1..24: mol_type = other DNA
ttgtaacatgccattgcttttgga

SEQ ID NO: 11525 - DNA, 24 bp, synthetic construct
  misc_feature 1..24: note = Synthetic Construct
  source 1..24: mol_type = other DNA
gctcttgtattccggacatactct

SEQ ID NO: 11526 - DNA, 26 bp, synthetic construct
  misc_feature 1..26: note = Synthetic Construct
  source 1..26: mol_type = other DNA
tgtaatgtagattacagtcgctgtgt

SEQ ID NO: 11527 - DNA, 27 bp, synthetic construct
  misc_feature 1..27: note = Synthetic Construct
  source 1..27: mol_type = other DNA
aacattaaattcttgccacaccctaaa

SEQ ID NO: 11528 - DNA, 24 bp, synthetic construct
  misc_feature 1..24: note = Synthetic Construct
  source 1..24: mol_type = other DNA
acacacaagcaggttaggtatctg

SEQ ID NO: 11529 - DNA, 27 bp, synthetic construct
  misc_feature 1..27: note = Synthetic Construct
  source 1..27: mol_type = other DNA
cctatggttatctgagtctgtgttcag

SEQ ID NO: 11530 - DNA, 21 bp, synthetic construct
  misc_feature 1..21: note = Synthetic Construct
  source 1..21: mol_type = other DNA
atgagtcccagccacttccaa

SEQ ID NO: 11531 - DNA, 25 bp, synthetic construct
  misc_feature 1..25: note = Synthetic Construct
  source 1..25: mol_type = other DNA
gaactctatcaccaagcagatagca

SEQ ID NO: 11532 - DNA, 22 bp, synthetic construct
  misc_feature 1..22: note = Synthetic Construct
  source 1..22: mol_type = other DNA
aggatggagctcccagagacaa

SEQ ID NO: 11533 - DNA, 28 bp, synthetic construct
  misc_feature 1..28: note = Synthetic Construct
  source 1..28: mol_type = other DNA
gcaactttttgtcttccaactacctgaa

SEQ ID NO: 11534 - DNA, 22 bp, synthetic construct
  misc_feature 1..22: note = Synthetic Construct
  source 1..22: mol_type = other DNA
accctagtccactgtcctatgc

SEQ ID NO: 11535 - DNA, 25 bp, synthetic construct
  misc_feature 1..25: note = Synthetic Construct
  source 1..25: mol_type = other DNA
aagcacccgaaaaagacatttagtc

SEQ ID NO: 11536 - DNA, 22 bp, synthetic construct
  misc_feature 1..22: note = Synthetic Construct
  source 1..22: mol_type = other DNA
tcagaagctggagaaagcaaca

SEQ ID NO: 11537 - DNA, 25 bp, synthetic construct
  misc_feature 1..25: note = Synthetic Construct
  source 1..25: mol_type = other DNA
tggccatagtttcagagaaaacact

SEQ ID NO: 11538 - DNA, 29 bp, synthetic construct
  misc_feature 1..29: note = Synthetic Construct
  source 1..29: mol_type = other DNA
aggattatacaccatcaaaaatgtggttt

SEQ ID NO: 11539 - DNA, 29 bp, synthetic construct
  misc_feature 1..29: note = Synthetic Construct
  source 1..29: mol_type = other DNA
tgaaaagcctatactaaagcatcagtttt

SEQ ID NO: 11540 - DNA, 30 bp, synthetic construct
  misc_feature 1..30: note = Synthetic Construct
  source 1..30: mol_type = other DNA
gaaggcaaaactgatctctagaaattaagg

SEQ ID NO: 11541 - DNA, 24 bp, synthetic construct
  misc_feature 1..24: note = Synthetic Construct
  source 1..24: mol_type = other DNA
gaggttagctctggggaataaggt

SEQ ID NO: 11542 - DNA, 29 bp, synthetic construct
  misc_feature 1..29: note = Synthetic Construct
  source 1..29: mol_type = other DNA
gggcagtaaccatacaatttatcattgtc

SEQ ID NO: 11543 - DNA, 22 bp, synthetic construct
  misc_feature 1..22: note = Synthetic Construct
  source 1..22: mol_type = other DNA
gaagacagaagcccctggtaaa

SEQ ID NO: 11544 - DNA, 25 bp, synthetic construct
  misc_feature 1..25: note = Synthetic Construct
  source 1..25: mol_type = other DNA
ggacttaccagttctaccagagaag

SEQ ID NO: 11545 - DNA, 22 bp, synthetic construct
  misc_feature 1..22: note = Synthetic Construct
  source 1..22: mol_type = other DNA
tgtctgtgcaggcatgaattca

SEQ ID NO: 11546 - DNA, 25 bp, synthetic construct
  misc_feature 1..25: note = Synthetic Construct
  source 1..25: mol_type = other DNA
gagccaggacaagacttcttttcag

SEQ ID NO: 11547 - DNA, 25 bp, synthetic construct
  misc_feature 1..25: note = Synthetic Construct
  source 1..25: mol_type = other DNA
ggttgtgtgggtaaatgaggttttg

SEQ ID NO: 11548 - DNA, 24 bp, synthetic construct
  misc_feature 1..24: note = Synthetic Construct
  source 1..24: mol_type = other DNA
tgagctacagcaaagcaaagtagt

SEQ ID NO: 11549 - DNA, 28 bp, synthetic construct
  misc_feature 1..28: note = Synthetic Construct
  source 1..28: mol_type = other DNA
ctattattaggaagaagtgctggtctgt

SEQ ID NO: 11550 - DNA, 27 bp, synthetic construct
  misc_feature 1..27: note = Synthetic Construct
  source 1..27: mol_type = other DNA
gctactttccaggttacaagagaagac

SEQ ID NO: 11551 - DNA, 27 bp, synthetic construct
  misc_feature 1..27: note = Synthetic Construct
  source 1..27: mol_type = other DNA
gtttaattttgacagggggaaactttg

SEQ ID NO: 11552 - DNA, 22 bp, synthetic construct
  misc_feature 1..22: note = Synthetic Construct
  source 1..22: mol_type = other DNA
ccgtgcaacaaagctgattaca

SEQ ID NO: 11553 - DNA, 25 bp, synthetic construct
  misc_feature 1..25: note = Synthetic Construct
  source 1..25: mol_type = other DNA
tgtcagattctggcattcaaaatcc

SEQ ID NO: 11554 - DNA, 22 bp, synthetic construct
  misc_feature 1..22: note = Synthetic Construct
  source 1..22: mol_type = other DNA
agtggtcacattgggctacaaa

SEQ ID NO: 11555 - DNA, 27 bp, synthetic construct
  misc_feature 1..27: note = Synthetic Construct
  source 1..27: mol_type = other DNA
gctcttatgtttagtgccttaaacctt

SEQ ID NO: 11556 - DNA, 22 bp, synthetic construct
  misc_feature 1..22: note = Synthetic Construct
  source 1..22: mol_type = other DNA
tcaaaagcctgtgggattccat

SEQ ID NO: 11557 - DNA, 23 bp, synthetic construct
  misc_feature 1..23: note = Synthetic Construct
  source 1..23: mol_type = other DNA
gctgcacaaacttccagtttctg

SEQ ID NO: 11558 - DNA, 22 bp, synthetic construct
  misc_feature 1..22: note = Synthetic Construct
  source 1..22: mol_type = other DNA
tgaaagcagcccaggaagtcaa

SEQ ID NO: 11559 - DNA, 27 bp, synthetic construct
  misc_feature 1..27: note = Synthetic Construct
  source 1..27: mol_type = other DNA
gaacattcctcctagacaagttttgag

SEQ ID NO: 11560 - DNA, 22 bp, synthetic construct
  misc_feature 1..22: note = Synthetic Construct
  source 1..22: mol_type = other DNA
agcttctaggggtcatgaagca

SEQ ID NO: 11561 - DNA, 25 bp, synthetic construct
  misc_feature 1..25: note = Synthetic Construct
  source 1..25: mol_type = other DNA
cagctatgctgtgtcacaaaaaacc

SEQ ID NO: 11562 - DNA, 24 bp, synthetic construct
  misc_feature 1..24: note = Synthetic Construct
  source 1..24: mol_type = other DNA
gctagggagtctccatttcaaacc

SEQ ID NO: 11563 - DNA, 23 bp, synthetic construct
  misc_feature 1..23: note = Synthetic Construct
  source 1..23: mol_type = other DNA
ctggccacctcaatgaaaatgag

SEQ ID NO: 11564 - DNA, 29 bp, synthetic construct
  misc_feature 1..29: note = Synthetic Construct
  source 1..29: mol_type = other DNA
agaggtttttcttattttgaggaccattt

SEQ ID NO: 11565 - DNA, 25 bp, synthetic construct
  misc_feature 1..25: note = Synthetic Construct
  source 1..25: mol_type = other DNA
ccctcttctttaccagttgtcaagt

SEQ ID NO: 11566 - DNA, 24 bp, synthetic construct
  misc_feature 1..24: note = Synthetic Construct
  source 1..24: mol_type = other DNA
caagaggtcctgaggaaatgctat

SEQ ID NO: 11567 - DNA, 26 bp, synthetic construct
  misc_feature 1..26: note = Synthetic Construct
  source 1..26: mol_type = other DNA
cccccttccctttatcttcacacttg

SEQ ID NO: 11568 - DNA, 29 bp, synthetic construct
  misc_feature 1..29: note = Synthetic Construct
  source 1..29: mol_type = other DNA
ccttttaacaccaccttgtatcccaaatt

SEQ ID NO: 11569 - DNA, 26 bp, synthetic construct
  misc_feature 1..26: note = Synthetic Construct
  source 1..26: mol_type = other DNA
tgagagaaacacgtctatggaattcg

SEQ ID NO: 11570 - DNA, 19 bp, synthetic construct
  misc_feature 1..19: note = Synthetic Construct
  source 1..19: mol_type = other DNA
tctcccagcggctgttgat

SEQ ID NO: 11571 - DNA, 25 bp, synthetic construct
  misc_feature 1..25: note = Synthetic Construct
  source 1..25: mol_type = other DNA
attcttgggaatcatggggatcatg

SEQ ID NO: 11572 - DNA, 25 bp, synthetic construct
  misc_feature 1..25: note = Synthetic Construct
  source 1..25: mol_type = other DNA
caagctctactcgctctaaattgga

SEQ ID NO: 11573 - DNA, 21 bp, synthetic construct
  misc_feature 1..21: note = Synthetic Construct
  source 1..21: mol_type = other DNA
acctcccaaccagagccttga

SEQ ID NO: 11574 - DNA, 27 bp, synthetic construct
  misc_feature 1..27: note = Synthetic Construct
  source 1..27: mol_type = other DNA
cagtgtttaggcattgaagagttaggt

SEQ ID NO: 11575 - DNA, 24 bp, synthetic construct
  misc_feature 1..24: note = Synthetic Construct
  source 1..24: mol_type = other DNA
ctttctgtgggtctcatctttgca

SEQ ID NO: 11576 - DNA, 29 bp, synthetic construct
  misc_feature 1..29: note = Synthetic Construct
  source 1..29: mol_type = other DNA
cttttttatccctcaaagataaccaaggt

SEQ ID NO: 11577 - DNA, 20 bp, synthetic construct
  misc_feature 1..20: note = Synthetic Construct
  source 1..20: mol_type = other DNA
accatcaccctggccttcct

SEQ ID NO: 11578 - DNA, 28 bp, synthetic construct
  misc_feature 1..28: note = Synthetic Construct
  source 1..28: mol_type = other DNA
gtgtttgggtcataagaggattcttcat

SEQ ID NO: 11579 - DNA, 26 bp, synthetic construct
  misc_feature 1..26: note = Synthetic Construct
  source 1..26: mol_type = other DNA
cagatcagggatgaactgtgatgttg

SEQ ID NO: 11580 - DNA, 27 bp, synthetic construct
  misc_feature 1..27: note = Synthetic Construct
  source 1..27: mol_type = other DNA
tgtgttttcctactccatcactgttac

SEQ ID NO: 11581 - DNA, 21 bp, synthetic construct
  misc_feature 1..21: note = Synthetic Construct
  source 1..21: mol_type = other DNA
gacaaggcagcactgagttca

SEQ ID NO: 11582 - DNA, 28 bp, synthetic construct
  misc_feature 1..28: note = Synthetic Construct
  source 1..28: mol_type = other DNA
gctttgtaccttcagatgattacttgct

SEQ ID NO: 11583 - DNA, 30 bp, synthetic construct
  misc_feature 1..30: note = Synthetic Construct
  source 1..30: mol_type = other DNA
gctcctttttaaattgactttgatggatct

SEQ ID NO: 11584 - DNA, 23 bp, synthetic construct
  misc_feature 1..23: note = Synthetic Construct
  source 1..23: mol_type = other DNA
gtaggtcagtgggtctctgaaac

SEQ ID NO: 11585 - DNA, 29 bp, synthetic construct
  misc_feature 1..29: note = Synthetic Construct
  source 1..29: mol_type = other DNA
agaaaataccactactgactgaaaattgg

SEQ ID NO: 11586 - DNA, 24 bp, synthetic construct
  misc_feature 1..24: note = Synthetic Construct
  source 1..24: mol_type = other DNA
gcactgtttctggttttagcttct

SEQ ID NO: 11587 - DNA, 25 bp, synthetic construct
  misc_feature 1..25: note = Synthetic Construct
  source 1..25: mol_type = other DNA
agctacacctgtattaaccccctta

SEQ ID NO: 11588 - DNA, 29 bp, synthetic construct
  misc_feature 1..29: note = Synthetic Construct
  source 1..29: mol_type = other DNA
tggtccctgatgacttatttagttcattt

SEQ ID NO: 11589 - DNA, 24 bp, synthetic construct
  misc_feature 1..24: note = Synthetic Construct
  source 1..24: mol_type = other DNA
ggagtttagccctcacttcaatga

SEQ ID NO: 11590 - DNA, 24 bp, synthetic construct
  misc_feature 1..24: note = Synthetic Construct
  source 1..24: mol_type = other DNA
tgctccaccttcctcagaaatgtg

SEQ ID NO: 11591 - DNA, 27 bp, synthetic construct
  misc_feature 1..27: note = Synthetic Construct
  source 1..27: mol_type = other DNA
gtgagcaggaatgttacagctatttca

SEQ ID NO: 11592 - DNA, 23 bp, synthetic construct
  misc_feature 1..23: note = Synthetic Construct
  source 1..23: mol_type = other DNA
ttggggtagacagtctggaagtc

SEQ ID NO: 11593 - DNA, 25 bp, synthetic construct
  misc_feature 1..25: note = Synthetic Construct
  source 1..25: mol_type = other DNA
ccattgtcctctttttctcaaagct

SEQ ID NO: 11594 - DNA, 21 bp, synthetic construct
  misc_feature 1..21: note = Synthetic Construct
  source 1..21: mol_type = other DNA
aaccccaaggctcttgtgagt

SEQ ID NO: 11595 - DNA, 23 bp, synthetic construct
  misc_feature 1..23: note = Synthetic Construct
  source 1..23: mol_type = other DNA
tgtgtcttagtgtccaactgctt

SEQ ID NO: 11596 - DNA, 20 bp, synthetic construct
  misc_feature 1..20: note = Synthetic Construct
  source 1..20: mol_type = other DNA
atgttgcctgcttgcttggt

SEQ ID NO: 11597 - DNA, 29 bp, synthetic construct
  misc_feature 1..29: note = Synthetic Construct
  source 1..29: mol_type = other DNA
gtcagagactttctatttcccatttatgc

SEQ ID NO: 11598 - DNA, 20 bp, synthetic construct
  misc_feature 1..20: note = Synthetic Construct
  source 1..20: mol_type = other DNA
tcagaagaggggcgattcca

SEQ ID NO: 11599 - DNA, 24 bp, synthetic construct
  misc_feature 1..24: note = Synthetic Construct
  source 1..24: mol_type = other DNA
ggtcttgcaacagttgtgacattc

SEQ ID NO: 11600 - DNA, 21 bp, synthetic construct
  misc_feature 1..21: note = Synthetic Construct
  source 1..21: mol_type = other DNA
aggtgtgtggcttgacttctg

SEQ ID NO: 11601 - DNA, 21 bp, synthetic construct
  misc_feature 1..21: note = Synthetic Construct
  source 1..21: mol_type = other DNA
tcgcaccatcttctcctctgt

SEQ ID NO: 11602 - DNA, 27 bp, synthetic construct
  misc_feature 1..27: note = Synthetic Construct
  source 1..27: mol_type = other DNA
gggaaaacttgccaaggttaaatgact

SEQ ID NO: 11603 - DNA, 24 bp, synthetic construct
  misc_feature 1..24: note = Synthetic Construct
  source 1..24: mol_type = other DNA
tctttttcctgcctctatggttgt

SEQ ID NO: 11604 - DNA, 27 bp, synthetic construct
  misc_feature 1..27: note = Synthetic Construct
  source 1..27: mol_type = other DNA
ggagtaataagtgagggagggtaagtt

SEQ ID NO: 11605 - DNA, 28 bp, synthetic construct
  misc_feature 1..28: note = Synthetic Construct
  source 1..28: mol_type = other DNA
ccctcatcccaaaatttctttgttacca

SEQ ID NO: 11606 - DNA, 26 bp, synthetic construct
  misc_feature 1..26: note = Synthetic Construct
  source 1..26: mol_type = other DNA
ttattccactcctgattcctatgcaa

SEQ ID NO: 11607 - DNA, 22 bp, synthetic construct
  misc_feature 1..22: note = Synthetic Construct
  source 1..22: mol_type = other DNA
tcctgtctgtcagtcccattct

SEQ ID NO: 11608 - DNA, 22 bp, synthetic construct
  misc_feature 1..22: note = Synthetic Construct
  source 1..22: mol_type = other DNA
ggaggaagtgttgggcaatact

SEQ ID NO: 11609 - DNA, 21 bp, synthetic construct
  misc_feature 1..21: note = Synthetic Construct
  source 1..21: mol_type = other DNA
ccacaaaccttgccactgtga

SEQ ID NO: 11610 - DNA, 29 bp, synthetic construct
  misc_feature 1..29: note = Synthetic Construct
  source 1..29: mol_type = other DNA
cacctacagattaactgaaagctttttga

SEQ ID NO: 11611 - DNA, 27 bp, synthetic construct
  misc_feature 1..27: note = Synthetic Construct
  source 1..27: mol_type = other DNA
aataaaaaatccggatggagacaagtg

SEQ ID NO: 11612 - DNA, 24 bp, synthetic construct
  misc_feature 1..24: note = Synthetic Construct
  source 1..24: mol_type = other DNA
gctcccttacctactcagagatga

SEQ ID NO: 11613 - DNA, 24 bp, synthetic construct
  misc_feature 1..24: note = Synthetic Construct
  source 1..24: mol_type = other DNA
cataaatcctgtcgccgaagtact

SEQ ID NO: 11614 - DNA, 25 bp, synthetic construct
  misc_feature 1..25: note = Synthetic Construct
  source 1..25: mol_type = other DNA
agagctttaagtgcacaatggaaag

SEQ ID NO: 11615 - DNA, 27 bp, synthetic construct
  misc_feature 1..27: note = Synthetic Construct
  source 1..27: mol_type = other DNA
gagcattttacaattcacaaagcacat

SEQ ID NO: 11616 - DNA, 24 bp, synthetic construct
  misc_feature 1..24: note = Synthetic Construct
  source 1..24: mol_type = other DNA
tgattgtgtggcattgctaagagt

SEQ ID NO: 11617 - DNA, 20 bp, synthetic construct
  misc_feature 1..20: note = Synthetic Construct
  source 1..20: mol_type = other DNA
atccctgctctgcgtgcttt

SEQ ID NO: 11618 - DNA, 25 bp, synthetic construct
  misc_feature 1..25: note = Synthetic Construct
  source 1..25: mol_type = other DNA
tgtctgtgacagagttgttctttct

SEQ ID NO: 11619 - DNA, 28 bp, synthetic construct
  misc_feature 1..28: note = Synthetic Construct
  source 1..28: mol_type = other DNA
cgactttttcctgaaaatacacctatgg

SEQ ID NO: 11620 - DNA, 21 bp, synthetic construct
  misc_feature 1..21: note = Synthetic Construct
  source 1..21: mol_type = other DNA
tgctcagggtcaacactcaga

SEQ ID NO: 11621 - DNA, 30 bp, synthetic construct
  misc_feature 1..30: note = Synthetic Construct
  source 1..30: mol_type = other DNA
ctgcttcttaagtgatagataaccctcttc

SEQ ID NO: 11622 - DNA, 28 bp, synthetic construct
  misc_feature 1..28: note = Synthetic Construct
  source 1..28: mol_type = other DNA
ccagtgaggttttctactgtagtgttga

SEQ ID NO: 11623 - DNA, 26 bp, synthetic construct
  misc_feature 1..26: note = Synthetic Construct
  source 1..26: mol_type = other DNA
gtaatatgggtggtctttctctcaca

SEQ ID NO: 11624 - DNA, 30 bp, synthetic construct
  misc_feature 1..30: note = Synthetic Construct
  source 1..30: mol_type = other DNA
cacaccaaggttaaattaagaaacccaata

SEQ ID NO: 11625 - DNA, 20 bp, synthetic construct
  misc_feature 1..20: note = Synthetic Construct
  source 1..20: mol_type = other DNA
tgggtgtggcctttaaagca

SEQ ID NO: 11626 - DNA, 24 bp, synthetic construct
  misc_feature 1..24: note = Synthetic Construct
  source 1..24: mol_type = other DNA
ggacctgtagatagaccctaacca

SEQ ID NO: 11627 - DNA, 24 bp, synthetic construct
  misc_feature 1..24: note = Synthetic Construct
  source 1..24: mol_type = other DNA
tgaaagagcagcctaagcgataag

SEQ ID NO: 11628 - DNA, 22 bp, synthetic construct
  misc_feature 1..22: note = Synthetic Construct
  source 1..22: mol_type = other DNA
tcctttgcgatgtgcttttcag

SEQ ID NO: 11629 - DNA, 25 bp, synthetic construct
  misc_feature 1..25: note = Synthetic Construct
  source 1..25: mol_type = other DNA
gtgaggtcttccatggaactaagac

SEQ ID NO: 11630 - DNA, 24 bp, synthetic construct
  misc_feature 1..24: note = Synthetic Construct
  source 1..24: mol_type = other DNA
cacaggtgttgatgtccctaacct

SEQ ID NO: 11631 - DNA, 27 bp, synthetic construct
  misc_feature 1..27: note = Synthetic Construct
  source 1..27: mol_type = other DNA
acctgcacacttgttctttaaatgttc

SEQ ID NO: 11632 - DNA, 24 bp, synthetic construct
  misc_feature 1..24: note = Synthetic Construct
  source 1..24: mol_type = other DNA
gtcaccctgaagtgatccagaaag

SEQ ID NO: 11633 - DNA, 27 bp, synthetic construct
  misc_feature 1..27: note = Synthetic Construct
  source 1..27: mol_type = other DNA
gcaacatctttaggctttgagttaacc

SEQ ID NO: 11634 - DNA, 26 bp, synthetic construct
  misc_feature 1..26: note = Synthetic Construct
  source 1..26: mol_type = other DNA
gtgctaagaggaaagtttgaccacaa

SEQ ID NO: 11635 - DNA, 27 bp, synthetic construct
  misc_feature 1..27: note = Synthetic Construct
  source 1..27: mol_type = other DNA
tgatggaagtggtcaaatgtaatcaac

SEQ ID NO: 11636 - DNA, 27 bp, synthetic construct
  misc_feature 1..27: note = Synthetic Construct
  source 1..27: mol_type = other DNA
tctgcagattcaacactattcctatca

SEQ ID NO: 11637 - DNA, 29 bp, synthetic construct
  misc_feature 1..29: note = Synthetic Construct
  source 1..29: mol_type = other DNA
tcacatgctatagttcattcacacaaatc

SEQ ID NO: 11638 - DNA, 22 bp, synthetic construct
  misc_feature 1..22: note = Synthetic Construct
  source 1..22: mol_type = other DNA
agcttgaaggtaggaggcagaa

SEQ ID NO: 11639 - DNA, 27 bp, synthetic construct
  misc_feature 1..27: note = Synthetic Construct
  source 1..27: mol_type = other DNA
gccatattctctcagttcacacaaagg

SEQ ID NO: 11640 - DNA, 29 bp, synthetic construct
  misc_feature 1..29: note = Synthetic Construct
  source 1..29: mol_type = other DNA
cctttcaggaataaaagttgtgattacca

SEQ ID NO: 11641 - DNA, 27 bp, synthetic construct
  misc_feature 1..27: note = Synthetic Construct
  source 1..27: mol_type = other DNA
acaggacagggagattatttcactaac

SEQ ID NO: 11642 - DNA, 25 bp, synthetic construct
  misc_feature 1..25: note = Synthetic Construct
  source 1..25: mol_type = other DNA
cctgaaaaggaaaatctggcctgat

SEQ ID NO: 11643 - DNA, 26 bp, synthetic construct
  misc_feature 1..26: note = Synthetic Construct
  source 1..26: mol_type = other DNA
gggatgctaactgctcttctctttgg

SEQ ID NO: 11644 - DNA, 18 bp, synthetic construct
  misc_feature 1..18: note = Synthetic Construct
  source 1..18: mol_type = other DNA
tgcacggaggccctccat

SEQ ID NO: 11645 - DNA, 30 bp, synthetic construct
  misc_feature 1..30: note = Synthetic Construct
  source 1..30: mol_type = other DNA
gctgaactcacaataatagcttcttacttg

SEQ ID NO: 11646 - DNA, 21 bp, synthetic construct
  misc_feature 1..21: note = Synthetic Construct
  source 1..21: mol_type = other DNA
aagctctgcagccttccagat

SEQ ID NO: 11647 - DNA, 26 bp, synthetic construct
  misc_feature 1..26: note = Synthetic Construct
  source 1..26: mol_type = other DNA
atctttctcttcctccagttgactac

SEQ ID NO: 11648 - DNA, 29 bp, synthetic construct
  misc_feature 1..29: note = Synthetic Construct
  source 1..29: mol_type = other DNA
ccagttataagcagatgaggtgtattcat

SEQ ID NO: 11649 - DNA, 27 bp, synthetic construct
  misc_feature 1..27: note = Synthetic Construct
  source 1..27: mol_type = other DNA
cccaggaagccactagaatacaaatcc

SEQ ID NO: 11650 - DNA, 22 bp, synthetic construct
  misc_feature 1..22: note = Synthetic Construct
  source 1..22: mol_type = other DNA
accataatggcagggtgacatg

SEQ ID NO: 11651 - DNA, 25 bp, synthetic construct
  misc_feature 1..25: note = Synthetic Construct
  source 1..25: mol_type = other DNA
ctccaaagcttgttcacttcctact

SEQ ID NO: 11652 - DNA, 23 bp, synthetic construct
  misc_feature 1..23: note = Synthetic Construct
  source 1..23: mol_type = other DNA
gcttgccctttttcgttcattgt

SEQ ID NO: 11653 - DNA, 30 bp, synthetic construct
  misc_feature 1..30: note = Synthetic Construct
  source 1..30: mol_type = other DNA
tggtgaaaattaacacggaaattctaaagt

SEQ ID NO: 11654 - DNA, 28 bp, synthetic construct
  misc_feature 1..28: note = Synthetic Construct
  source 1..28: mol_type = other DNA
tctgtctaccctcattctatggtattga

SEQ ID NO: 11655 - DNA, 23 bp, synthetic construct
  misc_feature 1..23: note = Synthetic Construct
  source 1..23: mol_type = other DNA
acctactggggatcacaaaactg

SEQ ID NO: 11656 - DNA, 22 bp, synthetic construct
  misc_feature 1..22: note = Synthetic Construct
  source 1..22: mol_type = other DNA
tccaggacctgatgacttcact

SEQ ID NO: 11657 - DNA, 27 bp, synthetic construct
  misc_feature 1..27: note = Synthetic Construct
  source 1..27: mol_type = other DNA
gcataatgttgtaggcactttgaaaga

SEQ ID NO: 11658 - DNA, 26 bp, synthetic construct
  misc_feature 1..26: note = Synthetic Construct
  source 1..26: mol_type = other DNA
aacacccattaatcctcatgttttcc

SEQ ID NO: 11659 - DNA, 22 bp, synthetic construct
  misc_feature 1..22: note = Synthetic Construct
  source 1..22: mol_type = other DNA
ggcacaacatttgggagacaaa

SEQ ID NO: 11660 - DNA, 26 bp, synthetic construct
  misc_feature 1..26: note = Synthetic Construct
  source 1..26: mol_type = other DNA
cctggaacctgaaagcttgcaaaaag

SEQ ID NO: 11661 - DNA, 20 bp, synthetic construct
  misc_feature 1..20: note = Synthetic Construct
  source 1..20: mol_type = other DNA
acagggtgctctcctcttga

SEQ ID NO: 11662 - DNA, 25 bp, synthetic construct
  misc_feature 1..25: note = Synthetic Construct
  source 1..25: mol_type = other DNA
ggaagcaaacaggtagagcctggta

SEQ ID NO: 11663 - DNA, 23 bp, synthetic construct
  misc_feature 1..23: note = Synthetic Construct
  source 1..23: mol_type = other DNA
ctacaacaacagagctccaggat

SEQ ID NO: 11664 - DNA, 23 bp, synthetic construct
  misc_feature 1..23: note = Synthetic Construct
  source 1..23: mol_type = other DNA
tgtccttggtcgtatgtgagaga

SEQ ID NO: 11665 - DNA, 20 bp, synthetic construct
  misc_feature 1..20: note = Synthetic Construct
  source 1..20: mol_type = other DNA
gcaggaactggcttgccttt

SEQ ID NO: 11666 - DNA, 23 bp, synthetic construct
  misc_feature 1..23: note = Synthetic Construct
  source 1..23: mol_type = other DNA
aggtttcggctttagttgtgtga

SEQ ID NO: 11667 - DNA, 21 bp, synthetic construct
  misc_feature 1..21: note = Synthetic Construct
  source 1..21: mol_type = other DNA
tgtctgcttctgccggcattc

SEQ ID NO: 11668 - DNA, 25 bp, synthetic construct
  misc_feature 1..25: note = Synthetic Construct
  source 1..25: mol_type = other DNA
gtccctcacacctttctaccagaag

SEQ ID NO: 11669 - DNA, 25 bp, synthetic construct
  misc_feature 1..25: note = Synthetic Construct
  source 1..25: mol_type = other DNA
ggctgcaggagtagaggtctaaatg

SEQ ID NO: 11670 - DNA, 25 bp, synthetic construct
  misc_feature 1..25: note = Synthetic Construct
  source 1..25: mol_type = other DNA
ggcaagaagaaaactggagccaaga

SEQ ID NO: 11671 - DNA, 24 bp, synthetic construct
  misc_feature 1..24: note = Synthetic Construct
  source 1..24: mol_type = other DNA
gagcctgagttcttgatcactaca

SEQ ID NO: 11672 - DNA, 21 bp, synthetic construct
  misc_feature 1..21: note = Synthetic Construct
  source 1..21: mol_type = other DNA
cctggaaaaagccccggtaga

SEQ ID NO: 11673 - DNA, 21 bp, synthetic construct
  misc_feature 1..21: note = Synthetic Construct
  source 1..21: mol_type = other DNA
gcaatggtcccagtgagagtt

SEQ ID NO: 11674 - DNA, 20 bp, synthetic construct
  misc_feature 1..20: note = Synthetic Construct
  source 1..20: mol_type = other DNA
gccctttggaacctgaccaa

SEQ ID NO: 11675 - DNA, 24 bp, synthetic construct
  misc_feature 1..24: note = Synthetic Construct
  source 1..24: mol_type = other DNA
ggccttgatttgacccttcttttc

SEQ ID NO: 11676 - DNA, 22 bp, synthetic construct
  misc_feature 1..22: note = Synthetic Construct
  source 1..22: mol_type = other DNA
ccacccgcttctgaaacacatc

SEQ ID NO: 11677 - DNA, 18 bp, synthetic construct
  misc_feature 1..18: note = Synthetic Construct
  source 1..18: mol_type = other DNA
tggcgctaaagcccaaca

SEQ ID NO: 11678 - DNA, 24 bp, synthetic construct
  misc_feature 1..24: note = Synthetic Construct
  source 1..24: mol_type = other DNA
ccttccccgcttctggatatgaaa

SEQ ID NO: 11679 - DNA, 23 bp, synthetic construct
  misc_feature 1..23: note = Synthetic Construct
  source 1..23: mol_type = other DNA
gtcagcgtttacggctattgagt

SEQ ID NO: 11680 - DNA, 20 bp, synthetic construct
  misc_feature 1..20: note = Synthetic Construct
  source 1..20: mol_type = other DNA
gcatctccagtgccctctgt

SEQ ID NO: 11681 - DNA, 24 bp, synthetic construct
  misc_feature 1..24: note = Synthetic Construct
  source 1..24: mol_type = other DNA
catcttcctagacatgcacacaac

SEQ ID NO: 11682 - DNA, 21 bp, synthetic construct
  misc_feature 1..21: note = Synthetic Construct
  source 1..21: mol_type = other DNA
gtcccaagtcaactgccatct

SEQ ID NO: 11683 - DNA, 20 bp, synthetic construct
  misc_feature 1..20: note = Synthetic Construct
  source 1..20: mol_type = other DNA
gcgtcagcacagctaacaca

SEQ ID NO: 11684 - DNA, 23 bp, synthetic construct
  misc_feature 1..23: note = Synthetic Construct
  source 1..23: mol_type = other DNA
tcacaatgggagggaacattcaa

SEQ ID NO: 11685 - DNA, 27 bp, synthetic construct
  misc_feature 1..27: note = Synthetic Construct
  source 1..27: mol_type = other DNA
ggtaaaggctggttgtaaagtccacat

SEQ ID NO: 11686 - DNA, 24 bp, synthetic construct
  misc_feature 1..24: note = Synthetic Construct
  source 1..24: mol_type = other DNA
ccgactcaatggggaactcctact

SEQ ID NO: 11687 - DNA, 22 bp, synthetic construct
  misc_feature 1..22: note = Synthetic Construct
  source 1..22: mol_type = other DNA
tccttacaccttggggcgtcta

SEQ ID NO: 11688 - DNA, 26 bp, synthetic construct
  misc_feature 1..26: note = Synthetic Construct
  source 1..26: mol_type = other DNA
gggcatttctaagacacttggacagt

SEQ ID NO: 11689 - DNA, 25 bp, synthetic construct
  misc_feature 1..25: note = Synthetic Construct
  source 1..25: mol_type = other DNA
cactgtatctcaaagggcaaaacaa

SEQ ID NO: 11690 - DNA, 23 bp, synthetic construct
  misc_feature 1..23: note = Synthetic Construct
  source 1..23: mol_type = other DNA
acttgtctctgcagacagtttca

SEQ ID NO: 11691 - DNA, 20 bp, synthetic construct
  misc_feature 1..20: note = Synthetic Construct
  source 1..20: mol_type = other DNA
ggcctcttggtgcctctgtt

SEQ ID NO: 11692 - DNA, 29 bp, synthetic construct
  misc_feature 1..29: note = Synthetic Construct
  source 1..29: mol_type = other DNA
gctagagaaacaagacaacatccaagttc

SEQ ID NO: 11693 - DNA, 22 bp, synthetic construct
  misc_feature 1..22: note = Synthetic Construct
  source 1..22: mol_type = other DNA
gcgggcatagagagaaggaaat

SEQ ID NO: 11694 - DNA, 23 bp, synthetic construct
  misc_feature 1..23: note = Synthetic Construct
  source 1..23: mol_type = other DNA
ggcttcagtccttcacctctttc

SEQ ID NO: 11695 - DNA, 20 bp, synthetic construct
  misc_feature 1..20: note = Synthetic Construct
  source 1..20: mol_type = other DNA
tcagagtcctaggccagcat

SEQ ID NO: 11696 - DNA, 24 bp, synthetic construct
  misc_feature 1..24: note = Synthetic Construct
  source 1..24: mol_type = other DNA
ggttcctcatggaagactggtttg

SEQ ID NO: 11697 - DNA, 26 bp, synthetic construct
  misc_feature 1..26: note = Synthetic Construct
  source 1..26: mol_type = other DNA
gttgagaagggagtaagatcagacaa

SEQ ID NO: 11698 - DNA, 23 bp, synthetic construct
  misc_feature 1..23: note = Synthetic Construct
  source 1..23: mol_type = other DNA
ctcccgcctctaaatgaatggat

SEQ ID NO: 11699 - DNA, 23 bp, synthetic construct
  misc_feature 1..23: note = Synthetic Construct
  source 1..23: mol_type = other DNA
cattccctcccctaccctggaaa

SEQ ID NO: 11700 - DNA, 22 bp, synthetic construct
  misc_feature 1..22: note = Synthetic Construct
  source 1..22: mol_type = other DNA
gagactcaatcctggcacttgt

SEQ ID NO: 11701 - DNA, 22 bp, synthetic construct
  misc_feature 1..22: note = Synthetic Construct
  source 1..22: mol_type = other DNA
cccggctgccatttaagaccat

SEQ ID NO: 11702 - DNA, 23 bp, synthetic construct
  misc_feature 1..23: note = Synthetic Construct
  source 1..23: mol_type = other DNA
gatgagggctgagtatggtcaag

SEQ ID NO: 11703 - DNA, 22 bp, synthetic construct
  misc_feature 1..22: note = Synthetic Construct
  source 1..22: mol_type = other DNA
ccctttcctgaaccccttcatt

SEQ ID NO: 11704 - DNA, 22 bp, synthetic construct
  misc_feature 1..22: note = Synthetic Construct
  source 1..22: mol_type = other DNA
ggggcaccaaagaaaagacaag

SEQ ID NO: 11705 - DNA, 26 bp, synthetic construct
  misc_feature 1..26: note = Synthetic Construct
  source 1..26: mol_type = other DNA
catcagtaccccacataggtttaact

SEQ ID NO: 11706 - DNA, 26 bp, synthetic construct
  misc_feature 1..26: note = Synthetic Construct
  source 1..26: mol_type = other DNA
ggagctcagtatgagtagaggggaaa

SEQ ID NO: 11707 - DNA, 20 bp, synthetic construct
  misc_feature 1..20: note = Synthetic Construct
  source 1..20: mol_type = other DNA
ttgtgcacgacgctggaatg

SEQ ID NO: 11708 - DNA, 22 bp, synthetic construct
  misc_feature 1..22: note = Synthetic Construct
  source 1..22: mol_type = other DNA
tcgctaggccattcctcctgtt

SEQ ID NO: 11709 - DNA, 26 bp, synthetic construct
  misc_feature 1..26: note = Synthetic Construct
  source 1..26: mol_type = other DNA
cacgacacccttagataatgttggat

SEQ ID NO: 11710 - DNA, 19 bp, synthetic construct
  misc_feature 1..19: note = Synthetic Construct
  source 1..19: mol_type = other DNA
tggcacaagcccaggtcat

SEQ ID NO: 11711 - DNA, 24 bp, synthetic construct
  misc_feature 1..24: note = Synthetic Construct
  source 1..24: mol_type = other DNA
gcctcctctgcatctctgaaccaa

SEQ ID NO: 11712 - DNA, 20 bp, synthetic construct
  misc_feature 1..20: note = Synthetic Construct
  source 1..20: mol_type = other DNA
tgcagcgatcccttcacctt

SEQ ID NO: 11713 - DNA, 22 bp, synthetic construct
  misc_feature 1..22: note = Synthetic Construct
  source 1..22: mol_type = other DNA
tggtagtcaggcctagtgactt

SEQ ID NO: 11714 - DNA, 24 bp, synthetic construct
  misc_feature 1..24: note = Synthetic Construct
  source 1..24: mol_type = other DNA
gaggtcttccaaaggctattcaga

SEQ ID NO: 11715 - DNA, 23 bp, synthetic construct
  misc_feature 1..23: note = Synthetic Construct
  source 1..23: mol_type = other DNA
cctgagcctgtcacactatttct

SEQ ID NO: 11716 - DNA, 20 bp, synthetic construct
  misc_feature 1..20: note = Synthetic Construct
  source 1..20: mol_type = other DNA
gagagcaacaggcgttgaga

SEQ ID NO: 11717 - DNA, 23 bp, synthetic construct
  misc_feature 1..23: note = Synthetic Construct
  source 1..23: mol_type = other DNA
agccctacaaggtcaagttttca

SEQ ID NO: 11718 - DNA, 21 bp, synthetic construct
  misc_feature 1..21: note = Synthetic Construct
  source 1..21: mol_type = other DNA
ggaggcacttcactcctccta

SEQ ID NO: 11719 - DNA, 23 bp, synthetic construct
  misc_feature 1..23: note = Synthetic Construct
  source 1..23: mol_type = other DNA
gttggggtcaactttccctgaag

SEQ ID NO: 11720 - DNA, 22 bp, synthetic construct
  misc_feature 1..22: note = Synthetic Construct
  source 1..22: mol_type = other DNA
gaggtttggctccatcatcaga

SEQ ID NO: 11721 - DNA, 25 bp, synthetic construct
  misc_feature 1..25: note = Synthetic Construct
  source 1..25: mol_type = other DNA
gaggctcatgtctcttcagccttag

SEQ ID NO: 11722 - DNA, 22 bp, synthetic construct
  misc_feature 1..22: note = Synthetic Construct
  source 1..22: mol_type = other DNA
gttgcttcccgttatcctcact

SEQ ID NO: 11723 - DNA, 24 bp, synthetic construct
  misc_feature 1..24: note = Synthetic Construct
  source 1..24: mol_type = other DNA
gggcctgttcttgttgatagtgtt

SEQ ID NO: 11724 - DNA, 26 bp, synthetic construct
  misc_feature 1..26: note = Synthetic Construct
  source 1..26: mol_type = other DNA
gtttgctgttactgaatcccgaatct

SEQ ID NO: 11725 - DNA, 26 bp, synthetic construct
  misc_feature 1..26: note = Synthetic Construct
  source 1..26: mol_type = other DNA
gcacatgtaaaaatcctccctactgt

SEQ ID NO: 11726 - DNA, 25 bp, synthetic construct
  misc_feature 1..25: note = Synthetic Construct
  source 1..25: mol_type = other DNA
cctctggtaatagcacccaggatac

SEQ ID NO: 11727 - DNA, 25 bp, synthetic construct
  misc_feature 1..25: note = Synthetic Construct
  source 1..25: mol_type = other DNA
ctgaggtccagaatccagatgttct

SEQ ID NO: 11728 - DNA, 21 bp, synthetic construct
  misc_feature 1..21: note = Synthetic Construct
  source 1..21: mol_type = other DNA
ggacaacaggatcggggatga

SEQ ID NO: 11729 - DNA, 22 bp, synthetic construct
  misc_feature 1..22: note = Synthetic Construct
  source 1..22: mol_type = other DNA
ccatgtgtaggaagccctgtga

SEQ ID NO: 11730 - DNA, 22 bp, synthetic construct
  misc_feature 1..22: note = Synthetic Construct
  source 1..22: mol_type = other DNA
gcgacctcacttttccagtcat

SEQ ID NO: 11731 - DNA, 25 bp, synthetic construct
  misc_feature 1..25: note = Synthetic Construct
  source 1..25: mol_type = other DNA
gtgctattgtggctctgtaggttga

SEQ ID NO: 11732 - DNA, 21 bp, synthetic construct
  misc_feature 1..21: note = Synthetic Construct
  source 1..21: mol_type = other DNA
gtttcagcctgagaggcaaga

SEQ ID NO: 11733 - DNA, 23 bp, synthetic construct
  misc_feature 1..23: note = Synthetic Construct
  source 1..23: mol_type = other DNA
gagatgaagcgtgtgacccaagt

SEQ ID NO: 11734 - DNA, 22 bp, synthetic construct
  misc_feature 1..22: note = Synthetic Construct
  source 1..22: mol_type = other DNA
tgcctcatctctgcccctcttt

SEQ ID NO: 11735 - DNA, 22 bp, synthetic construct
  misc_feature 1..22: note = Synthetic Construct
  source 1..22: mol_type = other DNA
tctcagtgcgtttggaaggaaa

SEQ ID NO: 11736 - DNA, 22 bp, synthetic construct
  misc_feature 1..22: note = Synthetic Construct
  source 1..22: mol_type = other DNA
aggtttccctggacacacattc

SEQ ID NO: 11737 - DNA, 23 bp, synthetic construct
  misc_feature 1..23: note = Synthetic Construct
  source 1..23: mol_type = other DNA
aggagacagggacagtttcaatg

SEQ ID NO: 11738 - DNA, 22 bp, synthetic construct
  misc_feature 1..22: note = Synthetic Construct
  source 1..22: mol_type = other DNA
tgggttggaaacacgtccttta

SEQ ID NO: 11739 - DNA, 20 bp, synthetic construct
  misc_feature 1..20: note = Synthetic Construct
  source 1..20: mol_type = other DNA
gcccttagcaacagctgcat

SEQ ID NO: 11740 - DNA, 21 bp, synthetic construct
  misc_feature 1..21: note = Synthetic Construct
  source 1..21: mol_type = other DNA
gcagacacgcctctggcaaat

SEQ ID NO: 11741 - DNA, 21 bp, synthetic construct
  misc_feature 1..21: note = Synthetic Construct
  source 1..21: mol_type = other DNA
gccaaaagtgacagcaacaca

SEQ ID NO: 11742 - DNA, 26 bp, synthetic construct
  misc_feature 1..26: note = Synthetic Construct
  source 1..26: mol_type = other DNA
gcacacatccaatccttcagtaaatc

SEQ ID NO: 11743 - DNA, 22 bp, synthetic construct
  misc_feature 1..22: note = Synthetic Construct
  source 1..22: mol_type = other DNA
tcctcatccaagctccttctct

SEQ ID NO: 11744 - DNA, 24 bp, synthetic construct
  misc_feature 1..24: note = Synthetic Construct
  source 1..24: mol_type = other DNA
ggcactttccacccagaacttaac

SEQ ID NO: 11745 - DNA, 20 bp, synthetic construct
  misc_feature 1..20: note = Synthetic Construct
  source 1..20: mol_type = other DNA
aagcccacgttgtgctcttg

SEQ ID NO: 11746 - DNA, 26 bp, synthetic construct
  misc_feature 1..26: note = Synthetic Construct
  source 1..26: mol_type = other DNA
ctcagtagggtgaaaaggatggaagt

SEQ ID NO: 11747 - DNA, 24 bp, synthetic construct
  misc_feature 1..24: note = Synthetic Construct
  source 1..24: mol_type = other DNA
gctggatctacagaaaccagcaaa

SEQ ID NO: 11748 - DNA, 19 bp, synthetic construct
  misc_feature 1..19: note = Synthetic Construct
  source 1..19: mol_type = other DNA
tggctgcagatgcttgtca

SEQ ID NO: 11749 - DNA, 22 bp, synthetic construct
  misc_feature 1..22: note = Synthetic Construct
  source 1..22: mol_type = other DNA
gcctctcagcctcacgttctta

SEQ ID NO: 11750 - DNA, 20 bp, synthetic construct
  misc_feature 1..20: note = Synthetic Construct
  source 1..20: mol_type = other DNA
tccttgactcacgcctctga

SEQ ID NO: 11751 - DNA, 22 bp, synthetic construct
  misc_feature 1..22: note = Synthetic Construct
  source 1..22: mol_type = other DNA
ggaggacatggtgtttgaggat

SEQ ID NO: 11752 - DNA, 24 bp, synthetic construct
  misc_feature 1..24: note = Synthetic Construct
  source 1..24: mol_type = other DNA
ctacagttagagtcacacgtcaca

SEQ ID NO: 11753 - DNA, 20 bp, synthetic construct
  misc_feature 1..20: note = Synthetic Construct
  source 1..20: mol_type = other DNA
catgcggagggacttagcaa

SEQ ID NO: 11754 - DNA, 23 bp, synthetic construct
  misc_feature 1..23: note = Synthetic Construct
  source 1..23: mol_type = other DNA
gctttccagagtagaggcgtttc

SEQ ID NO: 11755 - DNA, 24 bp, synthetic construct
  misc_feature 1..24: note = Synthetic Construct
  source 1..24: mol_type = other DNA
tgatggtgcagaattgctacgata

SEQ ID NO: 11756 - DNA, 21 bp, synthetic construct
  misc_feature 1..21: note = Synthetic Construct
  source 1..21: mol_type = other DNA
gctgaaatggacccacagaga

SEQ ID NO: 11757 - DNA, 20 bp, synthetic construct
  misc_feature 1..20: note = Synthetic Construct
  source 1..20: mol_type = other DNA
tgctccaacgatggctcttc

SEQ ID NO: 11758 - DNA, 23 bp, synthetic construct
  misc_feature 1..23: note = Synthetic Construct
  source 1..23: mol_type = other DNA
aggtgaaagcgatgtctgcttag

SEQ ID NO: 11759 - DNA, 21 bp, synthetic construct
  misc_feature 1..21: note = Synthetic Construct
  source 1..21: mol_type = other DNA
gccctgacctcaccattggaa

SEQ ID NO: 11760 - DNA, 19 bp, synthetic construct
  misc_feature 1..19: note = Synthetic Construct
  source 1..19: mol_type = other DNA
tggggcaattgcgggtatt

SEQ ID NO: 11761 - DNA, 25 bp, synthetic construct
  misc_feature 1..25: note = Synthetic Construct
  source 1..25: mol_type = other DNA
gcattacaggagagtgaagatggat

SEQ ID NO: 11762 - DNA, 23 bp, synthetic construct
  misc_feature 1..23: note = Synthetic Construct
  source 1..23: mol_type = other DNA
ggaggagaaaggtggtacacttg

SEQ ID NO: 11763 - DNA, 24 bp, synthetic construct
  misc_feature 1..24: note = Synthetic Construct
  source 1..24: mol_type = other DNA
ggagacaatacaggttgggtggtt

SEQ ID NO: 11764 - DNA, 24 bp, synthetic construct
  misc_feature 1..24: note = Synthetic Construct
  source 1..24: mol_type = other DNA
gcggatcttccttacctagtctga

SEQ ID NO: 11765 - DNA, 25 bp, synthetic construct
  misc_feature 1..25: note = Synthetic Construct
  source 1..25: mol_type = other DNA
ggatactgtgtaggaaggcaataca

SEQ ID NO: 11766 - DNA, 22 bp, synthetic construct
  misc_feature 1..22: note = Synthetic Construct
  source 1..22: mol_type = other DNA
caactccaaccccagccttttg

SEQ ID NO: 11767 - DNA, 24 bp, synthetic construct
  misc_feature 1..24: note = Synthetic Construct
  source 1..24: mol_type = other DNA
caggccaagaatgacatacgactt

SEQ ID NO: 11768 - DNA, 22 bp, synthetic construct
  misc_feature 1..22: note = Synthetic Construct
  source 1..22: mol_type = other DNA
ggcgaaaatgagcactgtggaa

SEQ ID NO: 11769 - DNA, 23 bp, synthetic construct
  misc_feature 1..23: note = Synthetic Construct
  source 1..23: mol_type = other DNA
ggaaggcagtacaagagcttact

SEQ ID NO: 11770 - DNA, 25 bp, synthetic construct
  misc_feature 1..25: note = Synthetic Construct
  source 1..25: mol_type = other DNA
ggcgattcctgacatttgattgcat

SEQ ID NO: 11771 - DNA, 21 bp, synthetic construct
  misc_feature 1..21: note = Synthetic Construct
  source 1..21: mol_type = other DNA
ggggtttgtttgggtcagaga

SEQ ID NO: 11772 - DNA, 25 bp, synthetic construct
  misc_feature 1..25: note = Synthetic Construct
  source 1..25: mol_type = other DNA
ctgcaatattggccatttctcttca

SEQ ID NO: 11773 - DNA, 20 bp, synthetic construct
  misc_feature 1..20: note = Synthetic Construct
  source 1..20: mol_type = other DNA
agtgtgcacgcctggttgaa

SEQ ID NO: 11774 - DNA, 22 bp, synthetic construct
  misc_feature 1..22: note = Synthetic Construct
  source 1..22: mol_type = other DNA
ccccagctccttcacaaagact

SEQ ID NO: 11775 - DNA, 22 bp, synthetic construct
  misc_feature 1..22: note = Synthetic Construct
  source 1..22: mol_type = other DNA
tggagctgaggaggaaagaaca

SEQ ID NO: 11776 - DNA, 27 bp, synthetic construct
  misc_feature 1..27: note = Synthetic Construct
  source 1..27: mol_type = other DNA
tgggtcataaagtgactctgtaacatc

SEQ ID NO: 11777 - DNA, 24 bp, synthetic construct
  misc_feature 1..24: note = Synthetic Construct
  source 1..24: mol_type = other DNA
gctgtgaatgttacatggcaggat

SEQ ID NO: 11778 - DNA, 22 bp, synthetic construct
  misc_feature 1..22: note = Synthetic Construct
  source 1..22: mol_type = other DNA
cgtcccttaccggagcaacttt

SEQ ID NO: 11779 - DNA, 24 bp, synthetic construct
  misc_feature 1..24: note = Synthetic Construct
  source 1..24: mol_type = other DNA
agtgagctagaggctaggacttac

SEQ ID NO: 11780 - DNA, 22 bp, synthetic construct
  misc_feature 1..22: note = Synthetic Construct
  source 1..22: mol_type = other DNA
tcctttcctctcatcgcctttg

SEQ ID NO: 11781 - DNA, 22 bp, synthetic construct
  misc_feature 1..22: note = Synthetic Construct
  source 1..22: mol_type = other DNA
gggcacagaagggtgttccaaa

SEQ ID NO: 11782 - DNA, 21 bp, synthetic construct
  misc_feature 1..21: note = Synthetic Construct
  source 1..21: mol_type = other DNA
ggccctcattgcagtcagcat

SEQ ID NO: 11783 - DNA, 24 bp, synthetic construct
  misc_feature 1..24: note = Synthetic Construct
  source 1..24: mol_type = other DNA
tcctgagatgggaaagagtgaaga

SEQ ID NO: 11784 - DNA, 25 bp, synthetic construct
  misc_feature 1..25: note = Synthetic Construct
  source 1..25: mol_type = other DNA
gaaactgcacaaacttcctctccta

SEQ ID NO: 11785 - DNA, 22 bp, synthetic construct
  misc_feature 1..22: note = Synthetic Construct
  source 1..22: mol_type = other DNA
cgcctgtggttgttgatgaaag

SEQ ID NO: 11786 - DNA, 22 bp, synthetic construct
  misc_feature 1..22: note = Synthetic Construct
  source 1..22: mol_type = other DNA
tccccaagagcacagactcaac

SEQ ID NO: 11787 - DNA, 22 bp, synthetic construct
  misc_feature 1..22: note = Synthetic Construct
  source 1..22: mol_type = other DNA
cctcttcgcagaccttgaggat

SEQ ID NO: 11788 - DNA, 24 bp, synthetic construct
  misc_feature 1..24: note = Synthetic Construct
  source 1..24: mol_type = other DNA
tccacactctaccatttgctgaat

SEQ ID NO: 11789 - DNA, 25 bp, synthetic construct
  misc_feature 1..25: note = Synthetic Construct
  source 1..25: mol_type = other DNA
tgaattgtgcagtgaggctatatct

SEQ ID NO: 11790 - DNA, 26 bp, synthetic construct
  misc_feature 1..26: note = Synthetic Construct
  source 1..26: mol_type = other DNA
tgtgagtaggatctaggcatgttagt

SEQ ID NO: 11791 - DNA, 24 bp, synthetic construct
  misc_feature 1..24: note = Synthetic Construct
  source 1..24: mol_type = other DNA
ggtcacacagagttaatggagaca

SEQ ID NO: 11792 - DNA, 21 bp, synthetic construct
  misc_feature 1..21: note = Synthetic Construct
  source 1..21: mol_type = other DNA
ggacccaagaggctgagaaag

SEQ ID NO: 11793 - DNA, 22 bp, synthetic construct
  misc_feature 1..22: note = Synthetic Construct
  source 1..22: mol_type = other DNA
ctcgtgggtgtgatggaacaga

SEQ ID NO: 11794 - DNA, 20 bp, synthetic construct
  misc_feature 1..20: note = Synthetic Construct
  source 1..20: mol_type = other DNA
tgttgagcgtggaccagtga

SEQ ID NO: 11795 - DNA, 21 bp, synthetic construct
  misc_feature 1..21: note = Synthetic Construct
  source 1..21: mol_type = other DNA
ggctgaggctgtagccttgat

SEQ ID NO: 11796 - DNA, 24 bp, synthetic construct
  misc_feature 1..24: note = Synthetic Construct
  source 1..24: mol_type = other DNA
gatgggctcaagtcagaggttaag

SEQ ID NO: 11797 - DNA, 22 bp, synthetic construct
  misc_feature 1..22: note = Synthetic Construct
  source 1..22: mol_type = other DNA
gacagctgcttctcggctacaa

SEQ ID NO: 11798 - DNA, 19 bp, synthetic construct
  misc_feature 1..19: note = Synthetic Construct
  source 1..19: mol_type = other DNA
atcgcacgtactgccatgt

SEQ ID NO: 11799 - DNA, 23 bp, synthetic construct
  misc_feature 1..23: note = Synthetic Construct
  source 1..23: mol_type = other DNA
ccagaccatgcatccatccacat

SEQ ID NO: 11800 - DNA, 25 bp, synthetic construct
  misc_feature 1..25: note = Synthetic Construct
  source 1..25: mol_type = other DNA
gcaaagaaccatcagggtagacatc

SEQ ID NO: 11801 - DNA, 22 bp, synthetic construct
  misc_feature 1..22: note = Synthetic Construct
  source 1..22: mol_type = other DNA
aagggaggccttccactgtcat

SEQ ID NO: 11802 - DNA, 22 bp, synthetic construct
  misc_feature 1..22: note = Synthetic Construct
  source 1..22: mol_type = other DNA
aagaggccattgccatagttca

SEQ ID NO: 11803 - DNA, 19 bp, synthetic construct
  misc_feature 1..19: note = Synthetic Construct
  source 1..19: mol_type = other DNA
tggggttcaaccggacagt

SEQ ID NO: 11804 - DNA, 21 bp, synthetic construct
  misc_feature 1..21: note = Synthetic Construct
  source 1..21: mol_type = other DNA
cgtgccttaagcccaggtatt

SEQ ID NO: 11805 - DNA, 22 bp, synthetic construct
  misc_feature 1..22: note = Synthetic Construct
  source 1..22: mol_type = other DNA
ggtctcaggaatccacctccaa

SEQ ID NO: 11806 - DNA, 23 bp, synthetic construct
  misc_feature 1..23: note = Synthetic Construct
  source 1..23: mol_type = other DNA
acacagggaacgctctgtaaatg

SEQ ID NO: 11807 - DNA, 24 bp, synthetic construct
  misc_feature 1..24: note = Synthetic Construct
  source 1..24: mol_type = other DNA
cctgtccctctttggttgaaggtt

SEQ ID NO: 11808 - DNA, 28 bp, synthetic construct
  misc_feature 1..28: note = Synthetic Construct
  source 1..28: mol_type = other DNA
caggcattatctacatgtctgcttgtct

SEQ ID NO: 11809 - DNA, 22 bp, synthetic construct
  misc_feature 1..22: note = Synthetic Construct
  source 1..22: mol_type = other DNA
cgtccaagcctcagctgtgtaa

SEQ ID NO: 11810 - DNA, 24 bp, synthetic construct
  misc_feature 1..24: note = Synthetic Construct
  source 1..24: mol_type = other DNA
ctagccaaaagccattctggtagt

SEQ ID NO: 11811 - DNA, 24 bp, synthetic construct
  misc_feature 1..24: note = Synthetic Construct
  source 1..24: mol_type = other DNA
tgttatctgccttctcccaacaaa

SEQ ID NO: 11812 - DNA, 26 bp, synthetic construct
  misc_feature 1..26: note = Synthetic Construct
  source 1..26: mol_type = other DNA
cctcactgccaaatctgatacagaca

SEQ ID NO: 11813 - DNA, 29 bp, synthetic construct
  misc_feature 1..29: note = Synthetic Construct
  source 1..29: mol_type = other DNA
cgagaattacacccatctgatcctctttc

SEQ ID NO: 11814 - DNA, 22 bp, synthetic construct
  misc_feature 1..22: note = Synthetic Construct
  source 1..22: mol_type = other DNA
ggcaagggctaagacgtttgaa

SEQ ID NO: 11815 - DNA, 26 bp, synthetic construct
  misc_feature 1..26: note = Synthetic Construct
  source 1..26: mol_type = other DNA
tcctaactcctacctcatacctcaac

SEQ ID NO: 11816 - DNA, 21 bp, synthetic construct
  misc_feature 1..21: note = Synthetic Construct
  source 1..21: mol_type = other DNA
ccgggactagggtggaagtca

SEQ ID NO: 11817 - DNA, 22 bp, synthetic construct
  misc_feature 1..22: note = Synthetic Construct
  source 1..22: mol_type = other DNA
tgctacacactagctcctcaca

SEQ ID NO: 11818 - DNA, 22 bp, synthetic construct
  misc_feature 1..22: note = Synthetic Construct
  source 1..22: mol_type = other DNA
gcacagacatccagaactgctt

SEQ ID NO: 11819 - DNA, 22 bp, synthetic construct
  misc_feature 1..22: note = Synthetic Construct
  source 1..22: mol_type = other DNA
gtgtgcccacagagacttggaa

SEQ ID NO: 11820 - DNA, 24 bp, synthetic construct
  misc_feature 1..24: note = Synthetic Construct
  source 1..24: mol_type = other DNA
aagccgcctaataatggaaaccta

SEQ ID NO: 11821 - DNA, 24 bp, synthetic construct
  misc_feature 1..24: note = Synthetic Construct
  source 1..24: mol_type = other DNA
atgttctgtagtcgttaggcttgt

SEQ ID NO: 11822 - DNA, 23 bp, synthetic construct
  misc_feature 1..23: note = Synthetic Construct
  source 1..23: mol_type = other DNA
tgaaagaggcaggaaaaggttgt

SEQ ID NO: 11823 - DNA, 22 bp, synthetic construct
  misc_feature 1..22: note = Synthetic Construct
  source 1..22: mol_type = other DNA
agccagataccgtgagccaaga

SEQ ID NO: 11824 - DNA, 27 bp, synthetic construct
  misc_feature 1..27: note = Synthetic Construct
  source 1..27: mol_type = other DNA
cagaagtgggattcaaatccacagaga

SEQ ID NO: 11825 - DNA, 22 bp, synthetic construct
  misc_feature 1..22: note = Synthetic Construct
  source 1..22: mol_type = other DNA
ggcccaaagtgctttgagaaca

SEQ ID NO: 11826 - DNA, 23 bp, synthetic construct
  misc_feature 1..23: note = Synthetic Construct
  source 1..23: mol_type = other DNA
gtcacggaagaactggtggatca

SEQ ID NO: 11827 - DNA, 22 bp, synthetic construct
  misc_feature 1..22: note = Synthetic Construct
  source 1..22: mol_type = other DNA
gcttaataggcgccaaccattt

SEQ ID NO: 11828 - DNA, 24 bp, synthetic construct
  misc_feature 1..24: note = Synthetic Construct
  source 1..24: mol_type = other DNA
cagcttccctgtggaattgtcttc

SEQ ID NO: 11829 - DNA, 21 bp, synthetic construct
  misc_feature 1..21: note = Synthetic Construct
  source 1..21: mol_type = other DNA
tgaaggctcaccagccagaga

SEQ ID NO: 11830 - DNA, 22 bp, synthetic construct
  misc_feature 1..22: note = Synthetic Construct
  source 1..22: mol_type = other DNA
gctgcctcctagagccactaca

SEQ ID NO: 11831 - DNA, 20 bp, synthetic construct
  misc_feature 1..20: note = Synthetic Construct
  source 1..20: mol_type = other DNA
tttacgggcctcccaagtca

SEQ ID NO: 11832 - DNA, 25 bp, synthetic construct
  misc_feature 1..25: note = Synthetic Construct
  source 1..25: mol_type = other DNA
cgtcagccgataatagctgttgctt

SEQ ID NO: 11833 - DNA, 23 bp, synthetic construct
  misc_feature 1..23: note = Synthetic Construct
  source 1..23: mol_type = other DNA
tcttccctaccctgagcctgatg

SEQ ID NO: 11834 - DNA, 23 bp, synthetic construct
  misc_feature 1..23: note = Synthetic Construct
  source 1..23: mol_type = other DNA
gccatgtttcacctgctgcttac

SEQ ID NO: 11835 - DNA, 23 bp, synthetic construct
  misc_feature 1..23: note = Synthetic Construct
  source 1..23: mol_type = other DNA
cagggctttgtgacctagacaga

SEQ ID NO: 11836 - DNA, 19 bp, synthetic construct
  misc_feature 1..19: note = Synthetic Construct
  source 1..19: mol_type = other DNA
tcttgcgcgacaggagaga

SEQ ID NO: 11837 - DNA, 22 bp, synthetic construct
  misc_feature 1..22: note = Synthetic Construct
  source 1..22: mol_type = other DNA
ccttccctccttcgtgtcttct

SEQ ID NO: 11838 - DNA, 24 bp, synthetic construct
  misc_feature 1..24: note = Synthetic Construct
  source 1..24: mol_type = other DNA
gcacttgaggtaggattggaggaa

SEQ ID NO: 11839 - DNA, 21 bp, synthetic construct
  misc_feature 1..21: note = Synthetic Construct
  source 1..21: mol_type = other DNA
gttgtcttggttgccgtgttc

SEQ ID NO: 11840 - DNA, 21 bp, synthetic construct
  misc_feature 1..21: note = Synthetic Construct
  source 1..21: mol_type = other DNA
tgcttctgtctggctgagaag

SEQ ID NO: 11841 - DNA, 24 bp, synthetic construct
  misc_feature 1..24: note = Synthetic Construct
  source 1..24: mol_type = other DNA
ctccttcgtgtatatgagcagctt

SEQ ID NO: 11842 - DNA, 25 bp, synthetic construct
  misc_feature 1..25: note = Synthetic Construct
  source 1..25: mol_type = other DNA
gcccttttccttaaaagcaggaaga

SEQ ID NO: 11843 - DNA, 22 bp, synthetic construct
  misc_feature 1..22: note = Synthetic Construct
  source 1..22: mol_type = other DNA
gcgcaggaagagcagtttgatg

SEQ ID NO: 11844 - DNA, 23 bp, synthetic construct
  misc_feature 1..23: note = Synthetic Construct
  source 1..23: mol_type = other DNA
ggttccccagattggctcaaaag

SEQ ID NO: 11845 - DNA, 19 bp, synthetic construct
  misc_feature 1..19: note = Synthetic Construct
  source 1..19: mol_type = other DNA
atccgccagccgcccaata

SEQ ID NO: 11846 - DNA, 25 bp, synthetic construct
  misc_feature 1..25: note = Synthetic Construct
  source 1..25: mol_type = other DNA
ccaagtctcaggtgtgaggagttac

SEQ ID NO: 11847 - DNA, 24 bp, synthetic construct
  misc_feature 1..24: note = Synthetic Construct
  source 1..24: mol_type = other DNA
cacactgggttttctggtttcagt

SEQ ID NO: 11848 - DNA, 22 bp, synthetic construct
  misc_feature 1..22: note = Synthetic Construct
  source 1..22: mol_type = other DNA
cagggcaactcaacggcaaaag

SEQ ID NO: 11849 - DNA, 22 bp, synthetic construct
  misc_feature 1..22: note = Synthetic Construct
  source 1..22: mol_type = other DNA
agctggtcactgtgggagaaga

SEQ ID NO: 11850 - DNA, 20 bp, synthetic construct
  misc_feature 1..20: note = Synthetic Construct
  source 1..20: mol_type = other DNA
aggctcagctctggggattg

SEQ ID NO: 11851 - DNA, 22 bp, synthetic construct
  misc_feature 1..22: note = Synthetic Construct
  source 1..22: mol_type = other DNA
ggctggctccatcgtttgagat

SEQ ID NO: 11852 - DNA, 25 bp, synthetic construct
  misc_feature 1..25: note = Synthetic Construct
  source 1..25: mol_type = other DNA
cagggaagctttgacagaagagata

SEQ ID NO: 11853 - DNA, 25 bp, synthetic construct
  misc_feature 1..25: note = Synthetic Construct
  source 1..25: mol_type = other DNA
aggatacaggttggaaagcaagatt

SEQ ID NO: 11854 - DNA, 24 bp, synthetic construct
  misc_feature 1..24: note = Synthetic Construct
  source 1..24: mol_type = other DNA
gtgcggctgtcatcaacattcaac

SEQ ID NO: 11855 - DNA, 22 bp, synthetic construct
  misc_feature 1..22: note = Synthetic Construct
  source 1..22: mol_type = other DNA
ggaacgggagtcaggtcaaaca

SEQ ID NO: 11856 - DNA, 22 bp, synthetic construct
  misc_feature 1..22: note = Synthetic Construct
  source 1..22: mol_type = other DNA
tccctctgtcagtctgggtcta

SEQ ID NO: 11857 - DNA, 18 bp, synthetic construct
  misc_feature 1..18: note = Synthetic Construct
  source 1..18: mol_type = other DNA
acgcgcagtccacaaaca

SEQ ID NO: 11858 - DNA, 22 bp, synthetic construct
  misc_feature 1..22: note = Synthetic Construct
  source 1..22: mol_type = other DNA
tgcatattgtccaaggctgctt

SEQ ID NO: 11859 - DNA, 20 bp, synthetic construct
  misc_feature 1..20: note = Synthetic Construct
  source 1..20: mol_type = other DNA
gccctctgcatctagccaat

SEQ ID NO: 11860 - DNA, 22 bp, synthetic construct
  misc_feature 1..22: note = Synthetic Construct
  source 1..22: mol_type = other DNA
tggtccatccaaatcaggcaat

SEQ ID NO: 11861 - DNA, 27 bp, synthetic construct
  misc_feature 1..27: note = Synthetic Construct
  source 1..27: mol_type = other DNA
gccgctcctctttctgttccttaaaaa

SEQ ID NO: 11862 - DNA, 23 bp, synthetic construct
  misc_feature 1..23: note = Synthetic Construct
  source 1..23: mol_type = other DNA
gcaaaccaggcttttcttgcata

SEQ ID NO: 11863 - DNA, 23 bp, synthetic construct
  misc_feature 1..23: note = Synthetic Construct
  source 1..23: mol_type = other DNA
ccatctggctatgtgacggatgt

SEQ ID NO: 11864 - DNA, 26 bp, synthetic construct
  misc_feature 1..26: note = Synthetic Construct
  source 1..26: mol_type = other DNA
cagtaaaggaagctttgcaggtttgt

SEQ ID NO: 11865 - DNA, 23 bp, synthetic construct
  misc_feature 1..23: note = Synthetic Construct
  source 1..23: mol_type = other DNA
ttaaatactcccatgcccggaaa

SEQ ID NO: 11866 - DNA, 23 bp, synthetic construct
  misc_feature 1..23: note = Synthetic Construct
  source 1..23: mol_type = other DNA
ggttgtggagacaaggcttccta

SEQ ID NO: 11867 - DNA, 23 bp, synthetic construct
  misc_feature 1..23: note = Synthetic Construct
  source 1..23: mol_type = other DNA
gctgtctctccctaggtcaggtt

SEQ ID NO: 11868 - DNA, 24 bp, synthetic construct
  misc_feature 1..24: note = Synthetic Construct
  source 1..24: mol_type = other DNA
atgtgttcctgagagtccctttac

SEQ ID NO: 11869 - DNA, 22 bp, synthetic construct
  misc_feature 1..22: note = Synthetic Construct
  source 1..22: mol_type = other DNA
gggacatagcacaggactggat

SEQ ID NO: 11870 - DNA, 26 bp, synthetic construct
  misc_feature 1..26: note = Synthetic Construct
  source 1..26: mol_type = other DNA
cagctctacaaattgttgccatcttc

SEQ ID NO: 11871 - DNA, 21 bp, synthetic construct
  misc_feature 1..21: note = Synthetic Construct
  source 1..21: mol_type = other DNA
ggctctggaagttgccagtca

SEQ ID NO: 11872 - DNA, 24 bp, synthetic construct
  misc_feature 1..24: note = Synthetic Construct
  source 1..24: mol_type = other DNA
ccaagatttggaagagctgaggat

SEQ ID NO: 11873 - DNA, 22 bp, synthetic construct
  misc_feature 1..22: note = Synthetic Construct
  source 1..22: mol_type = other DNA
ggctgaagctgtaatccacaca

SEQ ID NO: 11874 - DNA, 22 bp, synthetic construct
  misc_feature 1..22: note = Synthetic Construct
  source 1..22: mol_type = other DNA
caaccaggatcgccctagaaaa

SEQ ID NO: 11875 - DNA, 22 bp, synthetic construct
  misc_feature 1..22: note = Synthetic Construct
  source 1..22: mol_type = other DNA
aacccagctacggagaggatga

SEQ ID NO: 11876 - DNA, 25 bp, synthetic construct
  misc_feature 1..25: note = Synthetic Construct
  source 1..25: mol_type = other DNA
acccagcttaatggttccaaatagt

SEQ ID NO: 11877 - DNA, 23 bp, synthetic construct
  misc_feature 1..23: note = Synthetic Construct
  source 1..23: mol_type = other DNA
tgctctgctttcttccagtttca

SEQ ID NO: 11878 - DNA, 25 bp, synthetic construct
  misc_feature 1..25: note = Synthetic Construct
  source 1..25: mol_type = other DNA
ccttccaaaagggagggatgttttc

SEQ ID NO: 11879 - DNA, 25 bp, synthetic construct
  misc_feature 1..25: note = Synthetic Construct
  source 1..25: mol_type = other DNA
gcattgaaacacctggtttacttca

SEQ ID NO: 11880 - DNA, 23 bp, synthetic construct
  misc_feature 1..23: note = Synthetic Construct
  source 1..23: mol_type = other DNA
tgcttgacagctctgttgattgt

SEQ ID NO: 11881 - DNA, 25 bp, synthetic construct
  misc_feature 1..25: note = Synthetic Construct
  source 1..25: mol_type = other DNA
gccagctagaaccctatacccagaa

SEQ ID NO: 11882 - DNA, 24 bp, synthetic construct
  misc_feature 1..24: note = Synthetic Construct
  source 1..24: mol_type = other DNA
gtgaaatgtcttgcccttgtcatc

SEQ ID NO: 11883 - DNA, 20 bp, synthetic construct
  misc_feature 1..20: note = Synthetic Construct
  source 1..20: mol_type = other DNA
caccagctacccaagctcaa

SEQ ID NO: 11884 - DNA, 22 bp, synthetic construct
  misc_feature 1..22: note = Synthetic Construct
  source 1..22: mol_type = other DNA
gatgactggaccgcatgtctct

SEQ ID NO: 11885 - DNA, 22 bp, synthetic construct
  misc_feature 1..22: note = Synthetic Construct
  source 1..22: mol_type = other DNA
ctcgttcctgctgtgcttgtag

SEQ ID NO: 11886 - DNA, 22 bp, synthetic construct
  misc_feature 1..22: note = Synthetic Construct
  source 1..22: mol_type = other DNA
tgcctttggtccctcacacaag

SEQ ID NO: 11887 - DNA, 22 bp, synthetic construct
  misc_feature 1..22: note = Synthetic Construct
  source 1..22: mol_type = other DNA
gagaaccacggagagaggaagt

SEQ ID NO: 11888 - DNA, 26 bp, synthetic construct
  misc_feature 1..26: note = Synthetic Construct
  source 1..26: mol_type = other DNA
cccacagttagtacatggcagagttt

SEQ ID NO: 11889 - DNA, 22 bp, synthetic construct
  misc_feature 1..22: note = Synthetic Construct
  source 1..22: mol_type = other DNA
cctgggagccatgtctgaaact

SEQ ID NO: 11890 - DNA, 22 bp, synthetic construct
  misc_feature 1..22: note = Synthetic Construct
  source 1..22: mol_type = other DNA
gggcaccttcacattgctgaga

SEQ ID NO: 11891 - DNA, 24 bp, synthetic construct
  misc_feature 1..24: note = Synthetic Construct
  source 1..24: mol_type = other DNA
ggaccctggtctttagttccgatt

SEQ ID NO: 11892 - DNA, 22 bp, synthetic construct
  misc_feature 1..22: note = Synthetic Construct
  source 1..22: mol_type = other DNA
agcaccaagggctgaaggaaag

SEQ ID NO: 11893 - DNA, 23 bp, synthetic construct
  misc_feature 1..23: note = Synthetic Construct
  source 1..23: mol_type = other DNA
gcaacacagatccactgaagaca

SEQ ID NO: 11894 - DNA, 24 bp, synthetic construct
  misc_feature 1..24: note = Synthetic Construct
  source 1..24: mol_type = other DNA
ggctctccataaccagatgctgta

SEQ ID NO: 11895 - DNA, 20 bp, synthetic construct
  misc_feature 1..20: note = Synthetic Construct
  source 1..20: mol_type = other DNA
ttccactggcccactgtact

SEQ ID NO: 11896 - DNA, 21 bp, synthetic construct
  misc_feature 1..21: note = Synthetic Construct
  source 1..21: mol_type = other DNA
gcccatcagtctcccctgcta

SEQ ID NO: 11897 - DNA, 19 bp, synthetic construct
  misc_feature 1..19: note = Synthetic Construct
  source 1..19: mol_type = other DNA
ccagtcatccggggcactt

SEQ ID NO: 11898 - DNA, 25 bp, synthetic construct
  misc_feature 1..25: note = Synthetic Construct
  source 1..25: mol_type = other DNA
gtggaatccaatcactcagccttca

SEQ ID NO: 11899 - DNA, 24 bp, synthetic construct
  misc_feature 1..24: note = Synthetic Construct
  source 1..24: mol_type = other DNA
cgcccactgctatctctaccattc

SEQ ID NO: 11900 - DNA, 21 bp, synthetic construct
  misc_feature 1..21: note = Synthetic Construct
  source 1..21: mol_type = other DNA
agtgcctggccatctgctgta

SEQ ID NO: 11901 - DNA, 23 bp, synthetic construct
  misc_feature 1..23: note = Synthetic Construct
  source 1..23: mol_type = other DNA
gtgttcatccatcagggccaatg

SEQ ID NO: 11902 - DNA, 21 bp, synthetic construct
  misc_feature 1..21: note = Synthetic Construct
  source 1..21: mol_type = other DNA
gctaaccttggcactgtggat

SEQ ID NO: 11903 - DNA, 22 bp, synthetic construct
  misc_feature 1..22: note = Synthetic Construct
  source 1..22: mol_type = other DNA
gctgtcatccatggtccagaca

SEQ ID NO: 11904 - DNA, 23 bp, synthetic construct
  misc_feature 1..23: note = Synthetic Construct
  source 1..23: mol_type = other DNA
ccatggaagagggagatggaagt

SEQ ID NO: 11905 - DNA, 19 bp, synthetic construct
  misc_feature 1..19: note = Synthetic Construct
  source 1..19: mol_type = other DNA
ccacctcttgggccctttg

SEQ ID NO: 11906 - DNA, 27 bp, synthetic construct
  misc_feature 1..27: note = Synthetic Construct
  source 1..27: mol_type = other DNA
cacagaatatgggctgagaatccaaga

SEQ ID NO: 11907 - DNA, 20 bp, synthetic construct
  misc_feature 1..20: note = Synthetic Construct
  source 1..20: mol_type = other DNA
gagtccccaccagcaagaag

SEQ ID NO: 11908 - DNA, 22 bp, synthetic construct
  misc_feature 1..22: note = Synthetic Construct
  source 1..22: mol_type = other DNA
gtgatgtggctactgcttcact

SEQ ID NO: 11909 - DNA, 20 bp, synthetic construct
  misc_feature 1..20: note = Synthetic Construct
  source 1..20: mol_type = other DNA
gcttccctcttccagtgctt

SEQ ID NO: 11910 - DNA, 23 bp, synthetic construct
  misc_feature 1..23: note = Synthetic Construct
  source 1..23: mol_type = other DNA
ctgcactgtgattctggcatagt

SEQ ID NO: 11911 - DNA, 22 bp, synthetic construct
  misc_feature 1..22: note = Synthetic Construct
  source 1..22: mol_type = other DNA
cccctccactaacggtgcatta

SEQ ID NO: 11912 - DNA, 26 bp, synthetic construct
  misc_feature 1..26: note = Synthetic Construct
  source 1..26: mol_type = other DNA
cagggatgaaagacagagagcatttg

SEQ ID NO: 11913 - DNA, 22 bp, synthetic construct
  misc_feature 1..22: note = Synthetic Construct
  source 1..22: mol_type = other DNA
cccctcgaggctgttttagtga

SEQ ID NO: 11914 - DNA, 20 bp, synthetic construct
  misc_feature 1..20: note = Synthetic Construct
  source 1..20: mol_type = other DNA
ccagtgtcagggccgagtag

SEQ ID NO: 11915 - DNA, 20 bp, synthetic construct
  misc_feature 1..20: note = Synthetic Construct
  source 1..20: mol_type = other DNA
tgctgctttacgcccagtga

SEQ ID NO: 11916 - DNA, 20 bp, synthetic construct
  misc_feature 1..20: note = Synthetic Construct
  source 1..20: mol_type = other DNA
gaccaatggggtgtcagctt

SEQ ID NO: 11917 - DNA, 21 bp, synthetic construct
  misc_feature 1..21: note = Synthetic Construct
  source 1..21: mol_type = other DNA
aggctatgggaggtgggaaca

SEQ ID NO: 11918 - DNA, 25 bp, synthetic construct
  misc_feature 1..25: note = Synthetic Construct
  source 1..25: mol_type = other DNA
ctgtgtatgtgggtctgaagctcaa

SEQ ID NO: 11919 - DNA, 20 bp, synthetic construct
  misc_feature 1..20: note = Synthetic Construct
  source 1..20: mol_type = other DNA
ggggctcagatcccttggtt

SEQ ID NO: 11920 - DNA, 22 bp, synthetic construct
  misc_feature 1..22: note = Synthetic Construct
  source 1..22: mol_type = other DNA
agcatccgtggaggcttttaat

SEQ ID NO: 11921 - DNA, 24 bp, synthetic construct
  misc_feature 1..24: note = Synthetic Construct
  source 1..24: mol_type = other DNA
acgatttctgaagcagtcttggta

SEQ ID NO: 11922 - DNA, 21 bp, synthetic construct
  misc_feature 1..21: note = Synthetic Construct
  source 1..21: mol_type = other DNA
gggcattagctggccttcaca

SEQ ID NO: 11923 - DNA, 21 bp, synthetic construct
  misc_feature 1..21: note = Synthetic Construct
  source 1..21: mol_type = other DNA
tcccacttacaggcccgttct

SEQ ID NO: 11924 - DNA, 23 bp, synthetic construct
  misc_feature 1..23: note = Synthetic Construct
  source 1..23: mol_type = other DNA
tttcagaagtgctggaaccaaga

SEQ ID NO: 11925 - DNA, 22 bp, synthetic construct
  misc_feature 1..22: note = Synthetic Construct
  source 1..22: mol_type = other DNA
catgaaagcactggggttctct

SEQ ID NO: 11926 - DNA, 25 bp, synthetic construct
  misc_feature 1..25: note = Synthetic Construct
  source 1..25: mol_type = other DNA
cgagagaggaagacactggagtgaa

SEQ ID NO: 11927 - DNA, 27 bp, synthetic construct
  misc_feature 1..27: note = Synthetic Construct
  source 1..27: mol_type = other DNA
ccttcctccacactaagtgactggaaa

SEQ ID NO: 11928 - DNA, 19 bp, synthetic construct
  misc_feature 1..19: note = Synthetic Construct
  source 1..19: mol_type = other DNA
cagcccatcctgggcatct

SEQ ID NO: 11929 - DNA, 20 bp, synthetic construct
  misc_feature 1..20: note = Synthetic Construct
  source 1..20: mol_type = other DNA
aggctggcaaatgggctcaa

SEQ ID NO: 11930 - DNA, 18 bp, synthetic construct
  misc_feature 1..18: note = Synthetic Construct
  source 1..18: mol_type = other DNA
gctgagcccagcagtgtt

SEQ ID NO: 11931 - DNA, 24 bp, synthetic construct
  misc_feature 1..24: note = Synthetic Construct
  source 1..24: mol_type = other DNA
cctggctgggctacatcttacctt

SEQ ID NO: 11932 - DNA, 22 bp, synthetic construct
  misc_feature 1..22: note = Synthetic Construct
  source 1..22: mol_type = other DNA
gcatggggacctgagactttct

SEQ ID NO: 11933 - DNA, 21 bp, synthetic construct
  misc_feature 1..21: note = Synthetic Construct
  source 1..21: mol_type = other DNA
gggccgatgagcaagtcagtt

SEQ ID NO: 11934 - DNA, 24 bp, synthetic construct
  misc_feature 1..24: note = Synthetic Construct
  source 1..24: mol_type = other DNA
cctccccgaaaggaaacagagcat

SEQ ID NO: 11935 - DNA, 22 bp, synthetic construct
  misc_feature 1..22: note = Synthetic Construct
  source 1..22: mol_type = other DNA
tggatggtgagaagagccaatg

SEQ ID NO: 11936 - DNA, 20 bp, synthetic construct
  misc_feature 1..20: note = Synthetic Construct
  source 1..20: mol_type = other DNA
gcctggtcaccatccgcttt

SEQ ID NO: 11937 - DNA, 22 bp, synthetic construct
  misc_feature 1..22: note = Synthetic Construct
  source 1..22: mol_type = other DNA
gacactcacaggctcagagaac

SEQ ID NO: 11938 - DNA, 20 bp, synthetic construct
  misc_feature 1..20: note = Synthetic Construct
  source 1..20: mol_type = other DNA
tgagcactcctgggtcaaga

SEQ ID NO: 11939 - DNA, 21 bp, synthetic construct
  misc_feature 1..21: note = Synthetic Construct
  source 1..21: mol_type = other DNA
cttggctcgattggtccaaca

SEQ ID NO: 11940 - DNA, 20 bp, synthetic construct
  misc_feature 1..20: note = Synthetic Construct
  source 1..20: mol_type = other DNA
ccagagcagccaggtcttca

SEQ ID NO: 11941 - DNA, 20 bp, synthetic construct
  misc_feature 1..20: note = Synthetic Construct
  source 1..20: mol_type = other DNA
tctcctcgcccaagatcaga

SEQ ID NO: 11942 - DNA, 24 bp, synthetic construct
  misc_feature 1..24: note = Synthetic Construct
  source 1..24: mol_type = other DNA
cctcagcccaggactcacttttag

SEQ ID NO: 11943 - DNA, 19 bp, synthetic construct
  misc_feature 1..19: note = Synthetic Construct
  source 1..19: mol_type = other DNA
tccatgacgggcagctgta

SEQ ID NO: 11944 - DNA, 22 bp, synthetic construct
  misc_feature 1..22: note = Synthetic Construct
  source 1..22: mol_type = other DNA
caccctgggatcaagtccaagt

SEQ ID NO: 11945 - DNA, 20 bp, synthetic construct
  misc_feature 1..20: note = Synthetic Construct
  source 1..20: mol_type = other DNA
tgcatgctgggacacagaga

SEQ ID NO: 11946 - DNA, 20 bp, synthetic construct
  misc_feature 1..20: note = Synthetic Construct
  source 1..20: mol_type = other DNA
aggggctgctggggcttgta

SEQ ID NO: 11947 - DNA, 22 bp, synthetic construct
  misc_feature 1..22: note = Synthetic Construct
  source 1..22: mol_type = other DNA
gcgctgcctagtgacattggtt

SEQ ID NO: 11948 - DNA, 22 bp, synthetic construct
  misc_feature 1..22: note = Synthetic Construct
  source 1..22: mol_type = other DNA
tggtggtggtccccagtaatgt

SEQ ID NO: 11949 - DNA, 21 bp, synthetic construct
  misc_feature 1..21: note = Synthetic Construct
  source 1..21: mol_type = other DNA
ccctggtgggttttgagtgaa

SEQ ID NO: 11950 - DNA, 21 bp, synthetic construct
  misc_feature 1..21: note = Synthetic Construct
  source 1..21: mol_type = other DNA
cccacttagagccccaggaaa

SEQ ID NO: 11951 - DNA, 20 bp, synthetic construct
  misc_feature 1..20: note = Synthetic Construct
  source 1..20: mol_type = other DNA
cgatcggctttgcaggcttt

SEQ ID NO: 11952 - DNA, 22 bp, synthetic construct
  misc_feature 1..22: note = Synthetic Construct
  source 1..22: mol_type = other DNA
aaccagatcgtgtctccctagt

SEQ ID NO: 11953 - DNA, 21 bp, synthetic construct
  misc_feature 1..21: note = Synthetic Construct
  source 1..21: mol_type = other DNA
ccaacagcgtgaggcttctga

SEQ ID NO: 11954 - DNA, 23 bp, synthetic construct
  misc_feature 1..23: note = Synthetic Construct
  source 1..23: mol_type = other DNA
gcctggaacacactgtactctga

SEQ ID NO: 11955 - DNA, 18 bp, synthetic construct
  misc_feature 1..18: note = Synthetic Construct
  source 1..18: mol_type = other DNA
tcctgcccgtctgctcaa

SEQ ID NO: 11956 - DNA, 24 bp, synthetic construct
  misc_feature 1..24: note = Synthetic Construct
  source 1..24: mol_type = other DNA
tgaaaccagaagctttcacctcat

SEQ ID NO: 11957 - DNA, 22 bp, synthetic construct
  misc_feature 1..22: note = Synthetic Construct
  source 1..22: mol_type = other DNA
agtcagggtgtctcttccatga

SEQ ID NO: 11958 - DNA, 24 bp, synthetic construct
  misc_feature 1..24: note = Synthetic Construct
  source 1..24: mol_type = other DNA
gagcaaaagagctgttccagagaa

SEQ ID NO: 11959 - DNA, 24 bp, synthetic construct
  misc_feature 1..24: note = Synthetic Construct
  source 1..24: mol_type = other DNA
ccttctacacaggatgggatgagt

SEQ ID NO: 11960 - DNA, 21 bp, synthetic construct
  misc_feature 1..21: note = Synthetic Construct
  source 1..21: mol_type = other DNA
tgaagggttcccctccaaagt

SEQ ID NO: 11961 - DNA, 23 bp, synthetic construct
  misc_feature 1..23: note = Synthetic Construct
  source 1..23: mol_type = other DNA
gcctacatgtctatcccctgaag

SEQ ID NO: 11962 - DNA, 21 bp, synthetic construct
  misc_feature 1..21: note = Synthetic Construct
  source 1..21: mol_type = other DNA
gctggaaaccatggcggagtt

SEQ ID NO: 11963 - DNA, 20 bp, synthetic construct
  misc_feature 1..20: note = Synthetic Construct
  source 1..20: mol_type = other DNA
gggccagtacccaggaggaa

SEQ ID NO: 11964 - DNA, 21 bp, synthetic construct
  misc_feature 1..21: note = Synthetic Construct
  source 1..21: mol_type = other DNA
cacagggatgagcaccaccat

SEQ ID NO: 11965 - DNA, 23 bp, synthetic construct
  misc_feature 1..23: note = Synthetic Construct
  source 1..23: mol_type = other DNA
tggcagagttgtcaggatttcaa

SEQ ID NO: 11966 - DNA, 20 bp, synthetic construct
  misc_feature 1..20: note = Synthetic Construct
  source 1..20: mol_type = other DNA
aggcgagtgtcccaagacaa

SEQ ID NO: 11967 - DNA, 24 bp, synthetic construct
  misc_feature 1..24: note = Synthetic Construct
  source 1..24: mol_type = other DNA
gtgaaccagggacatctggacaag

SEQ ID NO: 11968 - DNA, 21 bp, synthetic construct
  misc_feature 1..21: note = Synthetic Construct
  source 1..21: mol_type = other DNA
tcaggcacaggccaggtatag

SEQ ID NO: 11969 - DNA, 21 bp, synthetic construct
  misc_feature 1..21: note = Synthetic Construct
  source 1..21: mol_type = other DNA
ccggacgcagacggaattact

SEQ ID NO: 11970 - DNA, 20 bp, synthetic construct
  misc_feature 1..20: note = Synthetic Construct
  source 1..20: mol_type = other DNA
ggcagtttggggagctgtgt

SEQ ID NO: 11971 - DNA, 20 bp, synthetic construct
  misc_feature 1..20: note = Synthetic Construct
  source 1..20: mol_type = other DNA
ctgacatttgcgggctgttg

SEQ ID NO: 11972 - DNA, 22 bp, synthetic construct
  misc_feature 1..22: note = Synthetic Construct
  source 1..22: mol_type = other DNA
cttcatgggacccaagcctatg

SEQ ID NO: 11973 - DNA, 20 bp, synthetic construct
  misc_feature 1..20: note = Synthetic Construct
  source 1..20: mol_type = other DNA
ctggctggacccttcctgat

SEQ ID NO: 11974 - DNA, 18 bp, synthetic construct
  misc_feature 1..18: note = Synthetic Construct
  source 1..18: mol_type = other DNA
ggcccttggctgtgtgaa

SEQ ID NO: 11975 - DNA, 22 bp, synthetic construct
  misc_feature 1..22: note = Synthetic Construct
  source 1..22: mol_type = other DNA
ttcctcgtggaccctactgtgt

SEQ ID NO: 11976 - DNA, 22 bp, synthetic construct
  misc_feature 1..22: note = Synthetic Construct
  source 1..22: mol_type = other DNA
cgttggctcctaaagtcagcta

SEQ ID NO: 11977 - DNA, 22 bp, synthetic construct
  misc_feature 1..22: note = Synthetic Construct
  source 1..22: mol_type = other DNA
gtgtaagggcggctctaactga

SEQ ID NO: 11978 - DNA, 20 bp, synthetic construct
  misc_feature 1..20: note = Synthetic Construct
  source 1..20: mol_type = other DNA
atcagaggagggcggaccaa

SEQ ID NO: 11979 - DNA, 23 bp, synthetic construct
  misc_feature 1..23: note = Synthetic Construct
  source 1..23: mol_type = other DNA
ggagaccatgggaacccttcaac

SEQ ID NO: 11980 - DNA, 22 bp, synthetic construct
  misc_feature 1..22: note = Synthetic Construct
  source 1..22: mol_type = other DNA
ggtcctgtcgttgaggtagtca

SEQ ID NO: 11981 - DNA, 20 bp, synthetic construct
  misc_feature 1..20: note = Synthetic Construct
  source 1..20: mol_type = other DNA
gggctagcaaacacccaagt

SEQ ID NO: 11982 - DNA, 22 bp, synthetic construct
  misc_feature 1..22: note = Synthetic Construct
  source 1..22: mol_type = other DNA
gccaaatgaacctggccctgta

SEQ ID NO: 11983 - DNA, 21 bp, synthetic construct
  misc_feature 1..21: note = Synthetic Construct
  source 1..21: mol_type = other DNA
gccacaaaggcccactacaga

SEQ ID NO: 11984 - DNA, 22 bp, synthetic construct
  misc_feature 1..22: note = Synthetic Construct
  source 1..22: mol_type = other DNA
gtcttccaggtcagcaatccaa

SEQ ID NO: 11985 - DNA, 23 bp, synthetic construct
  misc_feature 1..23: note = Synthetic Construct
  source 1..23: mol_type = other DNA
catgcccagcaattgtcccttag

SEQ ID NO: 11986 - DNA, 22 bp, synthetic construct
  misc_feature 1..22: note = Synthetic Construct
  source 1..22: mol_type = other DNA
gcagtcttggcagagctttact

SEQ ID NO: 11987 - DNA, 22 bp, synthetic construct
  misc_feature 1..22: note = Synthetic Construct
  source 1..22: mol_type = other DNA
gaagagtcagtggccttgaaga

SEQ ID NO: 11988 - DNA, 25 bp, synthetic construct
  misc_feature 1..25: note = Synthetic Construct
  source 1..25: mol_type = other DNA
gtggtgtatgttgtagtcccagcta

SEQ ID NO: 11989 - DNA, 24 bp, synthetic construct
  misc_feature 1..24: note = Synthetic Construct
  source 1..24: mol_type = other DNA
gtggggtagtggtaaagtaagcat

SEQ ID NO: 11990 - DNA, 22 bp, synthetic construct
  misc_feature 1..22: note = Synthetic Construct
  source 1..22: mol_type = other DNA
gggtccctgctccatctcattt

SEQ ID NO: 11991 - DNA, 20 bp, synthetic construct
  misc_feature 1..20: note = Synthetic Construct
  source 1..20: mol_type = other DNA
agggccctcccgcaattaga

SEQ ID NO: 11992 - DNA, 22 bp, synthetic construct
  misc_feature 1..22: note = Synthetic Construct
  source 1..22: mol_type = other DNA
cctgaggtcttggcccacaata

SEQ ID NO: 11993 - DNA, 20 bp, synthetic construct
  misc_feature 1..20: note = Synthetic Construct
  source 1..20: mol_type = other DNA
ttcagcgggaaccaccatgt

SEQ ID NO: 11994 - DNA, 29 bp, synthetic construct
  misc_feature 1..29: note = Synthetic Construct
  source 1..29: mol_type = other DNA
ctgacttcctagtcttcccttctatgaaa

SEQ ID NO: 11995 - DNA, 23 bp, synthetic construct
  misc_feature 1..23: note = Synthetic Construct
  source 1..23: mol_type = other DNA
ggtttacaggttagggcatggat

SEQ ID NO: 11996 - DNA, 22 bp, synthetic construct
  misc_feature 1..22: note = Synthetic Construct
  source 1..22: mol_type = other DNA
aggaccggaggactgctctatt

SEQ ID NO: 11997 - DNA, 22 bp, synthetic construct
  misc_feature 1..22: note = Synthetic Construct
  source 1..22: mol_type = other DNA
aagggcagcgtatccctctaca

SEQ ID NO: 11998 - DNA, 23 bp, synthetic construct
  misc_feature 1..23: note = Synthetic Construct
  source 1..23: mol_type = other DNA
gtggcccagtttttgctcagaga

SEQ ID NO: 11999 - DNA, 26 bp, synthetic construct
  misc_feature 1..26: note = Synthetic Construct
  source 1..26: mol_type = other DNA
ggtgcaggatttttctcgacctcttt

SEQ ID NO: 12000 - DNA, 22 bp, synthetic construct
  misc_feature 1..22: note = Synthetic Construct
  source 1..22: mol_type = other DNA
tctctgtgtctcctcaccagtt

SEQ ID NO: 12001 - DNA, 22 bp, synthetic construct
  misc_feature 1..22: note = Synthetic Construct
  source 1..22: mol_type = other DNA
ccaactggtccctgcattcttg

SEQ ID NO: 12002 - DNA, 23 bp, synthetic construct
  misc_feature 1..23: note = Synthetic Construct
  source 1..23: mol_type = other DNA
gtgtgaggatcctgcagcattta

SEQ ID NO: 12003 - DNA, 21 bp, synthetic construct
  misc_feature 1..21: note = Synthetic Construct
  source 1..21: mol_type = other DNA
agtccctcagctcagcccata

SEQ ID NO: 12004 - DNA, 23 bp, synthetic construct
  misc_feature 1..23: note = Synthetic Construct
  source 1..23: mol_type = other DNA
gccaaggggtaaccctaaaggta

SEQ ID NO: 12005 - DNA, 20 bp, synthetic construct
  misc_feature 1..20: note = Synthetic Construct
  source 1..20: mol_type = other DNA
ggttggaaggtgacgctaca

SEQ ID NO: 12006 - DNA, 19 bp, synthetic construct
  misc_feature 1..19: note = Synthetic Construct
  source 1..19: mol_type = other DNA
cctgcacttgcccggttct

SEQ ID NO: 12007 - DNA, 23 bp, synthetic construct
  misc_feature 1..23: note = Synthetic Construct
  source 1..23: mol_type = other DNA
gctccaagaagtgcatccaggtt

SEQ ID NO: 12008 - DNA, 21 bp, synthetic construct
  misc_feature 1..21: note = Synthetic Construct
  source 1..21: mol_type = other DNA
gtgctgggtcacactcaaact

SEQ ID NO: 12009 - DNA, 21 bp, synthetic construct
  misc_feature 1..21: note = Synthetic Construct
  source 1..21: mol_type = other DNA
tgtcgtccccactgtggaact

SEQ ID NO: 12010 - DNA, 21 bp, synthetic construct
  misc_feature 1..21: note = Synthetic Construct
  source 1..21: mol_type = other DNA
ccccaggcaactcacttcaca

SEQ ID NO: 12011 - DNA, 20 bp, synthetic construct
  misc_feature 1..20: note = Synthetic Construct
  source 1..20: mol_type = other DNA
agagtagacgcgccctggaa

SEQ ID NO: 12012 - DNA, 21 bp, synthetic construct
  misc_feature 1..21: note = Synthetic Construct
  source 1..21: mol_type = other DNA
gctagcaggacttgggcaaca

SEQ ID NO: 12013 - DNA, 23 bp, synthetic construct
  misc_feature 1..23: note = Synthetic Construct
  source 1..23: mol_type = other DNA
ctgaaccagctcggacagagaag

SEQ ID NO: 12014 - DNA, 22 bp, synthetic construct
  misc_feature 1..22: note = Synthetic Construct
  source 1..22: mol_type = other DNA
caccacgttgatgcagagtttc

SEQ ID NO: 12015 - DNA, 23 bp, synthetic construct
  misc_feature 1..23: note = Synthetic Construct
  source 1..23: mol_type = other DNA
ccaagtgcagaagctggaaaaca

SEQ ID NO: 12016 - DNA, 24 bp, synthetic construct
  misc_feature 1..24: note = Synthetic Construct
  source 1..24: mol_type = other DNA
gaccaggccctttgattgttctgt

SEQ ID NO: 12017 - DNA, 22 bp, synthetic construct
  misc_feature 1..22: note = Synthetic Construct
  source 1..22: mol_type = other DNA
taagtccccgtgctcacagcat

SEQ ID NO: 12018 - DNA, 25 bp, synthetic construct
  misc_feature 1..25: note = Synthetic Construct
  source 1..25: mol_type = other DNA
gctccatcctgtgaatgaagtaagt

SEQ ID NO: 12019 - DNA, 24 bp, synthetic construct
  misc_feature 1..24: note = Synthetic Construct
  source 1..24: mol_type = other DNA
gggatccatcaccgttccaaacat

SEQ ID NO: 12020 - DNA, 19 bp, synthetic construct
  misc_feature 1..19: note = Synthetic Construct
  source 1..19: mol_type = other DNA
ggagagtccagggcgtctt

SEQ ID NO: 12021 - DNA, 22 bp, synthetic construct
  misc_feature 1..22: note = Synthetic Construct
  source 1..22: mol_type = other DNA
cttcacagtgcctgggacattt

SEQ ID NO: 12022 - DNA, 23 bp, synthetic construct
  misc_feature 1..23: note = Synthetic Construct
  source 1..23: mol_type = other DNA
tccaggatggggaaggacctaag

SEQ ID NO: 12023 - DNA, 24 bp, synthetic construct
  misc_feature 1..24: note = Synthetic Construct
  source 1..24: mol_type = other DNA
ctaagctcaaagtcaagggacaga

SEQ ID NO: 12024 - DNA, 25 bp, synthetic construct
  misc_feature 1..25: note = Synthetic Construct
  source 1..25: mol_type = other DNA
gagaagaaagtcgccctgaaaatac

SEQ ID NO: 12025 - DNA, 20 bp, synthetic construct
  misc_feature 1..20: note = Synthetic Construct
  source 1..20: mol_type = other DNA
gtgctttcccacagcgaatc

SEQ ID NO: 12026 - DNA, 20 bp, synthetic construct
  misc_feature 1..20: note = Synthetic Construct
  source 1..20: mol_type = other DNA
ggtgctgcagagggtggaaa

SEQ ID NO: 12027 - DNA, 20 bp, synthetic construct
  misc_feature 1..20: note = Synthetic Construct
  source 1..20: mol_type = other DNA
aactaccctcccacccaaca

SEQ ID NO: 12028 - DNA, 28 bp, synthetic construct
  misc_feature 1..28: note = Synthetic Construct
  source 1..28: mol_type = other DNA
gttgggtggacagtctttttcatctttg

SEQ ID NO: 12029 - DNA, 23 bp, synthetic construct
  misc_feature 1..23: note = Synthetic Construct
  source 1..23: mol_type = other DNA
gtgctctcccttgaaatgaggat

SEQ ID NO: 12030 - DNA, 21 bp, synthetic construct
  misc_feature 1..21: note = Synthetic Construct
  source 1..21: mol_type = other DNA
gatggtggaaaccgaccaact

SEQ ID NO: 12031 - DNA, 18 bp, synthetic construct
  misc_feature 1..18: note = Synthetic Construct
  source 1..18: mol_type = other DNA
tgcagggtggcagcatga

SEQ ID NO: 12032 - DNA, 24 bp, synthetic construct
  misc_feature 1..24: note = Synthetic Construct
  source 1..24: mol_type = other DNA
gccctctgacttcactgacctact

SEQ ID NO: 12033 - DNA, 21 bp, synthetic construct
  misc_feature 1..21: note = Synthetic Construct
  source 1..21: mol_type = other DNA
tggggttgaggtccccttatg

SEQ ID NO: 12034 - DNA, 22 bp, synthetic construct
  misc_feature 1..22: note = Synthetic Construct
  source 1..22: mol_type = other DNA
ccccttcatctgccctggtagt

SEQ ID NO: 12035 - DNA, 22 bp, synthetic construct
  misc_feature 1..22: note = Synthetic Construct
  source 1..22: mol_type = other DNA
cctctgcaccttggcctacatt

SEQ ID NO: 12036 - DNA, 21 bp, synthetic construct
  misc_feature 1..21: note = Synthetic Construct
  source 1..21: mol_type = other DNA
ggcggaaaccaaaccctcaga

SEQ ID NO: 12037 - DNA, 20 bp, synthetic construct
  misc_feature 1..20: note = Synthetic Construct
  source 1..20: mol_type = other DNA
gggcccctcccacatacaca

SEQ ID NO: 12038 - DNA, 22 bp, synthetic construct
  misc_feature 1..22: note = Synthetic Construct
  source 1..22: mol_type = other DNA
gcccatgctgaggactaacctt

SEQ ID NO: 12039 - DNA, 21 bp, synthetic construct
  misc_feature 1..21: note = Synthetic Construct
  source 1..21: mol_type = other DNA
ccctaaggttgggtcgagttg

SEQ ID NO: 12040 - DNA, 21 bp, synthetic construct
  misc_feature 1..21: note = Synthetic Construct
  source 1..21: mol_type = other DNA
cagggtcccaacgggtttcta

SEQ ID NO: 12041 - DNA, 21 bp, synthetic construct
  misc_feature 1..21: note = Synthetic Construct
  source 1..21: mol_type = other DNA
gccccagcattcacactgcat

SEQ ID NO: 12042 - DNA, 21 bp, synthetic construct
  misc_feature 1..21: note = Synthetic Construct
  source 1..21: mol_type = other DNA
gcaagtagctgggccttgtca

SEQ ID NO: 12043 - DNA, 22 bp, synthetic construct
  misc_feature 1..22: note = Synthetic Construct
  source 1..22: mol_type = other DNA
gcaccatcaggagatgcagact

SEQ ID NO: 12044 - DNA, 25 bp, synthetic construct
  misc_feature 1..25: note = Synthetic Construct
  source 1..25: mol_type = other DNA
ctctgtcagtttctgagtgggatga

SEQ ID NO: 12045 - DNA, 21 bp, synthetic construct
  misc_feature 1..21: note = Synthetic Construct
  source 1..21: mol_type = other DNA
gaggcctcactctccccttat

SEQ ID NO: 12046 - DNA, 23 bp, synthetic construct
  misc_feature 1..23: note = Synthetic Construct
  source 1..23: mol_type = other DNA
tcatgctgcttgggtaatgttct

SEQ ID NO: 12047 - DNA, 19 bp, synthetic construct
  misc_feature 1..19: note = Synthetic Construct
  source 1..19: mol_type = other DNA
ctgggccatcctcctgtct

SEQ ID NO: 12048 - DNA, 20 bp, synthetic construct
  misc_feature 1..20: note = Synthetic Construct
  source 1..20: mol_type = other DNA
tggagagtggggaggagctt

SEQ ID NO: 12049 - DNA, 21 bp, synthetic construct
  misc_feature 1..21: note = Synthetic Construct
  source 1..21: mol_type = other DNA
ggagcatgccgccttgttact

SEQ ID NO: 12050 - DNA, 24 bp, synthetic construct
  misc_feature 1..24: note = Synthetic Construct
  source 1..24: mol_type = other DNA
gtctcttccctgaagtagggttgt

SEQ ID NO: 12051 - DNA, 24 bp, synthetic construct
  misc_feature 1..24: note = Synthetic Construct
  source 1..24: mol_type = other DNA
tcactcacatcatcatggttggat

SEQ ID NO: 12052 - DNA, 20 bp, synthetic construct
  misc_feature 1..20: note = Synthetic Construct
  source 1..20: mol_type = other DNA
ggagcagcattgccttcgtt

SEQ ID NO: 12053 - DNA, 20 bp, synthetic construct
  misc_feature 1..20: note = Synthetic Construct
  source 1..20: mol_type = other DNA
gcctcgcatcacgcagtttt

SEQ ID NO: 12054 - DNA, 26 bp, synthetic construct
  misc_feature 1..26: note = Synthetic Construct
  source 1..26: mol_type = other DNA
cccgtttgaagaaatgatagctcgaa

SEQ ID NO: 12055 - DNA, 20 bp, synthetic construct
  misc_feature 1..20: note = Synthetic Construct
  source 1..20: mol_type = other DNA
gggtgctgttctggctttga

SEQ ID NO: 12056 - DNA, 21 bp, synthetic construct
  misc_feature 1..21: note = Synthetic Construct
  source 1..21: mol_type = other DNA
ggctgtggttgttgacagagt

SEQ ID NO: 12057 - DNA, 23 bp, synthetic construct
  misc_feature 1..23: note = Synthetic Construct
  source 1..23: mol_type = other DNA
ccctgtggaacaaagtgggaact

SEQ ID NO: 12058 - DNA, 22 bp, synthetic construct
  misc_feature 1..22: note = Synthetic Construct
  source 1..22: mol_type = other DNA
gcaaaggcttgtctgacagtga

SEQ ID NO: 12059 - DNA, 24 bp, synthetic construct
  misc_feature 1..24: note = Synthetic Construct
  source 1..24: mol_type = other DNA
caagaggaccttcggaaactttga

SEQ ID NO: 12060 - DNA, 20 bp, synthetic construct
  misc_feature 1..20: note = Synthetic Construct
  source 1..20: mol_type = other DNA
aggcacacgcaggtctcatc

SEQ ID NO: 12061 - DNA, 25 bp, synthetic construct
  misc_feature 1..25: note = Synthetic Construct
  source 1..25: mol_type = other DNA
gtgtagaggggcaactcctatcttg

SEQ ID NO: 12062 - DNA, 27 bp, synthetic construct
  misc_feature 1..27: note = Synthetic Construct
  source 1..27: mol_type = other DNA
cagactacaaaggtgtttgctgtttgt

SEQ ID NO: 12063 - DNA, 20 bp, synthetic construct
  misc_feature 1..20: note = Synthetic Construct
  source 1..20: mol_type = other DNA
ctgcgttgtgcctactctgt

SEQ ID NO: 12064 - DNA, 20 bp, synthetic construct
  misc_feature 1..20: note = Synthetic Construct
  source 1..20: mol_type = other DNA
ggtgtccccgcacttagcat

SEQ ID NO: 12065 - DNA, 23 bp, synthetic construct
  misc_feature 1..23: note = Synthetic Construct
  source 1..23: mol_type = other DNA
gtgaagccagacagcagtaatca

SEQ ID NO: 12066 - DNA, 23 bp, synthetic construct
  misc_feature 1..23: note = Synthetic Construct
  source 1..23: mol_type = other DNA
ggagggtgaacaaggcaaagatg

SEQ ID NO: 12067 - DNA, 22 bp, synthetic construct
  misc_feature 1..22: note = Synthetic Construct
  source 1..22: mol_type = other DNA
acctgcaggagctagttagaga

SEQ ID NO: 12068 - DNA, 21 bp, synthetic construct
  misc_feature 1..21: note = Synthetic Construct
  source 1..21: mol_type = other DNA
gctttcagtccccacttgtga

SEQ ID NO: 12069 - DNA, 22 bp, synthetic construct
  misc_feature 1..22: note = Synthetic Construct
  source 1..22: mol_type = other DNA
gtgaggcaggaaggatgagttt

SEQ ID NO: 12070 - DNA, 24 bp, synthetic construct
  misc_feature 1..24: note = Synthetic Construct
  source 1..24: mol_type = other DNA
gagctttggagacagtggggtaac

SEQ ID NO: 12071 - DNA, 22 bp, synthetic construct
  misc_feature 1..22: note = Synthetic Construct
  source 1..22: mol_type = other DNA
ccagcatcaggtcacaatgaac

SEQ ID NO: 12072 - DNA, 20 bp, synthetic construct
  misc_feature 1..20: note = Synthetic Construct
  source 1..20: mol_type = other DNA
actgagggcggcattgctta

SEQ ID NO: 12073 - DNA, 20 bp, synthetic construct
  misc_feature 1..20: note = Synthetic Construct
  source 1..20: mol_type = other DNA
gcggcaaggagggtttctaa

SEQ ID NO: 12074 - DNA, 25 bp, synthetic construct
  misc_feature 1..25: note = Synthetic Construct
  source 1..25: mol_type = other DNA
tcagagttctgtcctaatggaggaa

SEQ ID NO: 12075 - DNA, 26 bp, synthetic construct
  misc_feature 1..26: note = Synthetic Construct
  source 1..26: mol_type = other DNA
cactagtctggaaaaaccagcaccaa

SEQ ID NO: 12076 - DNA, 24 bp, synthetic construct
  misc_feature 1..24: note = Synthetic Construct
  source 1..24: mol_type = other DNA
aatcctggaacactcttgcctaaa

SEQ ID NO: 12077 - DNA, 26 bp, synthetic construct
  misc_feature 1..26: note = Synthetic Construct
  source 1..26: mol_type = other DNA
gtgtgagctagttccttctgctcttc

SEQ ID NO: 12078 - DNA, 22 bp, synthetic construct
  misc_feature 1..22: note = Synthetic Construct
  source 1..22: mol_type = other DNA
caactgcagcgtgctgatttta

SEQ ID NO: 12079 - DNA, 21 bp, synthetic construct
  misc_feature 1..21: note = Synthetic Construct
  source 1..21: mol_type = other DNA
aatcggccacagccccagaga

SEQ ID NO: 12080 - DNA, 24 bp, synthetic construct
  misc_feature 1..24: note = Synthetic Construct
  source 1..24: mol_type = other DNA
ggatcttctgaacaccacatcctt

SEQ ID NO: 12081 - DNA, 22 bp, synthetic construct
  misc_feature 1..22: note = Synthetic Construct
  source 1..22: mol_type = other DNA
atccagttccctgggtgactct

SEQ ID NO: 12082 - DNA, 25 bp, synthetic construct
  misc_feature 1..25: note = Synthetic Construct
  source 1..25: mol_type = other DNA
gttttctccaccaacacacctttct

SEQ ID NO: 12083 - DNA, 21 bp, synthetic construct
  misc_feature 1..21: note = Synthetic Construct
  source 1..21: mol_type = other DNA
aaggggactcggaggacaaga

SEQ ID NO: 12084 - DNA, 22 bp, synthetic construct
  misc_feature 1..22: note = Synthetic Construct
  source 1..22: mol_type = other DNA
gggccaatgtgtcctggtttgt

SEQ ID NO: 12085 - DNA, 21 bp, synthetic construct
  misc_feature 1..21: note = Synthetic Construct
  source 1..21: mol_type = other DNA
tgccatggcctttgcctatac

SEQ ID NO: 12086 - DNA, 24 bp, synthetic construct
  misc_feature 1..24: note = Synthetic Construct
  source 1..24: mol_type = other DNA
gctctcagggaaatcatccatttg

SEQ ID NO: 12087 - DNA, 24 bp, synthetic construct
  misc_feature 1..24: note = Synthetic Construct
  source 1..24: mol_type = other DNA
cctgggatttaccatgtcccataa

SEQ ID NO: 12088 - DNA, 21 bp, synthetic construct
  misc_feature 1..21: note = Synthetic Construct
  source 1..21: mol_type = other DNA
cgtgctccactttcctgacaa

SEQ ID NO: 12089 - DNA, 22 bp, synthetic construct
  misc_feature 1..22: note = Synthetic Construct
  source 1..22: mol_type = other DNA
cagggatgagccgctgtttcta

SEQ ID NO: 12090 - DNA, 21 bp, synthetic construct
  misc_feature 1..21: note = Synthetic Construct
  source 1..21: mol_type = other DNA
agatcttcggggctccagaca

SEQ ID NO: 12091 - DNA, 27 bp, synthetic construct
  misc_feature 1..27: note = Synthetic Construct
  source 1..27: mol_type = other DNA
gcatagtccacagtaggaaaaatgcaa

SEQ ID NO: 12092 - DNA, 21 bp, synthetic construct
  misc_feature 1..21: note = Synthetic Construct
  source 1..21: mol_type = other DNA
ggcagctgcaacagtatgtct

SEQ ID NO: 12093 - DNA, 24 bp, synthetic construct
  misc_feature 1..24: note = Synthetic Construct
  source 1..24: mol_type = other DNA
ggtctgtctgattccagctgatac

SEQ ID NO: 12094 - DNA, 27 bp, synthetic construct
  misc_feature 1..27: note = Synthetic Construct
  source 1..27: mol_type = other DNA
ctcagtgggcttagaataaacctgaat

SEQ ID NO: 12095 - DNA, 20 bp, synthetic construct
  misc_feature 1..20: note = Synthetic Construct
  source 1..20: mol_type = other DNA
ggaggtttggctgggtcttt

SEQ ID NO: 12096 - DNA, 20 bp, synthetic construct
  misc_feature 1..20: note = Synthetic Construct
  source 1..20: mol_type = other DNA
aggcgggtccccaggaaaca

SEQ ID NO: 12097 - DNA, 21 bp, synthetic construct
  misc_feature 1..21: note = Synthetic Construct
  source 1..21: mol_type = other DNA
acaaggggcctgactcagctt

SEQ ID NO: 12098 - DNA, 21 bp, synthetic construct
  misc_feature 1..21: note = Synthetic Construct
  source 1..21: mol_type = other DNA
cctggtgtgctctgccttgaa

SEQ ID NO: 12099 - DNA, 22 bp, synthetic construct
  misc_feature 1..22: note = Synthetic Construct
  source 1..22: mol_type = other DNA
cctcggtggacacttggtcttg

SEQ ID NO: 12100 - DNA, 27 bp, synthetic construct
  misc_feature 1..27: note = Synthetic Construct
  source 1..27: mol_type = other DNA
ggagataggaaaagtcatggagggtaa

SEQ ID NO: 12101 - DNA, 20 bp, synthetic construct
  misc_feature 1..20: note = Synthetic Construct
  source 1..20: mol_type = other DNA
agtctcatggcaggctgctt

SEQ ID NO: 12102 - DNA, 22 bp, synthetic construct
  misc_feature 1..22: note = Synthetic Construct
  source 1..22: mol_type = other DNA
agaacccctgcaccctctttct

SEQ ID NO: 12103 - DNA, 26 bp, synthetic construct
  misc_feature 1..26: note = Synthetic Construct
  source 1..26: mol_type = other DNA
ggccttaattgacaccgctaatcttg

SEQ ID NO: 12104 - DNA, 22 bp, synthetic construct
  misc_feature 1..22: note = Synthetic Construct
  source 1..22: mol_type = other DNA
ggagaggctaaggggaaacaga

SEQ ID NO: 12105 - DNA, 20 bp, synthetic construct
  misc_feature 1..20: note = Synthetic Construct
  source 1..20: mol_type = other DNA
atggtggtggctgtgcgatt

SEQ ID NO: 12106 - DNA, 22 bp, synthetic construct
  misc_feature 1..22: note = Synthetic Construct
  source 1..22: mol_type = other DNA
ttgggtcatagggccgagaatg

SEQ ID NO: 12107 - DNA, 20 bp, synthetic construct
  misc_feature 1..20: note = Synthetic Construct
  source 1..20: mol_type = other DNA
acacgaaagcggcgtcagaa

SEQ ID NO: 12108 - DNA, 22 bp, synthetic construct
  misc_feature 1..22: note = Synthetic Construct
  source 1..22: mol_type = other DNA
tgggcttctgggttctagatgt

SEQ ID NO: 12109 - DNA, 25 bp, synthetic construct
  misc_feature 1..25: note = Synthetic Construct
  source 1..25: mol_type = other DNA
ggaaaccatcccatgtctactgtgt

SEQ ID NO: 12110 - DNA, 22 bp, synthetic construct
  misc_feature 1..22: note = Synthetic Construct
  source 1..22: mol_type = other DNA
tcccacttactacgctccaaga

SEQ ID NO: 12111 - DNA, 21 bp, synthetic construct
  misc_feature 1..21: note = Synthetic Construct
  source 1..21: mol_type = other DNA
tcctgccctagctgtggcttt

SEQ ID NO: 12112 - DNA, 20 bp, synthetic construct
  misc_feature 1..20: note = Synthetic Construct
  source 1..20: mol_type = other DNA
ccgcaaatagccccagaact

SEQ ID NO: 12113 - DNA, 20 bp, synthetic construct
  misc_feature 1..20: note = Synthetic Construct
  source 1..20: mol_type = other DNA
tttggttagcggggctctct

SEQ ID NO: 12114 - DNA, 25 bp, synthetic construct
  misc_feature 1..25: note = Synthetic Construct
  source 1..25: mol_type = other DNA
ccaggataagaatgttggcctcctt

SEQ ID NO: 12115 - DNA, 23 bp, synthetic construct
  misc_feature 1..23: note = Synthetic Construct
  source 1..23: mol_type = other DNA
ctgttgcccgtgggattaaaatg

SEQ ID NO: 12116 - DNA, 22 bp, synthetic construct
  misc_feature 1..22: note = Synthetic Construct
  source 1..22: mol_type = other DNA
tgtgctacctggagagggtttc

SEQ ID NO: 12117 - DNA, 22 bp, synthetic construct
  misc_feature 1..22: note = Synthetic Construct
  source 1..22: mol_type = other DNA
cccttctgcagcatgtgcattt

SEQ ID NO: 12118 - DNA, 25 bp, synthetic construct
  misc_feature 1..25: note = Synthetic Construct
  source 1..25: mol_type = other DNA
gctaggaatgggaacattggcatct

SEQ ID NO: 12119 - DNA, 24 bp, synthetic construct
  misc_feature 1..24: note = Synthetic Construct
  source 1..24: mol_type = other DNA
gtctttacaagcaggccccatttg

SEQ ID NO: 12120 - DNA, 21 bp, synthetic construct
  misc_feature 1..21: note = Synthetic Construct
  source 1..21: mol_type = other DNA
agaccacctgcctaagaccaa

SEQ ID NO: 12121 - DNA, 19 bp, synthetic construct
  misc_feature 1..19: note = Synthetic Construct
  source 1..19: mol_type = other DNA
accccatccccaccagctt

SEQ ID NO: 12122 - DNA, 22 bp, synthetic construct
  misc_feature 1..22: note = Synthetic Construct
  source 1..22: mol_type = other DNA
gattggctcctgtgctctgagt

SEQ ID NO: 12123 - DNA, 22 bp, synthetic construct
  misc_feature 1..22: note = Synthetic Construct
  source 1..22: mol_type = other DNA
cctgcagggaaaacctgcaact

SEQ ID NO: 12124 - DNA, 23 bp, synthetic construct
  misc_feature 1..23: note = Synthetic Construct
  source 1..23: mol_type = other DNA
ctttacagcattgcctcctccta

SEQ ID NO: 12125 - DNA, 21 bp, synthetic construct
  misc_feature 1..21: note = Synthetic Construct
  source 1..21: mol_type = other DNA
ggccactagtctgggacaaag

SEQ ID NO: 12126 - DNA, 26 bp, synthetic construct
  misc_feature 1..26: note = Synthetic Construct
  source 1..26: mol_type = other DNA
gtaatgtcagtgcgtctaggtaaaga

SEQ ID NO: 12127 - DNA, 20 bp, synthetic construct
  misc_feature 1..20: note = Synthetic Construct
  source 1..20: mol_type = other DNA
ggagagggaatgctgcgaat

SEQ ID NO: 12128 - DNA, 19 bp, synthetic construct
  misc_feature 1..19: note = Synthetic Construct
  source 1..19: mol_type = other DNA
ggaggcacagcaggtctga

SEQ ID NO: 12129 - DNA, 23 bp, synthetic construct
  misc_feature 1..23: note = Synthetic Construct
  source 1..23: mol_type = other DNA
ggacaccaacgatgacacaaaat

SEQ ID NO: 12130 - DNA, 19 bp, synthetic construct
  misc_feature 1..19: note = Synthetic Construct
  source 1..19: mol_type = other DNA
agggagccggcatcctttg

SEQ ID NO: 12131 - DNA, 21 bp, synthetic construct
  misc_feature 1..21: note = Synthetic Construct
  source 1..21: mol_type = other DNA
tgccaagaggcttctcagttc

SEQ ID NO: 12132 - DNA, 22 bp, synthetic construct
  misc_feature 1..22: note = Synthetic Construct
  source 1..22: mol_type = other DNA
cctgggcagtaagctagcaatg

SEQ ID NO: 12133 - DNA, 20 bp, synthetic construct
  misc_feature 1..20: note = Synthetic Construct
  source 1..20: mol_type = other DNA
tcacccctcacctgcactct

SEQ ID NO: 12134 - DNA, 23 bp, synthetic construct
  misc_feature 1..23: note = Synthetic Construct
  source 1..23: mol_type = other DNA
gctgagaatccagagactgtgtt

SEQ ID NO: 12135 - DNA, 23 bp, synthetic construct
  misc_feature 1..23: note = Synthetic Construct
  source 1..23: mol_type = other DNA
ccacaccatacaagggatctcaa

SEQ ID NO: 12136 - DNA, 25 bp, synthetic construct
  misc_feature 1..25: note = Synthetic Construct
  source 1..25: mol_type = other DNA
agtggatgagaactatcatggcaaa

SEQ ID NO: 12137 - DNA, 21 bp, synthetic construct
  misc_feature 1..21: note = Synthetic Construct
  source 1..21: mol_type = other DNA
cttgaggcagttccgacttca

SEQ ID NO: 12138 - DNA, 22 bp, synthetic construct
  misc_feature 1..22: note = Synthetic Construct
  source 1..22: mol_type = other DNA
gccaagaacacgtcaggtctca

SEQ ID NO: 12139 - DNA, 25 bp, synthetic construct
  misc_feature 1..25: note = Synthetic Construct
  source 1..25: mol_type = other DNA
tttccactctcccttatttctgcaa

SEQ ID NO: 12140 - DNA, 24 bp, synthetic construct
  misc_feature 1..24: note = Synthetic Construct
  source 1..24: mol_type = other DNA
ccacagatgcaaagagagcacttc

SEQ ID NO: 12141 - DNA, 22 bp, synthetic construct
  misc_feature 1..22: note = Synthetic Construct
  source 1..22: mol_type = other DNA
gggagtgtctgtggtccagaat

SEQ ID NO: 12142 - DNA, 21 bp, synthetic construct
  misc_feature 1..21: note = Synthetic Construct
  source 1..21: mol_type = other DNA
ccaaagctgtttgcggctaga

SEQ ID NO: 12143 - DNA, 19 bp, synthetic construct
  misc_feature 1..19: note = Synthetic Construct
  source 1..19: mol_type = other DNA
gctgcggaggccagaaagt

SEQ ID NO: 12144 - DNA, 23 bp, synthetic construct
  misc_feature 1..23: note = Synthetic Construct
  source 1..23: mol_type = other DNA
ttgtagacaatggggccactaag

SEQ ID NO: 12145 - DNA, 23 bp, synthetic construct
  misc_feature 1..23: note = Synthetic Construct
  source 1..23: mol_type = other DNA
tgtgccagtgtgtaccttcattt

SEQ ID NO: 12146 - DNA, 26 bp, synthetic construct
  misc_feature 1..26: note = Synthetic Construct
  source 1..26: mol_type = other DNA
gggttcaggccagtagaatgacctat

SEQ ID NO: 12147 - DNA, 26 bp, synthetic construct
  misc_feature 1..26: note = Synthetic Construct
  source 1..26: mol_type = other DNA
ttgaggacaatagagaaggtctgttc

SEQ ID NO: 12148 - DNA, 25 bp, synthetic construct
  misc_feature 1..25: note = Synthetic Construct
  source 1..25: mol_type = other DNA
gctggatcctaagacaacactgtat

SEQ ID NO: 12149 - DNA, 20 bp, synthetic construct
  misc_feature 1..20: note = Synthetic Construct
  source 1..20: mol_type = other DNA
aggctggcatgttggagtca

SEQ ID NO: 12150 - DNA, 21 bp, synthetic construct
  misc_feature 1..21: note = Synthetic Construct
  source 1..21: mol_type = other DNA
tgtgagctgttcttgccatgt

SEQ ID NO: 12151 - DNA, 22 bp, synthetic construct
  misc_feature 1..22: note = Synthetic Construct
  source 1..22: mol_type = other DNA
gtgttacctggcgcctgaatgt

SEQ ID NO: 12152 - DNA, 22 bp, synthetic construct
  misc_feature 1..22: note = Synthetic Construct
  source 1..22: mol_type = other DNA
agctaagttttccaggcgatgt

SEQ ID NO: 12153 - DNA, 24 bp, synthetic construct
  misc_feature 1..24: note = Synthetic Construct
  source 1..24: mol_type = other DNA
gtgaaagagccatgataggtctga

SEQ ID NO: 12154 - DNA, 19 bp, synthetic construct
  misc_feature 1..19: note = Synthetic Construct
  source 1..19: mol_type = other DNA
gatgcccgcacctgctaga

SEQ ID NO: 12155 - DNA, 20 bp, synthetic construct
  misc_feature 1..20: note = Synthetic Construct
  source 1..20: mol_type = other DNA
tcgcccttgtggatccaagt

SEQ ID NO: 12156 - DNA, 19 bp, synthetic construct
  misc_feature 1..19: note = Synthetic Construct
  source 1..19: mol_type = other DNA
aggggacgtctcccaggtt

SEQ ID NO: 12157 - DNA, 18 bp, synthetic construct
  misc_feature 1..18: note = Synthetic Construct
  source 1..18: mol_type = other DNA
accctgcatcgggtctca

SEQ ID NO: 12158 - DNA, 21 bp, synthetic construct
  misc_feature 1..21: note = Synthetic Construct
  source 1..21: mol_type = other DNA
gtcctgttcccgcaaggttga

SEQ ID NO: 12159 - DNA, 24 bp, synthetic construct
  misc_feature 1..24: note = Synthetic Construct
  source 1..24: mol_type = other DNA
gtgttgttcctcttcccaaggaat

SEQ ID NO: 12160 - DNA, 24 bp, synthetic construct
  misc_feature 1..24: note = Synthetic Construct
  source 1..24: mol_type = other DNA
gtctcagagattccacagcctaca

SEQ ID NO: 12161 - DNA, 23 bp, synthetic construct
  misc_feature 1..23: note = Synthetic Construct
  source 1..23: mol_type = other DNA
acagatgccagatgcagaagaaa

SEQ ID NO: 12162 - DNA, 24 bp, synthetic construct
  misc_feature 1..24: note = Synthetic Construct
  source 1..24: mol_type = other DNA
ggctctgaggtcatctctgtatca

SEQ ID NO: 12163 - DNA, 20 bp, synthetic construct
  misc_feature 1..20: note = Synthetic Construct
  source 1..20: mol_type = other DNA
caagtccctcccagcaacaa

SEQ ID NO: 12164 - DNA, 22 bp, synthetic construct
  misc_feature 1..22: note = Synthetic Construct
  source 1..22: mol_type = other DNA
cgcctctgtcctctgtcacttt

SEQ ID NO: 12165 - DNA, 20 bp, synthetic construct
  misc_feature 1..20: note = Synthetic Construct
  source 1..20: mol_type = other DNA
ggataccaaccccgccagaa

SEQ ID NO: 12166 - DNA, 25 bp, synthetic construct
  misc_feature 1..25: note = Synthetic Construct
  source 1..25: mol_type = other DNA
ccatcatctggttatgctacagtct

SEQ ID NO: 12167 - DNA, 24 bp, synthetic construct
  misc_feature 1..24: note = Synthetic Construct
  source 1..24: mol_type = other DNA
cttgatgactccacttctccatca

SEQ ID NO: 12168 - DNA, 22 bp, synthetic construct
  misc_feature 1..22: note = Synthetic Construct
  source 1..22: mol_type = other DNA
gccaaggagtgaaccaggtttg

SEQ ID NO: 12169 - DNA, 22 bp, synthetic construct
  misc_feature 1..22: note = Synthetic Construct
  source 1..22: mol_type = other DNA
cgacctgtgttaggggttcagt

SEQ ID NO: 12170 - DNA, 19 bp, synthetic construct
  misc_feature 1..19: note = Synthetic Construct
  source 1..19: mol_type = other DNA
gtggcccagaaggctgctt

SEQ ID NO: 12171 - DNA, 25 bp, synthetic construct
  misc_feature 1..25: note = Synthetic Construct
  source 1..25: mol_type = other DNA
cacaggaggtcattaaggttcaaca

SEQ ID NO: 12172 - DNA, 24 bp, synthetic construct
  misc_feature 1..24: note = Synthetic Construct
  source 1..24: mol_type = other DNA
gcagacattgtatgtcggtgaaca

SEQ ID NO: 12173 - DNA, 18 bp, synthetic construct
  misc_feature 1..18: note = Synthetic Construct
  source 1..18: mol_type = other DNA
tgggttcgcacggctgtt

SEQ ID NO: 12174 - DNA, 22 bp, synthetic construct
  misc_feature 1..22: note = Synthetic Construct
  source 1..22: mol_type = other DNA
accaccacacctagctgcaaag

SEQ ID NO: 12175 - DNA, 19 bp, synthetic construct
  misc_feature 1..19: note = Synthetic Construct
  source 1..19: mol_type = other DNA
tgtccctggggccactgaa

SEQ ID NO: 12176 - DNA, 22 bp, synthetic construct
  misc_feature 1..22: note = Synthetic Construct
  source 1..22: mol_type = other DNA
gtggggtaacagccacaggtat

SEQ ID NO: 12177 - DNA, 22 bp, synthetic construct
  misc_feature 1..22: note = Synthetic Construct
  source 1..22: mol_type = other DNA
ctgccggagactatgctcagta

SEQ ID NO: 12178 - DNA, 22 bp, synthetic construct
  misc_feature 1..22: note = Synthetic Construct
  source 1..22: mol_type = other DNA
gtcacccaggccatgtgaactt

SEQ ID NO: 12179 - DNA, 22 bp, synthetic construct
  misc_feature 1..22: note = Synthetic Construct
  source 1..22: mol_type = other DNA
gggccatgtcattgctctgtag

SEQ ID NO: 12180 - DNA, 23 bp, synthetic construct
  misc_feature 1..23: note = Synthetic Construct
  source 1..23: mol_type = other DNA
ccccaagatgtctgccatagttc

SEQ ID NO: 12181 - DNA, 29 bp, synthetic construct
  misc_feature 1..29: note = Synthetic Construct
  source 1..29: mol_type = other DNA
gcagttggtaaaggcaaagcttaacgaaa

SEQ ID NO: 12182 - DNA, 21 bp, synthetic construct
  misc_feature 1..21: note = Synthetic Construct
  source 1..21: mol_type = other DNA
agactaggcagggtacacaca

SEQ ID NO: 12183 - DNA, 27 bp, synthetic construct
  misc_feature 1..27: note = Synthetic Construct
  source 1..27: mol_type = other DNA
gtgagcacaaatttggatcgagtgaga

SEQ ID NO: 12184 - DNA, 23 bp, synthetic construct
  misc_feature 1..23: note = Synthetic Construct
  source 1..23: mol_type = other DNA
gagtggctagctctcaagacaca

SEQ ID NO: 12185 - DNA, 23 bp, synthetic construct
  misc_feature 1..23: note = Synthetic Construct
  source 1..23: mol_type = other DNA
gtgtgggaaggaggattccatgt

SEQ ID NO: 12186 - DNA, 22 bp, synthetic construct
  misc_feature 1..22: note = Synthetic Construct
  source 1..22: mol_type = other DNA
atggtaggtcagacccagaagt

SEQ ID NO: 12187 - DNA, 25 bp, synthetic construct
  misc_feature 1..25: note = Synthetic Construct
  source 1..25: mol_type = other DNA
cgtccaggagacagttaacctcttg

SEQ ID NO: 12188 - DNA, 23 bp, synthetic construct
  misc_feature 1..23: note = Synthetic Construct
  source 1..23: mol_type = other DNA
ttccaagagcattcaggtgtctt

SEQ ID NO: 12189 - DNA, 23 bp, synthetic construct
  misc_feature 1..23: note = Synthetic Construct
  source 1..23: mol_type = other DNA
agcagctcaaactatgccaaaga

SEQ ID NO: 12190 - DNA, 21 bp, synthetic construct
  misc_feature 1..21: note = Synthetic Construct
  source 1..21: mol_type = other DNA
agtgccagagcccgctagaaa

SEQ ID NO: 12191 - DNA, 22 bp, synthetic construct
  misc_feature 1..22: note = Synthetic Construct
  source 1..22: mol_type = other DNA
acccctgtgcctaagctgaagt

SEQ ID NO: 12192 - DNA, 20 bp, synthetic construct
  misc_feature 1..20: note = Synthetic Construct
  source 1..20: mol_type = other DNA
ctgtgctggctgctgtttca

SEQ ID NO: 12193 - DNA, 21 bp, synthetic construct
  misc_feature 1..21: note = Synthetic Construct
  source 1..21: mol_type = other DNA
gatgggtgttgcaaggcaaag

SEQ ID NO: 12194 - DNA, 25 bp, synthetic construct
  misc_feature 1..25: note = Synthetic Construct
  source 1..25: mol_type = other DNA
ggcccatttaccctttctatcatgt

SEQ ID NO: 12195 - DNA, 23 bp, synthetic construct
  misc_feature 1..23: note = Synthetic Construct
  source 1..23: mol_type = other DNA
caagtggattgtgggtggacact

SEQ ID NO: 12196 - DNA, 23 bp, synthetic construct
  misc_feature 1..23: note = Synthetic Construct
  source 1..23: mol_type = other DNA
tgtgtgacattcctggtgctaaa

SEQ ID NO: 12197 - DNA, 20 bp, synthetic construct
  misc_feature 1..20: note = Synthetic Construct
  source 1..20: mol_type = other DNA
aggcaggcgatgagccaaat

SEQ ID NO: 12198 - DNA, 24 bp, synthetic construct
  misc_feature 1..24: note = Synthetic Construct
  source 1..24: mol_type = other DNA
gttccaatcacaggacaggggtat

SEQ ID NO: 12199 - DNA, 21 bp, synthetic construct
  misc_feature 1..21: note = Synthetic Construct
  source 1..21: mol_type = other DNA
ggagatgcaatcggcccataa

SEQ ID NO: 12200 - DNA, 20 bp, synthetic construct
  misc_feature 1..20: note = Synthetic Construct
  source 1..20: mol_type = other DNA
tgttggccaggggttaggtt

SEQ ID NO: 12201 - DNA, 22 bp, synthetic construct
  misc_feature 1..22: note = Synthetic Construct
  source 1..22: mol_type = other DNA
gtcatggggacctggattgcta

SEQ ID NO: 12202 - DNA, 22 bp, synthetic construct
  misc_feature 1..22: note = Synthetic Construct
  source 1..22: mol_type = other DNA
gccacatggacacctcacactt

SEQ ID NO: 12203 - DNA, 28 bp, synthetic construct
  misc_feature 1..28: note = Synthetic Construct
  source 1..28: mol_type = other DNA
ggttttcctatcggtgtttgaggtctac

SEQ ID NO: 12204 - DNA, 24 bp, synthetic construct
  misc_feature 1..24: note = Synthetic Construct
  source 1..24: mol_type = other DNA
cagggtgataagtccacagcattc

SEQ ID NO: 12205 - DNA, 20 bp, synthetic construct
  misc_feature 1..20: note = Synthetic Construct
  source 1..20: mol_type = other DNA
cagcacccagagagcagctt

SEQ ID NO: 12206 - DNA, 19 bp, synthetic construct
  misc_feature 1..19: note = Synthetic Construct
  source 1..19: mol_type = other DNA
gcgcaggcgcagcattatt

SEQ ID NO: 12207 - DNA, 20 bp, synthetic construct
  misc_feature 1..20: note = Synthetic Construct
  source 1..20: mol_type = other DNA
cacgacaccacacgcattca

SEQ ID NO: 12208 - DNA, 22 bp, synthetic construct
  misc_feature 1..22: note = Synthetic Construct
  source 1..22: mol_type = other DNA
tcccatcagcaccagtggaaac

SEQ ID NO: 12209 - DNA, 26 bp, synthetic construct
  misc_feature 1..26: note = Synthetic Construct
  source 1..26: mol_type = other DNA
gggagatcatacacagagaggaggtt

SEQ ID NO: 12210 - DNA, 25 bp, synthetic construct
  misc_feature 1..25: note = Synthetic Construct
  source 1..25: mol_type = other DNA
tcaggctaaagacattgctgtagaa

SEQ ID NO: 12211 - DNA, 22 bp, synthetic construct
  misc_feature 1..22: note = Synthetic Construct
  source 1..22: mol_type = other DNA
ccctgctcttccatgctgctaa

SEQ ID NO: 12212 - DNA, 23 bp, synthetic construct
  misc_feature 1..23: note = Synthetic Construct
  source 1..23: mol_type = other DNA
cctaggagggtaaaggcggagtt

SEQ ID NO: 12213 - DNA, 20 bp, synthetic construct
  misc_feature 1..20: note = Synthetic Construct
  source 1..20: mol_type = other DNA
ttgccagctctgccctgcta

SEQ ID NO: 12214 - DNA, 22 bp, synthetic construct
  misc_feature 1..22: note = Synthetic Construct
  source 1..22: mol_type = other DNA
gcaccaggagtgtgctgaagtt

SEQ ID NO: 12215 - DNA, 26 bp, synthetic construct
  misc_feature 1..26: note = Synthetic Construct
  source 1..26: mol_type = other DNA
gtctctgacaatacattcagccacta

SEQ ID NO: 12216 - DNA, 20 bp, synthetic construct
  misc_feature 1..20: note = Synthetic Construct
  source 1..20: mol_type = other DNA
aaggctcgcctgagggtgaa

SEQ ID NO: 12217 - DNA, 24 bp, synthetic construct
  misc_feature 1..24: note = Synthetic Construct
  source 1..24: mol_type = other DNA
cgtgattaagtacggctgcctgtt

SEQ ID NO: 12218 - DNA, 24 bp, synthetic construct
  misc_feature 1..24: note = Synthetic Construct
  source 1..24: mol_type = other DNA
gaccacagaaattggaaggagcta

SEQ ID NO: 12219 - DNA, 20 bp, synthetic construct
  misc_feature 1..20: note = Synthetic Construct
  source 1..20: mol_type = other DNA
ggcagcttcccttcgctctt

SEQ ID NO: 12220 - DNA, 24 bp, synthetic construct
  misc_feature 1..24: note = Synthetic Construct
  source 1..24: mol_type = other DNA
gcctgctgttgggtgaattactgt

SEQ ID NO: 12221 - DNA, 20 bp, synthetic construct
  misc_feature 1..20: note = Synthetic Construct
  source 1..20: mol_type = other DNA
gtgatgctgctacggaggaa

SEQ ID NO: 12222 - DNA, 19 bp, synthetic construct
  misc_feature 1..19: note = Synthetic Construct
  source 1..19: mol_type = other DNA
cccgcaatgcccagtgaca

SEQ ID NO: 12223 - DNA, 22 bp, synthetic construct
  misc_feature 1..22: note = Synthetic Construct
  source 1..22: mol_type = other DNA
aggggctgagtgctttttcttc

SEQ ID NO: 12224 - DNA, 22 bp, synthetic construct
  misc_feature 1..22: note = Synthetic Construct
  source 1..22: mol_type = other DNA
gcatcagagcagtgggcttaca

SEQ ID NO: 12225 - DNA, 19 bp, synthetic construct
  misc_feature 1..19: note = Synthetic Construct
  source 1..19: mol_type = other DNA
tggagggagggagctgttc

SEQ ID NO: 12226 - DNA, 21 bp, synthetic construct
  misc_feature 1..21: note = Synthetic Construct
  source 1..21: mol_type = other DNA
tgggagggccagagactcatt

SEQ ID NO: 12227 - DNA, 23 bp, synthetic construct
  misc_feature 1..23: note = Synthetic Construct
  source 1..23: mol_type = other DNA
gaagaaagccaggcctccaaaac

SEQ ID NO: 12228 - DNA, 19 bp, synthetic construct
  misc_feature 1..19: note = Synthetic Construct
  source 1..19: mol_type = other DNA
acagttggggcaagcacat

SEQ ID NO: 12229 - DNA, 19 bp, synthetic construct
  misc_feature 1..19: note = Synthetic Construct
  source 1..19: mol_type = other DNA
tgcaacgcgagggtgagtt

SEQ ID NO: 12230 - DNA, 22 bp, synthetic construct
  misc_feature 1..22: note = Synthetic Construct
  source 1..22: mol_type = other DNA
ggagagatgcgtccatcacaga

SEQ ID NO: 12231 - DNA, 20 bp, synthetic construct
  misc_feature 1..20: note = Synthetic Construct
  source 1..20: mol_type = other DNA
ggatggcttcaggcagttga

SEQ ID NO: 12232 - DNA, 20 bp, synthetic construct
  misc_feature 1..20: note = Synthetic Construct
  source 1..20: mol_type = other DNA
cacttctggggcacttgtgt

SEQ ID NO: 12233 - DNA, 25 bp, synthetic construct
  misc_feature 1..25: note = Synthetic Construct
  source 1..25: mol_type = other DNA
ctcttgcaaatcgaggaacgagaga

SEQ ID NO: 12234 - DNA, 21 bp, synthetic construct
  misc_feature 1..21: note = Synthetic Construct
  source 1..21: mol_type = other DNA
accttcagggccaccagtgtt

SEQ ID NO: 12235 - DNA, 22 bp, synthetic construct
  misc_feature 1..22: note = Synthetic Construct
  source 1..22: mol_type = other DNA
tgcactcactcagggcagaagt

SEQ ID NO: 12236 - DNA, 21 bp, synthetic construct
  misc_feature 1..21: note = Synthetic Construct
  source 1..21: mol_type = other DNA
gcagtgcgtgttcttgcatca

SEQ ID NO: 12237 - DNA, 21 bp, synthetic construct
  misc_feature 1..21: note = Synthetic Construct
  source 1..21: mol_type = other DNA
tcaggcagggctcagaactgt

SEQ ID NO: 12238 - DNA, 20 bp, synthetic construct
  misc_feature 1..20: note = Synthetic Construct
  source 1..20: mol_type = other DNA
tcctctgccttcagcactgt

SEQ ID NO: 12239 - DNA, 22 bp, synthetic construct
  misc_feature 1..22: note = Synthetic Construct
  source 1..22: mol_type = other DNA
ggagaagactgcggaacacaca

SEQ ID NO: 12240 - DNA, 28 bp, synthetic construct
  misc_feature 1..28: note = Synthetic Construct
  source 1..28: mol_type = other DNA
cacccctaagtttgagatctgttgattc

SEQ ID NO: 12241 - DNA, 22 bp, synthetic construct
  misc_feature 1..22: note = Synthetic Construct
  source 1..22: mol_type = other DNA
tgccccttccaatcctgtgtga

SEQ ID NO: 12242 - DNA, 27 bp, synthetic construct
  misc_feature 1..27: note = Synthetic Construct
  source 1..27: mol_type = other DNA
gccacaggggatgaataaaaagcagta

SEQ ID NO: 12243 - DNA, 24 bp, synthetic construct
  misc_feature 1..24: note = Synthetic Construct
  source 1..24: mol_type = other DNA
caaagatgggtcaagttcctctca

SEQ ID NO: 12244 - DNA, 19 bp, synthetic construct
  misc_feature 1..19: note = Synthetic Construct
  source 1..19: mol_type = other DNA
ggtgggcccagaacaaact

SEQ ID NO: 12245 - DNA, 20 bp, synthetic construct
  misc_feature 1..20: note = Synthetic Construct
  source 1..20: mol_type = other DNA
aaggctgccctggtcaaaca

SEQ ID NO: 12246 - DNA, 23 bp, synthetic construct
  misc_feature 1..23: note = Synthetic Construct
  source 1..23: mol_type = other DNA
gttttaggacagccagtcgagaa

SEQ ID NO: 12247 - DNA, 25 bp, synthetic construct
  misc_feature 1..25: note = Synthetic Construct
  source 1..25: mol_type = other DNA
acagttgaagtccaggcttatttga

SEQ ID NO: 12248 - DNA, 23 bp, synthetic construct
  misc_feature 1..23: note = Synthetic Construct
  source 1..23: mol_type = other DNA
cagtggacccagatggtgacttc

SEQ ID NO: 12249 - DNA, 23 bp, synthetic construct
  misc_feature 1..23: note = Synthetic Construct
  source 1..23: mol_type = other DNA
tgctttagggagcatggagtaca

SEQ ID NO: 12250 - DNA, 23 bp, synthetic construct
  misc_feature 1..23: note = Synthetic Construct
  source 1..23: mol_type = other DNA
cctcagtcttagcctgggctctt

SEQ ID NO: 12251 - DNA, 20 bp, synthetic construct
  misc_feature 1..20: note = Synthetic Construct
  source 1..20: mol_type = other DNA
acagacccaggacgctgaag

SEQ ID NO: 12252 - DNA, 22 bp, synthetic construct
  misc_feature 1..22: note = Synthetic Construct
  source 1..22: mol_type = other DNA
cgaggggctttgtaccagtgtt

SEQ ID NO: 12253 - DNA, 21 bp, synthetic construct
  misc_feature 1..21: note = Synthetic Construct
  source 1..21: mol_type = other DNA
ccatctggagcaggggagaag

SEQ ID NO: 12254 - DNA, 26 bp, synthetic construct
  misc_feature 1..26: note = Synthetic Construct
  source 1..26: mol_type = other DNA
ggttaccccattccatcttctctgta

SEQ ID NO: 12255 - DNA, 19 bp, synthetic construct
  misc_feature 1..19: note = Synthetic Construct
  source 1..19: mol_type = other DNA
gggagagagctggcgttca

SEQ ID NO: 12256 - DNA, 22 bp, synthetic construct
  misc_feature 1..22: note = Synthetic Construct
  source 1..22: mol_type = other DNA
cctgcatgtctctggtctcttg

SEQ ID NO: 12257 - DNA, 24 bp, synthetic construct
  misc_feature 1..24: note = Synthetic Construct
  source 1..24: mol_type = other DNA
ccgcacaacttactattgctgttg

SEQ ID NO: 12258 - DNA, 26 bp, synthetic construct
  misc_feature 1..26: note = Synthetic Construct
  source 1..26: mol_type = other DNA
aggagtgaatcaaaggatggaagtag

SEQ ID NO: 12259 - DNA, 24 bp, synthetic construct
  misc_feature 1..24: note = Synthetic Construct
  source 1..24: mol_type = other DNA
gtcttctgcaggggtgaaaacagt

SEQ ID NO: 12260 - DNA, 20 bp, synthetic construct
  misc_feature 1..20: note = Synthetic Construct
  source 1..20: mol_type = other DNA
aggccctgaagttgctggaa

SEQ ID NO: 12261 - DNA, 26 bp, synthetic construct
  misc_feature 1..26: note = Synthetic Construct
  source 1..26: mol_type = other DNA
gtgagtaagtcaacagtgatgaggaa

SEQ ID NO: 12262 - DNA, 21 bp, synthetic construct
  misc_feature 1..21: note = Synthetic Construct
  source 1..21: mol_type = other DNA
ccagcacagaaccgacacgtt

SEQ ID NO: 12263 - DNA, 20 bp, synthetic construct
  misc_feature 1..20: note = Synthetic Construct
  source 1..20: mol_type = other DNA
agctgccgcatcttgctttc

SEQ ID NO: 12264 - DNA, 22 bp, synthetic construct
  misc_feature 1..22: note = Synthetic Construct
  source 1..22: mol_type = other DNA
gatggtcccaaggagccaatgt

SEQ ID NO: 12265 - DNA, 24 bp, synthetic construct
  misc_feature 1..24: note = Synthetic Construct
  source 1..24: mol_type = other DNA
cgtgcagacctcacattactcttg

SEQ ID NO: 12266 - DNA, 22 bp, synthetic construct
  misc_feature 1..22: note = Synthetic Construct
  source 1..22: mol_type = other DNA
gcctgagtgtccatgaacttgt

SEQ ID NO: 12267 - DNA, 24 bp, synthetic construct
  misc_feature 1..24: note = Synthetic Construct
  source 1..24: mol_type = other DNA
tggatagctacatgcttgcttctt

SEQ ID NO: 12268 - DNA, 22 bp, synthetic construct
  misc_feature 1..22: note = Synthetic Construct
  source 1..22: mol_type = other DNA
cggagccactttactcccacaa

SEQ ID NO: 12269 - DNA, 24 bp, synthetic construct
  misc_feature 1..24: note = Synthetic Construct
  source 1..24: mol_type = other DNA
cttagcaaagagccttctgactgt

SEQ ID NO: 12270 - DNA, 22 bp, synthetic construct
  misc_feature 1..22: note = Synthetic Construct
  source 1..22: mol_type = other DNA
acaagggaaagctgagggttct

SEQ ID NO: 12271 - DNA, 23 bp, synthetic construct
  misc_feature 1..23: note = Synthetic Construct
  source 1..23: mol_type = other DNA
caaagcaccaatcctctgtgtga

SEQ ID NO: 12272 - DNA, 24 bp, synthetic construct
  misc_feature 1..24: note = Synthetic Construct
  source 1..24: mol_type = other DNA
gggcaaaagaatactctggtcagt

SEQ ID NO: 12273 - DNA, 20 bp, synthetic construct
  misc_feature 1..20: note = Synthetic Construct
  source 1..20: mol_type = other DNA
cacttcccaccctccctaca

SEQ ID NO: 12274 - DNA, 21 bp, synthetic construct
  misc_feature 1..21: note = Synthetic Construct
  source 1..21: mol_type = other DNA
gcactttgcgtggactgtttc

SEQ ID NO: 12275 - DNA, 23 bp, synthetic construct
  misc_feature 1..23: note = Synthetic Construct
  source 1..23: mol_type = other DNA
ctccgccacaaactgaaatctct

SEQ ID NO: 12276 - DNA, 20 bp, synthetic construct
  misc_feature 1..20: note = Synthetic Construct
  source 1..20: mol_type = other DNA
tgggcaagagtgtggagtca

SEQ ID NO: 12277 - DNA, 26 bp, synthetic construct
  misc_feature 1..26: note = Synthetic Construct
  source 1..26: mol_type = other DNA
ccgaaatcattgaacgagcaggctat

SEQ ID NO: 12278 - DNA, 23 bp, synthetic construct
  misc_feature 1..23: note = Synthetic Construct
  source 1..23: mol_type = other DNA
ccacctaagccctaggatcatct

SEQ ID NO: 12279 - DNA, 20 bp, synthetic construct
  misc_feature 1..20: note = Synthetic Construct
  source 1..20: mol_type = other DNA
cagcaggaaggggtgagttc

SEQ ID NO: 12280 - DNA, 22 bp, synthetic construct
  misc_feature 1..22: note = Synthetic Construct
  source 1..22: mol_type = other DNA
cgcctggagcctcaaattggtt

SEQ ID NO: 12281 - DNA, 25 bp, synthetic construct
  misc_feature 1..25: note = Synthetic Construct
  source 1..25: mol_type = other DNA
gtctggaaccaacagaattgtcact

SEQ ID NO: 12282 - DNA, 22 bp, synthetic construct
  misc_feature 1..22: note = Synthetic Construct
  source 1..22: mol_type = other DNA
caagaccctggacgctcaagaa

SEQ ID NO: 12283 - DNA, 23 bp, synthetic construct
  misc_feature 1..23: note = Synthetic Construct
  source 1..23: mol_type = other DNA
gtcagcaaaggaaggagtaccat

SEQ ID NO: 12284 - DNA, 23 bp, synthetic construct
  misc_feature 1..23: note = Synthetic Construct
  source 1..23: mol_type = other DNA
cagaagtcattgctgaggaggaa

SEQ ID NO: 12285 - DNA, 24 bp, synthetic construct
  misc_feature 1..24: note = Synthetic Construct
  source 1..24: mol_type = other DNA
ctggagaaagatgcagtcgaccat

SEQ ID NO: 12286 - DNA, 25 bp, synthetic construct
  misc_feature 1..25: note = Synthetic Construct
  source 1..25: mol_type = other DNA
agctctacttcacagaaaggagttg

SEQ ID NO: 12287 - DNA, 19 bp, synthetic construct
  misc_feature 1..19: note = Synthetic Construct
  source 1..19: mol_type = other DNA
cctgctcctgtggccctta

SEQ ID NO: 12288 - DNA, 22 bp, synthetic construct
  misc_feature 1..22: note = Synthetic Construct
  source 1..22: mol_type = other DNA
ccagccttgcttccccttcaat

SEQ ID NO: 12289 - DNA, 22 bp, synthetic construct
  misc_feature 1..22: note = Synthetic Construct
  source 1..22: mol_type = other DNA
ggggcagggaatacaggaattt

SEQ ID NO: 12290 - DNA, 25 bp, synthetic construct
  misc_feature 1..25: note = Synthetic Construct
  source 1..25: mol_type = other DNA
gaaatactcacaatgccctcagcat

SEQ ID NO: 12291 - DNA, 24 bp, synthetic construct
  misc_feature 1..24: note = Synthetic Construct
  source 1..24: mol_type = other DNA
gtgaggtgtggaaacgaaggtttg

SEQ ID NO: 12292 - DNA, 21 bp, synthetic construct
  misc_feature 1..21: note = Synthetic Construct
  source 1..21: mol_type = other DNA
ttgattgagcgggagcaaaga

SEQ ID NO: 12293 - DNA, 27 bp, synthetic construct
  misc_feature 1..27: note = Synthetic Construct
  source 1..27: mol_type = other DNA
caacccgaagaatctttgttcctcaag

SEQ ID NO: 12294 - DNA, 25 bp, synthetic construct
  misc_feature 1..25: note = Synthetic Construct
  source 1..25: mol_type = other DNA
ggcatgggaataaatgccaggtgaa

SEQ ID NO: 12295 - DNA, 25 bp, synthetic construct
  misc_feature 1..25: note = Synthetic Construct
  source 1..25: mol_type = other DNA
ggagacttggagggtaaaggcaact

SEQ ID NO: 12296 - DNA, 26 bp, synthetic construct
  misc_feature 1..26: note = Synthetic Construct
  source 1..26: mol_type = other DNA
gcagttttgaaggcctagttatgttc

SEQ ID NO: 12297 - DNA, 22 bp, synthetic construct
  misc_feature 1..22: note = Synthetic Construct
  source 1..22: mol_type = other DNA
gcaaggtctgagtggagaggat

SEQ ID NO: 12298 - DNA, 23 bp, synthetic construct
  misc_feature 1..23: note = Synthetic Construct
  source 1..23: mol_type = other DNA
attgcagctccaggctccgagat

SEQ ID NO: 12299 - DNA, 22 bp, synthetic construct
  misc_feature 1..22: note = Synthetic Construct
  source 1..22: mol_type = other DNA
cagccctctcctgttcagtgtt

SEQ ID NO: 12300 - DNA, 22 bp, synthetic construct
  misc_feature 1..22: note = Synthetic Construct
  source 1..22: mol_type = other DNA
cgagggtcgttggcacttcaat

SEQ ID NO: 12301 - DNA, 22 bp, synthetic construct
  misc_feature 1..22: note = Synthetic Construct
  source 1..22: mol_type = other DNA
tgggaaagagcgagatccaaaa

SEQ ID NO: 12302 - DNA, 20 bp, synthetic construct
  misc_feature 1..20: note = Synthetic Construct
  source 1..20: mol_type = other DNA
tctgcccagccgatggagta

SEQ ID NO: 12303 - DNA, 23 bp, synthetic construct
  misc_feature 1..23: note = Synthetic Construct
  source 1..23: mol_type = other DNA
gtcagtccctctgttctctgtca

SEQ ID NO: 12304 - DNA, 24 bp, synthetic construct
  misc_feature 1..24: note = Synthetic Construct
  source 1..24: mol_type = other DNA
tgacacaagaatcaggttggttga

SEQ ID NO: 12305 - DNA, 23 bp, synthetic construct
  misc_feature 1..23: note = Synthetic Construct
  source 1..23: mol_type = other DNA
tttattggctaccccaggtccta

SEQ ID NO: 12306 - DNA, 24 bp, synthetic construct
  misc_feature 1..24: note = Synthetic Construct
  source 1..24: mol_type = other DNA
gatgtcttccctgaacagtcagaa

SEQ ID NO: 12307 - DNA, 21 bp, synthetic construct
  misc_feature 1..21: note = Synthetic Construct
  source 1..21: mol_type = other DNA
gctgggctggttagggaaaca

SEQ ID NO: 12308 - DNA, 24 bp, synthetic construct
  misc_feature 1..24: note = Synthetic Construct
  source 1..24: mol_type = other DNA
caacactgtgctgtatgggaaaat

SEQ ID NO: 12309 - DNA, 21 bp, synthetic construct
  misc_feature 1..21: note = Synthetic Construct
  source 1..21: mol_type = other DNA
caacccaggaagacacaccaa

SEQ ID NO: 12310 - DNA, 24 bp, synthetic construct
  misc_feature 1..24: note = Synthetic Construct
  source 1..24: mol_type = other DNA
agaaggtagttcacctgaccgtta

SEQ ID NO: 12311 - DNA, 24 bp, synthetic construct
  misc_feature 1..24: note = Synthetic Construct
  source 1..24: mol_type = other DNA
gggctggcacatatgtagtagaag

SEQ ID NO: 12312 - DNA, 22 bp, synthetic construct
  misc_feature 1..22: note = Synthetic Construct
  source 1..22: mol_type = other DNA
ggcgacaacattgccaggatct

SEQ ID NO: 12313 - DNA, 25 bp, synthetic construct
  misc_feature 1..25: note = Synthetic Construct
  source 1..25: mol_type = other DNA
ctcagctcaggtatttgtgctgtta

SEQ ID NO: 12314 - DNA, 24 bp, synthetic construct
  misc_feature 1..24: note = Synthetic Construct
  source 1..24: mol_type = other DNA
gctgcactgcatacatacatggaa

SEQ ID NO: 12315 - DNA, 22 bp, synthetic construct
  misc_feature 1..22: note = Synthetic Construct
  source 1..22: mol_type = other DNA
ggcaaagtgatggtggcagctt

SEQ ID NO: 12316 - DNA, 23 bp, synthetic construct
  misc_feature 1..23: note = Synthetic Construct
  source 1..23: mol_type = other DNA
ggaaatctgagcatgtggagtga

SEQ ID NO: 12317 - DNA, 24 bp, synthetic construct
  misc_feature 1..24: note = Synthetic Construct
  source 1..24: mol_type = other DNA
cgatacccaggtaccatgttgaga

SEQ ID NO: 12318 - DNA, 22 bp, synthetic construct
  misc_feature 1..22: note = Synthetic Construct
  source 1..22: mol_type = other DNA
ggaaggccatttggcaagaatc

SEQ ID NO: 12319 - DNA, 24 bp, synthetic construct
  misc_feature 1..24: note = Synthetic Construct
  source 1..24: mol_type = other DNA
cttggtctgtccccaggttgttag

SEQ ID NO: 12320 - DNA, 25 bp, synthetic construct
  misc_feature 1..25: note = Synthetic Construct
  source 1..25: mol_type = other DNA
tcgagagaaagatggggtagaaagt

SEQ ID NO: 12321 - DNA, 24 bp, synthetic construct
  misc_feature 1..24: note = Synthetic Construct
  source 1..24: mol_type = other DNA
ccctgcctaacccaacatctgtgt

SEQ ID NO: 12322 - DNA, 21 bp, synthetic construct
  misc_feature 1..21: note = Synthetic Construct
  source 1..21: mol_type = other DNA
gtggaaaaggcgtcagactgt

SEQ ID NO: 12323 - DNA, 21 bp, synthetic construct
  misc_feature 1..21: note = Synthetic Construct
  source 1..21: mol_type = other DNA
cctgcgagttcctggagcaat

SEQ ID NO: 12324 - DNA, 20 bp, synthetic construct
  misc_feature 1..20: note = Synthetic Construct
  source 1..20: mol_type = other DNA
ggactaggtggttggtgcaa

SEQ ID NO: 12325 - DNA, 23 bp, synthetic construct
  misc_feature 1..23: note = Synthetic Construct
  source 1..23: mol_type = other DNA
agggcttttcatgtgagtgttgt

SEQ ID NO: 12326 - DNA, 22 bp, synthetic construct
  misc_feature 1..22: note = Synthetic Construct
  source 1..22: mol_type = other DNA
agcatctggctcccaagtgcta

SEQ ID NO: 12327 - DNA, 24 bp, synthetic construct
  misc_feature 1..24: note = Synthetic Construct
  source 1..24: mol_type = other DNA
ggcaagagacgaagtggaagcatt

SEQ ID NO: 12328 - DNA, 27 bp, synthetic construct
  misc_feature 1..27: note = Synthetic Construct
  source 1..27: mol_type = other DNA
gcaagctgggtgaagttatcttgtttc

SEQ ID NO: 12329 - DNA, 21 bp, synthetic construct
  misc_feature 1..21: note = Synthetic Construct
  source 1..21: mol_type = other DNA
gccagttgagggaagccatct

SEQ ID NO: 12330 - DNA, 20 bp, synthetic construct
  misc_feature 1..20: note = Synthetic Construct
  source 1..20: mol_type = other DNA
gcctccttagtgggcaggtt

SEQ ID NO: 12331 - DNA, 26 bp, synthetic construct
  misc_feature 1..26: note = Synthetic Construct
  source 1..26: mol_type = other DNA
cggaaacaaaacaactcttcccagat

SEQ ID NO: 12332 - DNA, 19 bp, synthetic construct
  misc_feature 1..19: note = Synthetic Construct
  source 1..19: mol_type = other DNA
tgagccttgctggctgtca

SEQ ID NO: 12333 - DNA, 22 bp, synthetic construct
  misc_feature 1..22: note = Synthetic Construct
  source 1..22: mol_type = other DNA
tgggaggcatagtccctgtgat

SEQ ID NO: 12334 - DNA, 22 bp, synthetic construct
  misc_feature 1..22: note = Synthetic Construct
  source 1..22: mol_type = other DNA
ttctgtggggcacttgtacttt

SEQ ID NO: 12335 - DNA, 26 bp, synthetic construct
  misc_feature 1..26: note = Synthetic Construct
  source 1..26: mol_type = other DNA
caaaggaggttcaaagaccagtttgt

SEQ ID NO: 12336 - DNA, 26 bp, synthetic construct
  misc_feature 1..26: note = Synthetic Construct
  source 1..26: mol_type = other DNA
ccttagtcctactttttcccttgcat

SEQ ID NO: 12337 - DNA, 21 bp, synthetic construct
  misc_feature 1..21: note = Synthetic Construct
  source 1..21: mol_type = other DNA
gaccttgcaagaacggagtca

SEQ ID NO: 12338 - DNA, 23 bp, synthetic construct
  misc_feature 1..23: note = Synthetic Construct
  source 1..23: mol_type = other DNA
gactgccatctggcattgagaac

SEQ ID NO: 12339 - DNA, 19 bp, synthetic construct
  misc_feature 1..19: note = Synthetic Construct
  source 1..19: mol_type = other DNA
agccgctcctgctttttga

SEQ ID NO: 12340 - DNA, 25 bp, synthetic construct
  misc_feature 1..25: note = Synthetic Construct
  source 1..25: mol_type = other DNA
gccaaaagtgcagagttatttcagt

SEQ ID NO: 12341 - DNA, 19 bp, synthetic construct
  misc_feature 1..19: note = Synthetic Construct
  source 1..19: mol_type = other DNA
tattggccgccagcactgt

SEQ ID NO: 12342 - DNA, 22 bp, synthetic construct
  misc_feature 1..22: note = Synthetic Construct
  source 1..22: mol_type = other DNA
gagcgcctagtcagtactttgt

SEQ ID NO: 12343 - DNA, 21 bp, synthetic construct
  misc_feature 1..21: note = Synthetic Construct
  source 1..21: mol_type = other DNA
gaagccaagttggtggaggat

SEQ ID NO: 12344 - DNA, 24 bp, synthetic construct
  misc_feature 1..24: note = Synthetic Construct
  source 1..24: mol_type = other DNA
gagaagggagagatgcatgggttt

SEQ ID NO: 12345 - DNA, 21 bp, synthetic construct
  misc_feature 1..21: note = Synthetic Construct
  source 1..21: mol_type = other DNA
ggccacccctgtgcatcttta

SEQ ID NO: 12346 - DNA, 21 bp, synthetic construct
  misc_feature 1..21: note = Synthetic Construct
  source 1..21: mol_type = other DNA
tgaatggtggccgaattgtgt

SEQ ID NO: 12347 - DNA, 27 bp, synthetic construct
  misc_feature 1..27: note = Synthetic Construct
  source 1..27: mol_type = other DNA
gccctttctggaggtacttgagcttat

SEQ ID NO: 12348 - DNA, 22 bp, synthetic construct
  misc_feature 1..22: note = Synthetic Construct
  source 1..22: mol_type = other DNA
gcagtctccagtgctgttcttc

SEQ ID NO: 12349 - DNA, 22 bp, synthetic construct
  misc_feature 1..22: note = Synthetic Construct
  source 1..22: mol_type = other DNA
cttcacccacagccagaaatgt

SEQ ID NO: 12350 - DNA, 25 bp, synthetic construct
  misc_feature 1..25: note = Synthetic Construct
  source 1..25: mol_type = other DNA
ctggcttggaacagaaaccatgact

SEQ ID NO: 12351 - DNA, 20 bp, synthetic construct
  misc_feature 1..20: note = Synthetic Construct
  source 1..20: mol_type = other DNA
aaggcttgagacgtgcttgt

SEQ ID NO: 12352 - DNA, 18 bp, synthetic construct
  misc_feature 1..18: note = Synthetic Construct
  source 1..18: mol_type = other DNA
gctgcagtgagccacgat

SEQ ID NO: 12353 - DNA, 20 bp, synthetic construct
  misc_feature 1..20: note = Synthetic Construct
  source 1..20: mol_type = other DNA
tggctggagcagagtgaaca

SEQ ID NO: 12354 - DNA, 22 bp, synthetic construct
  misc_feature 1..22: note = Synthetic Construct
  source 1..22: mol_type = other DNA
ccgccatcaggggttgatgtaa

SEQ ID NO: 12355 - DNA, 20 bp, synthetic construct
  misc_feature 1..20: note = Synthetic Construct
  source 1..20: mol_type = other DNA
agggatcagggccatcttca

SEQ ID NO: 12356 - DNA, 21 bp, synthetic construct
  misc_feature 1..21: note = Synthetic Construct
  source 1..21: mol_type = other DNA
agtcagcaggctggaaaaact

SEQ ID NO: 12357 - DNA, 22 bp, synthetic construct
  misc_feature 1..22: note = Synthetic Construct
  source 1..22: mol_type = other DNA
ctgtgcaggaagcaaggtagat

SEQ ID NO: 12358 - DNA, 25 bp, synthetic construct
  misc_feature 1..25: note = Synthetic Construct
  source 1..25: mol_type = other DNA
tgagtcaaggtgatacttgcttctt

SEQ ID NO: 12359 - DNA, 26 bp, synthetic construct
  misc_feature 1..26: note = Synthetic Construct
  source 1..26: mol_type = other DNA
acctataacaaaggggaagtcaggat

SEQ ID NO: 12360 - DNA, 22 bp, synthetic construct
  misc_feature 1..22: note = Synthetic Construct
  source 1..22: mol_type = other DNA
accttccccaccatgttctaca

SEQ ID NO: 12361 - DNA, 24 bp, synthetic construct
  misc_feature 1..24: note = Synthetic Construct
  source 1..24: mol_type = other DNA
cacatgcccagtaaatggaacaaa

SEQ ID NO: 12362 - DNA, 22 bp, synthetic construct
  misc_feature 1..22: note = Synthetic Construct
  source 1..22: mol_type = other DNA
cacctggaagctgaagccaaag

SEQ ID NO: 12363 - DNA, 20 bp, synthetic construct
  misc_feature 1..20: note = Synthetic Construct
  source 1..20: mol_type = other DNA
agtgggcgagcgccccttat

SEQ ID NO: 12364 - DNA, 19 bp, synthetic construct
  misc_feature 1..19: note = Synthetic Construct
  source 1..19: mol_type = other DNA
agccctgctgcgtggacaa

SEQ ID NO: 12365 - DNA, 25 bp, synthetic construct
  misc_feature 1..25: note = Synthetic Construct
  source 1..25: mol_type = other DNA
cttgggaaactaagtgagggcaaag

SEQ ID NO: 12366 - DNA, 22 bp, synthetic construct
  misc_feature 1..22: note = Synthetic Construct
  source 1..22: mol_type = other DNA
gcagcttttcctggtgtctttc

SEQ ID NO: 12367 - DNA, 25 bp, synthetic construct
  misc_feature 1..25: note = Synthetic Construct
  source 1..25: mol_type = other DNA
ggggtggttaagtatgggctagcaa

SEQ ID NO: 12368 - DNA, 25 bp, synthetic construct
  misc_feature 1..25: note = Synthetic Construct
  source 1..25: mol_type = other DNA
agtgagcatacagcttctcagaaat

SEQ ID NO: 12369 - DNA, 25 bp, synthetic construct
  misc_feature 1..25: note = Synthetic Construct
  source 1..25: mol_type = other DNA
ggatctaagcagtgcatctctgtgt

SEQ ID NO: 12370 - DNA, 21 bp, synthetic construct
  misc_feature 1..21: note = Synthetic Construct
  source 1..21: mol_type = other DNA
ggtgactgtgcacgcgttaat

SEQ ID NO: 12371 - DNA, 22 bp, synthetic construct
  misc_feature 1..22: note = Synthetic Construct
  source 1..22: mol_type = other DNA
gctcaagtactccctggcttct

SEQ ID NO: 12372 - DNA, 27 bp, synthetic construct
  misc_feature 1..27: note = Synthetic Construct
  source 1..27: mol_type = other DNA
caggatcttctttgtttgaaggagctt

SEQ ID NO: 12373 - DNA, 21 bp, synthetic construct
  misc_feature 1..21: note = Synthetic Construct
  source 1..21: mol_type = other DNA
ggcagacaaatcagcccagtt

SEQ ID NO: 12374 - DNA, 21 bp, synthetic construct
  misc_feature 1..21: note = Synthetic Construct
  source 1..21: mol_type = other DNA
gtcattgaactgcgcttgcat

SEQ ID NO: 12375 - DNA, 24 bp, synthetic construct
  misc_feature 1..24: note = Synthetic Construct
  source 1..24: mol_type = other DNA
gggactacagataagcaccactgt

SEQ ID NO: 12376 - DNA, 22 bp, synthetic construct
  misc_feature 1..22: note = Synthetic Construct
  source 1..22: mol_type = other DNA
caaagaggccctcatgctcagt

SEQ ID NO: 12377 - DNA, 22 bp, synthetic construct
  misc_feature 1..22: note = Synthetic Construct
  source 1..22: mol_type = other DNA
ttggtcctacaaccaagcaagt

SEQ ID NO: 12378 - DNA, 25 bp, synthetic construct
  misc_feature 1..25: note = Synthetic Construct
  source 1..25: mol_type = other DNA
gccagagatgaatggtttgcgaatg

SEQ ID NO: 12379 - DNA, 24 bp, synthetic construct
  misc_feature 1..24: note = Synthetic Construct
  source 1..24: mol_type = other DNA
cctgtgctatagaatcagcactct

SEQ ID NO: 12380 - DNA, 22 bp, synthetic construct
  misc_feature 1..22: note = Synthetic Construct
  source 1..22: mol_type = other DNA
tgtgtgttgtggagagggagat

SEQ ID NO: 12381 - DNA, 26 bp, synthetic construct
  misc_feature 1..26: note = Synthetic Construct
  source 1..26: mol_type = other DNA
gaagctccttacattagtgccaggtt

SEQ ID NO: 12382 - DNA, 25 bp, synthetic construct
  misc_feature 1..25: note = Synthetic Construct
  source 1..25: mol_type = other DNA
tgcactcagaggagaagttaaaaca

SEQ ID NO: 12383 - DNA, 27 bp, synthetic construct
  misc_feature 1..27: note = Synthetic Construct
  source 1..27: mol_type = other DNA
ggatcaaagttcaaggagttagtgtga

SEQ ID NO: 12384 - DNA, 22 bp, synthetic construct
  misc_feature 1..22: note = Synthetic Construct
  source 1..22: mol_type = other DNA
cgccaccagcatttgagtcttg

SEQ ID NO: 12385 - DNA, 19 bp, synthetic construct
  misc_feature 1..19: note = Synthetic Construct
  source 1..19: mol_type = other DNA
ccggccaagaaggtagcaa

SEQ ID NO: 12386 - DNA, 21 bp, synthetic construct
  misc_feature 1..21: note = Synthetic Construct
  source 1..21: mol_type = other DNA
gggctttctggccgagatgaa

SEQ ID NO: 12387 - DNA, 20 bp, synthetic construct
  misc_feature 1..20: note = Synthetic Construct
  source 1..20: mol_type = other DNA
gccacaggttggaggcaaga

SEQ ID NO: 12388 - DNA, 21 bp, synthetic construct
  misc_feature 1..21: note = Synthetic Construct
  source 1..21: mol_type = other DNA
agtgccctgctcaaccaatac

SEQ ID NO: 12389 - DNA, 24 bp, synthetic construct
  misc_feature 1..24: note = Synthetic Construct
  source 1..24: mol_type = other DNA
tccctcttgtttccaggtttttgt

SEQ ID NO: 12390 - DNA, 20 bp, synthetic construct
  misc_feature 1..20: note = Synthetic Construct
  source 1..20: mol_type = other DNA
ggaggctccatccacagtca

SEQ ID NO: 12391 - DNA, 24 bp, synthetic construct
  misc_feature 1..24: note = Synthetic Construct
  source 1..24: mol_type = other DNA
gggcaaatctgtgtcctccagata

SEQ ID NO: 12392 - DNA, 24 bp, synthetic construct
  misc_feature 1..24: note = Synthetic Construct
  source 1..24: mol_type = other DNA
gggttacaggttgactctgggatt

SEQ ID NO: 12393 - DNA, 21 bp, synthetic construct
  misc_feature 1..21: note = Synthetic Construct
  source 1..21: mol_type = other DNA
cctagcctacaagcgcactct

SEQ ID NO: 12394 - DNA, 23 bp, synthetic construct
  misc_feature 1..23: note = Synthetic Construct
  source 1..23: mol_type = other DNA
gagtactgaggcagggaaggttt

SEQ ID NO: 12395 - DNA, 26 bp, synthetic construct
  misc_feature 1..26: note = Synthetic Construct
  source 1..26: mol_type = other DNA
ccaatgagttgtagagctcagattgt

SEQ ID NO: 12396 - DNA, 22 bp, synthetic construct
  misc_feature 1..22: note = Synthetic Construct
  source 1..22: mol_type = other DNA
gaggggtgctagtcaactgtgt

SEQ ID NO: 12397 - DNA, 20 bp, synthetic construct
  misc_feature 1..20: note = Synthetic Construct
  source 1..20: mol_type = other DNA
aatgccaagccaccctggaa

SEQ ID NO: 12398 - DNA, 22 bp, synthetic construct
  misc_feature 1..22: note = Synthetic Construct
  source 1..22: mol_type = other DNA
aggaacccacagcggtaactga

SEQ ID NO: 12399 - DNA, 19 bp, synthetic construct
  misc_feature 1..19: note = Synthetic Construct
  source 1..19: mol_type = other DNA
tgcgagctgagtgcagcat

SEQ ID NO: 12400 - DNA, 26 bp, synthetic construct
  misc_feature 1..26: note = Synthetic Construct
  source 1..26: mol_type = other DNA
ctccaagtccaggatatatgaagcaa

SEQ ID NO: 12401 - DNA, 24 bp, synthetic construct
  misc_feature 1..24: note = Synthetic Construct
  source 1..24: mol_type = other DNA
gcacagaaataatcgtgcaggaaa

SEQ ID NO: 12402 - DNA, 24 bp, synthetic construct
  misc_feature 1..24: note = Synthetic Construct
  source 1..24: mol_type = other DNA
gggagcaaacctcttaggaagaca

SEQ ID NO: 12403 - DNA, 24 bp, synthetic construct
  misc_feature 1..24: note = Synthetic Construct
  source 1..24: mol_type = other DNA
tttggggttttgggatgaggataa

SEQ ID NO: 12404 - DNA, 21 bp, synthetic construct
  misc_feature 1..21: note = Synthetic Construct
  source 1..21: mol_type = other DNA
ttcctccgcccaaccgtcttt

SEQ ID NO: 12405 - DNA, 23 bp, synthetic construct
  misc_feature 1..23: note = Synthetic Construct
  source 1..23: mol_type = other DNA
gctaccctgaagtgctgatggat

SEQ ID NO: 12406 - DNA, 26 bp, synthetic construct
  misc_feature 1..26: note = Synthetic Construct
  source 1..26: mol_type = other DNA
cttgatctgtcaagggagaagagaga

SEQ ID NO: 12407 - DNA, 23 bp, synthetic construct
  misc_feature 1..23: note = Synthetic Construct
  source 1..23: mol_type = other DNA
gcaaagggagtgatgggagatga

SEQ ID NO: 12408 - DNA, 20 bp, synthetic construct
  misc_feature 1..20: note = Synthetic Construct
  source 1..20: mol_type = other DNA
ccgactcttggtgggttgaa

SEQ ID NO: 12409 - DNA, 24 bp, synthetic construct
  misc_feature 1..24: note = Synthetic Construct
  source 1..24: mol_type = other DNA
tgtgttcctagagactctggcttt

SEQ ID NO: 12410 - DNA, 22 bp, synthetic construct
  misc_feature 1..22: note = Synthetic Construct
  source 1..22: mol_type = other DNA
accagctgtgtgagctaagttg

SEQ ID NO: 12411 - DNA, 22 bp, synthetic construct
  misc_feature 1..22: note = Synthetic Construct
  source 1..22: mol_type = other DNA
ttgcctttccctgtctttggaa

SEQ ID NO: 12412 - DNA, 22 bp, synthetic construct
  misc_feature 1..22: note = Synthetic Construct
  source 1..22: mol_type = other DNA
gcaggactaacaatggctcaga

SEQ ID NO: 12413 - DNA, 19 bp, synthetic construct
  misc_feature 1..19: note = Synthetic Construct
  source 1..19: mol_type = other DNA
caggagccacctgggaact

SEQ ID NO: 12414 - DNA, 24 bp, synthetic construct
  misc_feature 1..24: note = Synthetic Construct
  source 1..24: mol_type = other DNA
tggagaagagcaaatccatgttgt

SEQ ID NO: 12415 - DNA, 24 bp, synthetic construct
  misc_feature 1..24: note = Synthetic Construct
  source 1..24: mol_type = other DNA
ccaggacccagaagtactccctat

SEQ ID NO: 12416 - DNA, 22 bp, synthetic construct
  misc_feature 1..22: note = Synthetic Construct
  source 1..22: mol_type = other DNA
cctaccatatgcaaggcaccat

SEQ ID NO: 12417 - DNA, 22 bp, synthetic construct
  misc_feature 1..22: note = Synthetic Construct
  source 1..22: mol_type = other DNA
agaagtccaggcttcccacttg

SEQ ID NO: 12418 - DNA, 26 bp, synthetic construct
  misc_feature 1..26: note = Synthetic Construct
  source 1..26: mol_type = other DNA
gggcttgttaaatgaacccgagaagt

SEQ ID NO: 12419 - DNA, 25 bp, synthetic construct
  misc_feature 1..25: note = Synthetic Construct
  source 1..25: mol_type = other DNA
gccacagtaaaacaaagtacacagt

SEQ ID NO: 12420 - DNA, 23 bp, synthetic construct
  misc_feature 1..23: note = Synthetic Construct
  source 1..23: mol_type = other DNA
tgtgcagtgaatgcagagactat

SEQ ID NO: 12421 - DNA, 24 bp, synthetic construct
  misc_feature 1..24: note = Synthetic Construct
  source 1..24: mol_type = other DNA
ctcacaagcctagaagggtatgtt

SEQ ID NO: 12422 - DNA, 22 bp, synthetic construct
  misc_feature 1..22: note = Synthetic Construct
  source 1..22: mol_type = other DNA
atgggacacctccctgctgagt

SEQ ID NO: 12423 - DNA, 25 bp, synthetic construct
  misc_feature 1..25: note = Synthetic Construct
  source 1..25: mol_type = other DNA
ggtgtagcagggagagagattggtt

SEQ ID NO: 12424 - DNA, 22 bp, synthetic construct
  misc_feature 1..22: note = Synthetic Construct
  source 1..22: mol_type = other DNA
ggccttgttgcctctccactta

SEQ ID NO: 12425 - DNA, 25 bp, synthetic construct
  misc_feature 1..25: note = Synthetic Construct
  source 1..25: mol_type = other DNA
cacttcatagtgtcaccctggttgt

SEQ ID NO: 12426 - DNA, 22 bp, synthetic construct
  misc_feature 1..22: note = Synthetic Construct
  source 1..22: mol_type = other DNA
agaagctgctttctgcttgtca

SEQ ID NO: 12427 - DNA, 25 bp, synthetic construct
  misc_feature 1..25: note = Synthetic Construct
  source 1..25: mol_type = other DNA
gattgtttgtgctccagaaagaaga

SEQ ID NO: 12428 - DNA, 22 bp, synthetic construct
  misc_feature 1..22: note = Synthetic Construct
  source 1..22: mol_type = other DNA
gaacagttggcgataggctgaa

SEQ ID NO: 12429 - DNA, 22 bp, synthetic construct
  misc_feature 1..22: note = Synthetic Construct
  source 1..22: mol_type = other DNA
ggccctatactgccttcagaga

SEQ ID NO: 12430 - DNA, 26 bp, synthetic construct
  misc_feature 1..26: note = Synthetic Construct
  source 1..26: mol_type = other DNA
cacaggtgatagcaacaacctaccat

SEQ ID NO: 12431 - DNA, 24 bp, synthetic construct
  misc_feature 1..24: note = Synthetic Construct
  source 1..24: mol_type = other DNA
ccttgggtggaacctgtgattcaa

SEQ ID NO: 12432 - DNA, 21 bp, synthetic construct
  misc_feature 1..21: note = Synthetic Construct
  source 1..21: mol_type = other DNA
aggcaccatgctcagctccta

SEQ ID NO: 12433 - DNA, 22 bp, synthetic construct
  misc_feature 1..22: note = Synthetic Construct
  source 1..22: mol_type = other DNA
gctcaaagccttggggttctac

SEQ ID NO: 12434 - DNA, 21 bp, synthetic construct
  misc_feature 1..21: note = Synthetic Construct
  source 1..21: mol_type = other DNA
gctccaatgtcagtcccttca

SEQ ID NO: 12435 - DNA, 22 bp, synthetic construct
  misc_feature 1..22: note = Synthetic Construct
  source 1..22: mol_type = other DNA
gctggagttccaggttggactt

SEQ ID NO: 12436 - DNA, 19 bp, synthetic construct
  misc_feature 1..19: note = Synthetic Construct
  source 1..19: mol_type = other DNA
gggcaccccaccattggaa

SEQ ID NO: 12437 - DNA, 22 bp, synthetic construct
  misc_feature 1..22: note = Synthetic Construct
  source 1..22: mol_type = other DNA
gccagtctgtggtgttcattgt

SEQ ID NO: 12438 - DNA, 21 bp, synthetic construct
  misc_feature 1..21: note = Synthetic Construct
  source 1..21: mol_type = other DNA
caccctgggaagctgactgta

SEQ ID NO: 12439 - DNA, 22 bp, synthetic construct
  misc_feature 1..22: note = Synthetic Construct
  source 1..22: mol_type = other DNA
gtggcatctgaggtgagctttg

SEQ ID NO: 12440 - DNA, 24 bp, synthetic construct
  misc_feature 1..24: note = Synthetic Construct
  source 1..24: mol_type = other DNA
gccggtagttgtgacaataggaaa

SEQ ID NO: 12441 - DNA, 25 bp, synthetic construct
  misc_feature 1..25: note = Synthetic Construct
  source 1..25: mol_type = other DNA
gggcgtacttcctttttcattctac

SEQ ID NO: 12442 - DNA, 22 bp, synthetic construct
  misc_feature 1..22: note = Synthetic Construct
  source 1..22: mol_type = other DNA
tctaggctggactggacaccaa

SEQ ID NO: 12443 - DNA, 26 bp, synthetic construct
  misc_feature 1..26: note = Synthetic Construct
  source 1..26: mol_type = other DNA
gagtttcctgttctgggtatgggttt

SEQ ID NO: 12444 - DNA, 22 bp, synthetic construct
  misc_feature 1..22: note = Synthetic Construct
  source 1..22: mol_type = other DNA
gagacacctggaaggacgaaca

SEQ ID NO: 12445 - DNA, 23 bp, synthetic construct
  misc_feature 1..23: note = Synthetic Construct
  source 1..23: mol_type = other DNA
gcttgcctgagaaatgcctgtga

SEQ ID NO: 12446 - DNA, 20 bp, synthetic construct
  misc_feature 1..20: note = Synthetic Construct
  source 1..20: mol_type = other DNA
cccacacacaactgctcaca

SEQ ID NO: 12447 - DNA, 19 bp, synthetic construct
  misc_feature 1..19: note = Synthetic Construct
  source 1..19: mol_type = other DNA
tggcaggacaaggggtttg

SEQ ID NO: 12448 - DNA, 24 bp, synthetic construct
  misc_feature 1..24: note = Synthetic Construct
  source 1..24: mol_type = other DNA
cctattcccatggagccattgttg

SEQ ID NO: 12449 - DNA, 20 bp, synthetic construct
  misc_feature 1..20: note = Synthetic Construct
  source 1..20: mol_type = other DNA
accttgctgagggagcagta

SEQ ID NO: 12450 - DNA, 23 bp, synthetic construct
  misc_feature 1..23: note = Synthetic Construct
  source 1..23: mol_type = other DNA
caaggcagatgggagaagagcaa

SEQ ID NO: 12451 - DNA, 19 bp, synthetic construct
  misc_feature 1..19: note = Synthetic Construct
  source 1..19: mol_type = other DNA
ccaccttccagccccttga

SEQ ID NO: 12452 - DNA, 20 bp, synthetic construct
  misc_feature 1..20: note = Synthetic Construct
  source 1..20: mol_type = other DNA
gcaacatcctggggcacaga

SEQ ID NO: 12453 - DNA, 20 bp, synthetic construct
  misc_feature 1..20: note = Synthetic Construct
  source 1..20: mol_type = other DNA
tcccaacacaggtggctaga

SEQ ID NO: 12454 - DNA, 26 bp, synthetic construct
  misc_feature 1..26: note = Synthetic Construct
  source 1..26: mol_type = other DNA
ggagtggatgcagaagtgtttctttc

SEQ ID NO: 12455 - DNA, 24 bp, synthetic construct
  misc_feature 1..24: note = Synthetic Construct
  source 1..24: mol_type = other DNA
gtacactagcaagtaccggtgaga

SEQ ID NO: 12456 - DNA, 20 bp, synthetic construct
  misc_feature 1..20: note = Synthetic Construct
  source 1..20: mol_type = other DNA
tgaggcttgtttccgcatgt

SEQ ID NO: 12457 - DNA, 26 bp, synthetic construct
  misc_feature 1..26: note = Synthetic Construct
  source 1..26: mol_type = other DNA
actggactacactggactactttgat

SEQ ID NO: 12458 - DNA, 22 bp, synthetic construct
  misc_feature 1..22: note = Synthetic Construct
  source 1..22: mol_type = other DNA
ccaagagcccacctgattctct

SEQ ID NO: 12459 - DNA, 22 bp, synthetic construct
  misc_feature 1..22: note = Synthetic Construct
  source 1..22: mol_type = other DNA
tgataggcaaacagcagacagt

SEQ ID NO: 12460 - DNA, 20 bp, synthetic construct
  misc_feature 1..20: note = Synthetic Construct
  source 1..20: mol_type = other DNA
cccgcgttacaatgcaactt

SEQ ID NO: 12461 - DNA, 24 bp, synthetic construct
  misc_feature 1..24: note = Synthetic Construct
  source 1..24: mol_type = other DNA
cacttccaaaaggcagctacaatc

SEQ ID NO: 12462 - DNA, 20 bp, synthetic construct
  misc_feature 1..20: note = Synthetic Construct
  source 1..20: mol_type = other DNA
tgcctggtgatcctccatca

SEQ ID NO: 12463 - DNA, 23 bp, synthetic construct
  misc_feature 1..23: note = Synthetic Construct
  source 1..23: mol_type = other DNA
gctgcaaacgagaagtaaagcat

SEQ ID NO: 12464 - DNA, 21 bp, synthetic construct
  misc_feature 1..21: note = Synthetic Construct
  source 1..21: mol_type = other DNA
gccctatgcacattggcttgt

SEQ ID NO: 12465 - DNA, 21 bp, synthetic construct
  misc_feature 1..21: note = Synthetic Construct
  source 1..21: mol_type = other DNA
aaggactgagcaatggctgtt

SEQ ID NO: 12466 - DNA, 20 bp, synthetic construct
  misc_feature 1..20: note = Synthetic Construct
  source 1..20: mol_type = other DNA
ggccgcagagcctcaacttt

SEQ ID NO: 12467 - DNA, 26 bp, synthetic construct
  misc_feature 1..26: note = Synthetic Construct
  source 1..26: mol_type = other DNA
ggagtctgcagtttgaggtttatatg

SEQ ID NO: 12468 - DNA, 24 bp, synthetic construct
  misc_feature 1..24: note = Synthetic Construct
  source 1..24: mol_type = other DNA
cctgtttcaggattaagggcttct

SEQ ID NO: 12469 - DNA, 21 bp, synthetic construct
  misc_feature 1..21: note = Synthetic Construct
  source 1..21: mol_type = other DNA
agctttggggtccctcagtat

SEQ ID NO: 12470 - DNA, 23 bp, synthetic construct
  misc_feature 1..23: note = Synthetic Construct
  source 1..23: mol_type = other DNA
agatcaaatcaccccagctttgt

SEQ ID NO: 12471 - DNA, 21 bp, synthetic construct
  misc_feature 1..21: note = Synthetic Construct
  source 1..21: mol_type = other DNA
cacacatgtccctgcagtttg

SEQ ID NO: 12472 - DNA, 21 bp, synthetic construct
  misc_feature 1..21: note = Synthetic Construct
  source 1..21: mol_type = other DNA
gcgtctgactcatgtcctgtt

SEQ ID NO: 12473 - DNA, 22 bp, synthetic construct
  misc_feature 1..22: note = Synthetic Construct
  source 1..22: mol_type = other DNA
ccggcttctttaccccacttag

SEQ ID NO: 12474 - DNA, 19 bp, synthetic construct
  misc_feature 1..19: note = Synthetic Construct
  source 1..19: mol_type = other DNA
caccccagaccccaagttc

SEQ ID NO: 12475 - DNA, 20 bp, synthetic construct
  misc_feature 1..20: note = Synthetic Construct
  source 1..20: mol_type = other DNA
agcctgtctgccacctgaaa

SEQ ID NO: 12476 - DNA, 19 bp, synthetic construct
  misc_feature 1..19: note = Synthetic Construct
  source 1..19: mol_type = other DNA
ggagcagagcgaccgtcat

SEQ ID NO: 12477 - DNA, 24 bp, synthetic construct
  misc_feature 1..24: note = Synthetic Construct
  source 1..24: mol_type = other DNA
gcactggactagtattcgggagat

SEQ ID NO: 12478 - DNA, 23 bp, synthetic construct
  misc_feature 1..23: note = Synthetic Construct
  source 1..23: mol_type = other DNA
ctcttctggcacaaggtgtgtct

SEQ ID NO: 12479 - DNA, 23 bp, synthetic construct
  misc_feature 1..23: note = Synthetic Construct
  source 1..23: mol_type = other DNA
caccagcaaagagggaagttaga

SEQ ID NO: 12480 - DNA, 24 bp, synthetic construct
  misc_feature 1..24: note = Synthetic Construct
  source 1..24: mol_type = other DNA
gatgtcaacgtactgactccaaca

SEQ ID NO: 12481 - DNA, 21 bp, synthetic construct
  misc_feature 1..21: note = Synthetic Construct
  source 1..21: mol_type = other DNA
ccaccagcttcattggtctct

SEQ ID NO: 12482 - DNA, 24 bp, synthetic construct
  misc_feature 1..24: note = Synthetic Construct
  source 1..24: mol_type = other DNA
gggatggttatcatgcccctcttc

SEQ ID NO: 12483 - DNA, 23 bp, synthetic construct
  misc_feature 1..23: note = Synthetic Construct
  source 1..23: mol_type = other DNA
ggttctagatcccgctctcttct

SEQ ID NO: 12484 - DNA, 24 bp, synthetic construct
  misc_feature 1..24: note = Synthetic Construct
  source 1..24: mol_type = other DNA
ctctggtacctgaaccttcccatt

SEQ ID NO: 12485 - DNA, 21 bp, synthetic construct
  misc_feature 1..21: note = Synthetic Construct
  source 1..21: mol_type = other DNA
tgcttcgaggagaggtagtga

SEQ ID NO: 12486 - DNA, 21 bp, synthetic construct
  misc_feature 1..21: note = Synthetic Construct
  source 1..21: mol_type = other DNA
gcacttgactcacagggagaa

SEQ ID NO: 12487 - DNA, 22 bp, synthetic construct
  misc_feature 1..22: note = Synthetic Construct
  source 1..22: mol_type = other DNA
gttatggcagctgacaccagta

SEQ ID NO: 12488 - DNA, 23 bp, synthetic construct
  misc_feature 1..23: note = Synthetic Construct
  source 1..23: mol_type = other DNA
gtcacagattcagggagaagcaa

SEQ ID NO: 12489 - DNA, 22 bp, synthetic construct
  misc_feature 1..22: note = Synthetic Construct
  source 1..22: mol_type = other DNA
cagccttttccctaggcaatgt

SEQ ID NO: 12490 - DNA, 25 bp, synthetic construct
  misc_feature 1..25: note = Synthetic Construct
  source 1..25: mol_type = other DNA
gctctggctactgctattggtgtga

SEQ ID NO: 12491 - DNA, 23 bp, synthetic construct
  misc_feature 1..23: note = Synthetic Construct
  source 1..23: mol_type = other DNA
acacaaagagttcgatggccttt

SEQ ID NO: 12492 - DNA, 23 bp, synthetic construct
  misc_feature 1..23: note = Synthetic Construct
  source 1..23: mol_type = other DNA
tgtttccagacaagccaacaagt

SEQ ID NO: 12493 - DNA, 23 bp, synthetic construct
  misc_feature 1..23: note = Synthetic Construct
  source 1..23: mol_type = other DNA
ggcagagcagcttctttccatct

SEQ ID NO: 12494 - DNA, 19 bp, synthetic construct
  misc_feature 1..19: note = Synthetic Construct
  source 1..19: mol_type = other DNA
gtccagcctcggagcaaaa

SEQ ID NO: 12495 - DNA, 24 bp, synthetic construct
  misc_feature 1..24: note = Synthetic Construct
  source 1..24: mol_type = other DNA
tcactatgaaccctaccaccacta

SEQ ID NO: 12496 - DNA, 21 bp, synthetic construct
  misc_feature 1..21: note = Synthetic Construct
  source 1..21: mol_type = other DNA
cccctgccttcctggtagtaa

SEQ ID NO: 12497 - DNA, 19 bp, synthetic construct
  misc_feature 1..19: note = Synthetic Construct
  source 1..19: mol_type = other DNA
aaggcgaccctccggaaca

SEQ ID NO: 12498 - DNA, 20 bp, synthetic construct
  misc_feature 1..20: note = Synthetic Construct
  source 1..20: mol_type = other DNA
aggcggagctctaagcacta

SEQ ID NO: 12499 - DNA, 24 bp, synthetic construct
  misc_feature 1..24: note = Synthetic Construct
  source 1..24: mol_type = other DNA
atgagctctgcagtcattgaattg

SEQ ID NO: 12500 - DNA, 20 bp, synthetic construct
  misc_feature 1..20: note = Synthetic Construct
  source 1..20: mol_type = other DNA
ctggctgctatgcactcaga

SEQ ID NO: 12501 - DNA, 23 bp, synthetic construct
  misc_feature 1..23: note = Synthetic Construct
  source 1..23: mol_type = other DNA
gcttcgtgcttttacctgactgt

SEQ ID NO: 12502 - DNA, 22 bp, synthetic construct
  misc_feature 1..22: note = Synthetic Construct
  source 1..22: mol_type = other DNA
ccaaggacagacctcccagaga

SEQ ID NO: 12503 - DNA, 27 bp, synthetic construct
  misc_feature 1..27: note = Synthetic Construct
  source 1..27: mol_type = other DNA
ggggttacttaccggtcagacaaattc

SEQ ID NO: 12504 - DNA, 24 bp, synthetic construct
  misc_feature 1..24: note = Synthetic Construct
  source 1..24: mol_type = other DNA
gcagaagcatcactgcgtaatatc

SEQ ID NO: 12505 - DNA, 23 bp, synthetic construct
  misc_feature 1..23: note = Synthetic Construct
  source 1..23: mol_type = other DNA
accatcctccccatctcagtaaa

SEQ ID NO: 12506 - DNA, 26 bp, synthetic construct
  misc_feature 1..26: note = Synthetic Construct
  source 1..26: mol_type = other DNA
cgtctccatttctgtatccctctcaa

SEQ ID NO: 12507 - DNA, 23 bp, synthetic construct
  misc_feature 1..23: note = Synthetic Construct
  source 1..23: mol_type = other DNA
gtggggtaacggtttaggagttg

SEQ ID NO: 12508 - DNA, 25 bp, synthetic construct
  misc_feature 1..25: note = Synthetic Construct
  source 1..25: mol_type = other DNA
ccttaattactgccgattgcctgtt

SEQ ID NO: 12509 - DNA, 23 bp, synthetic construct
  misc_feature 1..23: note = Synthetic Construct
  source 1..23: mol_type = other DNA
agcctggagaacaaaaggtgaaa

SEQ ID NO: 12510 - DNA, 20 bp, synthetic construct
  misc_feature 1..20: note = Synthetic Construct
  source 1..20: mol_type = other DNA
cgaggcaatttcccctgcaa

SEQ ID NO: 12511 - DNA, 22 bp, synthetic construct
  misc_feature 1..22: note = Synthetic Construct
  source 1..22: mol_type = other DNA
gaggtgacatgcctgttgtcat

SEQ ID NO: 12512 - DNA, 26 bp, synthetic construct
  misc_feature 1..26: note = Synthetic Construct
  source 1..26: mol_type = other DNA
gcccttctagtgaatgtttgggttca

SEQ ID NO: 12513 - DNA, 23 bp, synthetic construct
  misc_feature 1..23: note = Synthetic Construct
  source 1..23: mol_type = other DNA
ccaacaatctctgtgcctctact

SEQ ID NO: 12514 - DNA, 23 bp, synthetic construct
  misc_feature 1..23: note = Synthetic Construct
  source 1..23: mol_type = other DNA
ccctgcctaaaggtctccaaaac

SEQ ID NO: 12515 - DNA, 21 bp, synthetic construct
  misc_feature 1..21: note = Synthetic Construct
  source 1..21: mol_type = other DNA
tgagggctatcctcgaccttt

SEQ ID NO: 12516 - DNA, 25 bp, synthetic construct
  misc_feature 1..25: note = Synthetic Construct
  source 1..25: mol_type = other DNA
gtggtagctactgaatcagccctat

SEQ ID NO: 12517 - DNA, 21 bp, synthetic construct
  misc_feature 1..21: note = Synthetic Construct
  source 1..21: mol_type = other DNA
tccaggtgaaagcaggtcaag

SEQ ID NO: 12518 - DNA, 24 bp, synthetic construct
  misc_feature 1..24: note = Synthetic Construct
  source 1..24: mol_type = other DNA
gcagataaagcaaaagggtgactt

SEQ ID NO: 12519 - DNA, 22 bp, synthetic construct
  misc_feature 1..22: note = Synthetic Construct
  source 1..22: mol_type = other DNA
tccaggtcactgcctcatagat

SEQ ID NO: 12520 - DNA, 21 bp, synthetic construct
  misc_feature 1..21: note = Synthetic Construct
  source 1..21: mol_type = other DNA
tgtgggaggagaggtcaccat

SEQ ID NO: 12521 - DNA, 20 bp, synthetic construct
  misc_feature 1..20: note = Synthetic Construct
  source 1..20: mol_type = other DNA
agggcctagcggtcaacatt

SEQ ID NO: 12522 - DNA, 25 bp, synthetic construct
  misc_feature 1..25: note = Synthetic Construct
  source 1..25: mol_type = other DNA
gggcaacagaagtaacatccattag

SEQ ID NO: 12523 - DNA, 22 bp, synthetic construct
  misc_feature 1..22: note = Synthetic Construct
  source 1..22: mol_type = other DNA
tctgctacagtctttgcgttca

SEQ ID NO: 12524 - DNA, 22 bp, synthetic construct
  misc_feature 1..22: note = Synthetic Construct
  source 1..22: mol_type = other DNA
tgaccttttcagcttccgttgt

SEQ ID NO: 12525 - DNA, 20 bp, synthetic construct
  misc_feature 1..20: note = Synthetic Construct
  source 1..20: mol_type = other DNA
tggaggaccaaagccctcat

SEQ ID NO: 12526 - DNA, 23 bp, synthetic construct
  misc_feature 1..23: note = Synthetic Construct
  source 1..23: mol_type = other DNA
gtgacacctctgcctttgcatgt

SEQ ID NO: 12527 - DNA, 23 bp, synthetic construct
  misc_feature 1..23: note = Synthetic Construct
  source 1..23: mol_type = other DNA
tctgggatttgagcatggaactt

SEQ ID NO: 12528 - DNA, 24 bp, synthetic construct
  misc_feature 1..24: note = Synthetic Construct
  source 1..24: mol_type = other DNA
gaccgtctactaacagcaccaagt

SEQ ID NO: 12529 - DNA, 23 bp, synthetic construct
  misc_feature 1..23: note = Synthetic Construct
  source 1..23: mol_type = other DNA
ggtgtaagactaggctccctcta

SEQ ID NO: 12530 - DNA, 22 bp, synthetic construct
  misc_feature 1..22: note = Synthetic Construct
  source 1..22: mol_type = other DNA
ggggcgtagtgaatctccaatg

SEQ ID NO: 12531 - DNA, 21 bp, synthetic construct
  misc_feature 1..21: note = Synthetic Construct
  source 1..21: mol_type = other DNA
accaccacactccccttctct

SEQ ID NO: 12532 - DNA, 27 bp, synthetic construct
  misc_feature 1..27: note = Synthetic Construct
  source 1..27: mol_type = other DNA
gagaggtcaaagacaggagactgaatc

SEQ ID NO: 12533 - DNA, 23 bp, synthetic construct
  misc_feature 1..23: note = Synthetic Construct
  source 1..23: mol_type = other DNA
ggcataggtgacatgccatcaga

SEQ ID NO: 12534 - DNA, 24 bp, synthetic construct
  misc_feature 1..24: note = Synthetic Construct
  source 1..24: mol_type = other DNA
cagacaatggaactacgcctgcat

SEQ ID NO: 12535 - DNA, 25 bp, synthetic construct
  misc_feature 1..25: note = Synthetic Construct
  source 1..25: mol_type = other DNA
cgcctgagcttagacttcacctaca

SEQ ID NO: 12536 - DNA, 21 bp, synthetic construct
  misc_feature 1..21: note = Synthetic Construct
  source 1..21: mol_type = other DNA
tccccacctggagcccaaaat

SEQ ID NO: 12537 - DNA, 22 bp, synthetic construct
  misc_feature 1..22: note = Synthetic Construct
  source 1..22: mol_type = other DNA
ctgtccagacttgtccccaaga

SEQ ID NO: 12538 - DNA, 22 bp, synthetic construct
  misc_feature 1..22: note = Synthetic Construct
  source 1..22: mol_type = other DNA
aggagacagtgcaagcttttgt

SEQ ID NO: 12539 - DNA, 23 bp, synthetic construct
  misc_feature 1..23: note = Synthetic Construct
  source 1..23: mol_type = other DNA
tggactcactgttctccaagtga

SEQ ID NO: 12540 - DNA, 22 bp, synthetic construct
  misc_feature 1..22: note = Synthetic Construct
  source 1..22: mol_type = other DNA
gccctggtgaatgcacattttg

SEQ ID NO: 12541 - DNA, 20 bp, synthetic construct
  misc_feature 1..20: note = Synthetic Construct
  source 1..20: mol_type = other DNA
tggcatcgaggatggcatga

SEQ ID NO: 12542 - DNA, 24 bp, synthetic construct
  misc_feature 1..24: note = Synthetic Construct
  source 1..24: mol_type = other DNA
tcctgtttgttatgggaaccaagt

SEQ ID NO: 12543 - DNA, 22 bp, synthetic construct
  misc_feature 1..22: note = Synthetic Construct
  source 1..22: mol_type = other DNA
gcatccagcccaaatcctcact

SEQ ID NO: 12544 - DNA, 21 bp, synthetic construct
  misc_feature 1..21: note = Synthetic Construct
  source 1..21: mol_type = other DNA
tcctccctgagaccacagctt

SEQ ID NO: 12545 - DNA, 24 bp, synthetic construct
  misc_feature 1..24: note = Synthetic Construct
  source 1..24: mol_type = other DNA
ccatcacccatttacccctacttg

SEQ ID NO: 12546 - DNA, 20 bp, synthetic construct
  misc_feature 1..20: note = Synthetic Construct
  source 1..20: mol_type = other DNA
actggctgtcaggcttgctt

SEQ ID NO: 12547 - DNA, 25 bp, synthetic construct
  misc_feature 1..25: note = Synthetic Construct
  source 1..25: mol_type = other DNA
gcacgagatgaactaagacaccatt

SEQ ID NO: 12548 - DNA, 25 bp, synthetic construct
  misc_feature 1..25: note = Synthetic Construct
  source 1..25: mol_type = other DNA
gagggaatggtacctggattagcaa

SEQ ID NO: 12549 - DNA, 24 bp, synthetic construct
  misc_feature 1..24: note = Synthetic Construct
  source 1..24: mol_type = other DNA
tgccacttcacccatactgaattt

SEQ ID NO: 12550 - DNA, 22 bp, synthetic construct
  misc_feature 1..22: note = Synthetic Construct
  source 1..22: mol_type = other DNA
cacactgccacctgcttgagta

SEQ ID NO: 12551 - DNA, 22 bp, synthetic construct
  misc_feature 1..22: note = Synthetic Construct
  source 1..22: mol_type = other DNA
tgatgagtggaagcccatgttg

SEQ ID NO: 12552 - DNA, 23 bp, synthetic construct
  misc_feature 1..23: note = Synthetic Construct
  source 1..23: mol_type = other DNA
tgctcatcatggctatgctttct

SEQ ID NO: 12553 - DNA, 22 bp, synthetic construct
  misc_feature 1..22: note = Synthetic Construct
  source 1..22: mol_type = other DNA
gctgatccagagatggacacaa

SEQ ID NO: 12554 - DNA, 21 bp, synthetic construct
  misc_feature 1..21: note = Synthetic Construct
  source 1..21: mol_type = other DNA
gcagtgctgtctatgccaatg

SEQ ID NO: 12555 - DNA, 24 bp, synthetic construct
  misc_feature 1..24: note = Synthetic Construct
  source 1..24: mol_type = other DNA
gccagatgtggagttaacaagtca

SEQ ID NO: 12556 - DNA, 25 bp, synthetic construct
  misc_feature 1..25: note = Synthetic Construct
  source 1..25: mol_type = other DNA
tgacttaacaggtgacctagacaca

SEQ ID NO: 12557 - DNA, 19 bp, synthetic construct
  misc_feature 1..19: note = Synthetic Construct
  source 1..19: mol_type = other DNA
ccttggaggccagcaacaa

SEQ ID NO: 12558 - DNA, 26 bp, synthetic construct
  misc_feature 1..26: note = Synthetic Construct
  source 1..26: mol_type = other DNA
gaggcactgattcattcaacaggatt

SEQ ID NO: 12559 - DNA, 24 bp, synthetic construct
  misc_feature 1..24: note = Synthetic Construct
  source 1..24: mol_type = other DNA
cccatgggtaaactgctgtaagta

SEQ ID NO: 12560 - DNA, 22 bp, synthetic construct
  misc_feature 1..22: note = Synthetic Construct
  source 1..22: mol_type = other DNA
caggcctcaaaacacgaagaag

SEQ ID NO: 12561 - DNA, 23 bp, synthetic construct
  misc_feature 1..23: note = Synthetic Construct
  source 1..23: mol_type = other DNA
ggggagaagtgtcaccagattca

SEQ ID NO: 12562 - DNA, 24 bp, synthetic construct
  misc_feature 1..24: note = Synthetic Construct
  source 1..24: mol_type = other DNA
gcgggttaggaagattccctgaag

SEQ ID NO: 12563 - DNA, 24 bp, synthetic construct
  misc_feature 1..24: note = Synthetic Construct
  source 1..24: mol_type = other DNA
cttcctcacccgtccttaataaca

SEQ ID NO: 12564 - DNA, 23 bp, synthetic construct
  misc_feature 1..23: note = Synthetic Construct
  source 1..23: mol_type = other DNA
ggtgctttcctttccaccgaagt

SEQ ID NO: 12565 - DNA, 23 bp, synthetic construct
  misc_feature 1..23: note = Synthetic Construct
  source 1..23: mol_type = other DNA
gggaggaacagtgatctgagcat

SEQ ID NO: 12566 - DNA, 27 bp, synthetic construct
  misc_feature 1..27: note = Synthetic Construct
  source 1..27: mol_type = other DNA
gagaattaaacagggctttgagggatt

SEQ ID NO: 12567 - DNA, 22 bp, synthetic construct
  misc_feature 1..22: note = Synthetic Construct
  source 1..22: mol_type = other DNA
caccgagcactcgggtgaataa

SEQ ID NO: 12568 - DNA, 24 bp, synthetic construct
  misc_feature 1..24: note = Synthetic Construct
  source 1..24: mol_type = other DNA
ttgatggctcccatgtaagtttga

SEQ ID NO: 12569 - DNA, 23 bp, synthetic construct
  misc_feature 1..23: note = Synthetic Construct
  source 1..23: mol_type = other DNA
cgaagaagcaagaccgcagtaac

SEQ ID NO: 12570 - DNA, 23 bp, synthetic construct
  misc_feature 1..23: note = Synthetic Construct
  source 1..23: mol_type = other DNA
ctctggggaatgcctaacaatga

SEQ ID NO: 12571 - DNA, 22 bp, synthetic construct
  misc_feature 1..22: note = Synthetic Construct
  source 1..22: mol_type = other DNA
cagcaatgaggccagcgtagtt

SEQ ID NO: 12572 - DNA, 28 bp, synthetic construct
  misc_feature 1..28: note = Synthetic Construct
  source 1..28: mol_type = other DNA
ccctatccagaaagaaaaagccaagtga

SEQ ID NO: 12573 - DNA, 23 bp, synthetic construct
  misc_feature 1..23: note = Synthetic Construct
  source 1..23: mol_type = other DNA
ccttcctgcaagtcaaggactca

SEQ ID NO: 12574 - DNA, 22 bp, synthetic construct
  misc_feature 1..22: note = Synthetic Construct
  source 1..22: mol_type = other DNA
gccgtaggtagttccatgctaa

SEQ ID NO: 12575 - DNA, 22 bp, synthetic construct
  misc_feature 1..22: note = Synthetic Construct
  source 1..22: mol_type = other DNA
catcctcttgccgtgtgtgact

SEQ ID NO: 12576 - DNA, 22 bp, synthetic construct
  misc_feature 1..22: note = Synthetic Construct
  source 1..22: mol_type = other DNA
caagtagcgttcatcccaggaa

SEQ ID NO: 12577 - DNA, 22 bp, synthetic construct
  misc_feature 1..22: note = Synthetic Construct
  source 1..22: mol_type = other DNA
gcccctgaaattggaagcaaat

SEQ ID NO: 12578 - DNA, 21 bp, synthetic construct
  misc_feature 1..21: note = Synthetic Construct
  source 1..21: mol_type = other DNA
gccacaggtcgccttctgaac

SEQ ID NO: 12579 - DNA, 26 bp, synthetic construct
  misc_feature 1..26: note = Synthetic Construct
  source 1..26: mol_type = other DNA
ggcaacactctgtacaactccttact

SEQ ID NO: 12580 - DNA, 23 bp, synthetic construct
  misc_feature 1..23: note = Synthetic Construct
  source 1..23: mol_type = other DNA
aggcccttcaagaagttgaaaca

SEQ ID NO: 12581 - DNA, 23 bp, synthetic construct
  misc_feature 1..23: note = Synthetic Construct
  source 1..23: mol_type = other DNA
cccgtgtagccaagagactgaag

SEQ ID NO: 12582 - DNA, 21 bp, synthetic construct
  misc_feature 1..21: note = Synthetic Construct
  source 1..21: mol_type = other DNA
tgtgtggtacaggcccgatct

SEQ ID NO: 12583 - DNA, 22 bp, synthetic construct
  misc_feature 1..22: note = Synthetic Construct
  source 1..22: mol_type = other DNA
gctctcaaggactttgcagtct

SEQ ID NO: 12584 - DNA, 22 bp, synthetic construct
  misc_feature 1..22: note = Synthetic Construct
  source 1..22: mol_type = other DNA
gagggaggtgctttgctgtcaa

SEQ ID NO: 12585 - DNA, 23 bp, synthetic construct
  misc_feature 1..23: note = Synthetic Construct
  source 1..23: mol_type = other DNA
ggctctgtgaggatggagagagt

SEQ ID NO: 12586 - DNA, 22 bp, synthetic construct
  misc_feature 1..22: note = Synthetic Construct
  source 1..22: mol_type = other DNA
gccaggggaagtggtgtttaag

SEQ ID NO: 12587 - DNA, 24 bp, synthetic construct
  misc_feature 1..24: note = Synthetic Construct
  source 1..24: mol_type = other DNA
gtagactccacaccttcctacctt

SEQ ID NO: 12588 - DNA, 25 bp, synthetic construct
  misc_feature 1..25: note = Synthetic Construct
  source 1..25: mol_type = other DNA
tctcctggaaatgtgaacaggattg

SEQ ID NO: 12589 - DNA, 20 bp, synthetic construct
  misc_feature 1..20: note = Synthetic Construct
  source 1..20: mol_type = other DNA
ctcgctgcatctgagtgagt

SEQ ID NO: 12590 - DNA, 21 bp, synthetic construct
  misc_feature 1..21: note = Synthetic Construct
  source 1..21: mol_type = other DNA
tcggatgcttcctgggcaaag

SEQ ID NO: 12591 - DNA, 19 bp, synthetic construct
  misc_feature 1..19: note = Synthetic Construct
  source 1..19: mol_type = other DNA
caaccgctcaggctgtgaa

SEQ ID NO: 12592 - DNA, 24 bp, synthetic construct
  misc_feature 1..24: note = Synthetic Construct
  source 1..24: mol_type = other DNA
gatgataagcctgtccctgagatg

SEQ ID NO: 12593 - DNA, 24 bp, synthetic construct
  misc_feature 1..24: note = Synthetic Construct
  source 1..24: mol_type = other DNA
caggagggagaaagctttggaaga

SEQ ID NO: 12594 - DNA, 27 bp, synthetic construct
  misc_feature 1..27: note = Synthetic Construct
  source 1..27: mol_type = other DNA
catccgtctcttcactagctgttaaat

SEQ ID NO: 12595 - DNA, 21 bp, synthetic construct
  misc_feature 1..21: note = Synthetic Construct
  source 1..21: mol_type = other DNA
gtccctctgcttcctgccata

SEQ ID NO: 12596 - DNA, 22 bp, synthetic construct
  misc_feature 1..22: note = Synthetic Construct
  source 1..22: mol_type = other DNA
gctgtactcctgggtgacattc

SEQ ID NO: 12597 - DNA, 22 bp, synthetic construct
  misc_feature 1..22: note = Synthetic Construct
  source 1..22: mol_type = other DNA
agccctctgattccaggtaaga

SEQ ID NO: 12598 - DNA, 22 bp, synthetic construct
  misc_feature 1..22: note = Synthetic Construct
  source 1..22: mol_type = other DNA
tcgatggcagagacaaatgaca

SEQ ID NO: 12599 - DNA, 22 bp, synthetic construct
  misc_feature 1..22: note = Synthetic Construct
  source 1..22: mol_type = other DNA
cagggtcacacactcgggtatt

SEQ ID NO: 12600 - DNA, 22 bp, synthetic construct
  misc_feature 1..22: note = Synthetic Construct
  source 1..22: mol_type = other DNA
ctccagcagacagcatgcaaac

SEQ ID NO: 12601 - DNA, 24 bp, synthetic construct
  misc_feature 1..24: note = Synthetic Construct
  source 1..24: mol_type = other DNA
gcacacctgaaggtcaaacgaaca

SEQ ID NO: 12602 - DNA, 24 bp, synthetic construct
  misc_feature 1..24: note = Synthetic Construct
  source 1..24: mol_type = other DNA
gttgatggtcgcattccagatgta

SEQ ID NO: 12603 - DNA, 20 bp, synthetic construct
  misc_feature 1..20: note = Synthetic Construct
  source 1..20: mol_type = other DNA
tgtggcctggctcagacata

SEQ ID NO: 12604 - DNA, 20 bp, synthetic construct
  misc_feature 1..20: note = Synthetic Construct
  source 1..20: mol_type = other DNA
ttgcggccactgtcactact

SEQ ID NO: 12605 - DNA, 25 bp, synthetic construct
  misc_feature 1..25: note = Synthetic Construct
  source 1..25: mol_type = other DNA
caaatcctttgtgggtgttaagtgt

SEQ ID NO: 12606 - DNA, 21 bp, synthetic construct
  misc_feature 1..21: note = Synthetic Construct
  source 1..21: mol_type = other DNA
tgccctgatggataggtggat

SEQ ID NO: 12607 - DNA, 22 bp, synthetic construct
  misc_feature 1..22: note = Synthetic Construct
  source 1..22: mol_type = other DNA
agagctccaggctcatccctat

SEQ ID NO: 12608 - DNA, 24 bp, synthetic construct
  misc_feature 1..24: note = Synthetic Construct
  source 1..24: mol_type = other DNA
cagagtcccttggatctgttctca

SEQ ID NO: 12609 - DNA, 19 bp, synthetic construct
  misc_feature 1..19: note = Synthetic Construct
  source 1..19: mol_type = other DNA
ctggggcaggaccaggaaa

SEQ ID NO: 12610 - DNA, 22 bp, synthetic construct
  misc_feature 1..22: note = Synthetic Construct
  source 1..22: mol_type = other DNA
cagtggagcttgctggttgact

SEQ ID NO: 12611 - DNA, 26 bp, synthetic construct
  misc_feature 1..26: note = Synthetic Construct
  source 1..26: mol_type = other DNA
gggtaccttctctcaaagcagcatct

SEQ ID NO: 12612 - DNA, 20 bp, synthetic construct
  misc_feature 1..20: note = Synthetic Construct
  source 1..20: mol_type = other DNA
catccagcaccatggcatct

SEQ ID NO: 12613 - DNA, 19 bp, synthetic construct
  misc_feature 1..19: note = Synthetic Construct
  source 1..19: mol_type = other DNA
tggcagagactggcaggaa

SEQ ID NO: 12614 - DNA, 23 bp, synthetic construct
  misc_feature 1..23: note = Synthetic Construct
  source 1..23: mol_type = other DNA
ttcctgaagggttgtaccagttg

SEQ ID NO: 12615 - DNA, 21 bp, synthetic construct
  misc_feature 1..21: note = Synthetic Construct
  source 1..21: mol_type = other DNA
agggccctgctgaacactgaa

SEQ ID NO: 12616 - DNA, 21 bp, synthetic construct
  misc_feature 1..21: note = Synthetic Construct
  source 1..21: mol_type = other DNA
catctccagacggtggtgttc

SEQ ID NO: 12617 - DNA, 22 bp, synthetic construct
  misc_feature 1..22: note = Synthetic Construct
  source 1..22: mol_type = other DNA
cttggcttgggactgtctctct

SEQ ID NO: 12618 - DNA, 19 bp, synthetic construct
  misc_feature 1..19: note = Synthetic Construct
  source 1..19: mol_type = other DNA
actggcacagcccaggatt

SEQ ID NO: 12619 - DNA, 23 bp, synthetic construct
  misc_feature 1..23: note = Synthetic Construct
  source 1..23: mol_type = other DNA
caggacttctggaaacccactgt

SEQ ID NO: 12620 - DNA, 22 bp, synthetic construct
  misc_feature 1..22: note = Synthetic Construct
  source 1..22: mol_type = other DNA
catccctgcgcctaactctaag

SEQ ID NO: 12621 - DNA, 19 bp, synthetic construct
  misc_feature 1..19: note = Synthetic Construct
  source 1..19: mol_type = other DNA
tgcacatggcggctaaaca

SEQ ID NO: 12622 - DNA, 24 bp, synthetic construct
  misc_feature 1..24: note = Synthetic Construct
  source 1..24: mol_type = other DNA
ggagttcgcatggtacctccctta

SEQ ID NO: 12623 - DNA, 20 bp, synthetic construct
  misc_feature 1..20: note = Synthetic Construct
  source 1..20: mol_type = other DNA
agccatgccgattgcctctt

SEQ ID NO: 12624 - DNA, 22 bp, synthetic construct
  misc_feature 1..22: note = Synthetic Construct
  source 1..22: mol_type = other DNA
ttggtcttcaggtccggaggtt

SEQ ID NO: 12625 - DNA, 22 bp, synthetic construct
  misc_feature 1..22: note = Synthetic Construct
  source 1..22: mol_type = other DNA
ggcttttgttggaagcacagaa

SEQ ID NO: 12626 - DNA, 19 bp, synthetic construct
  misc_feature 1..19: note = Synthetic Construct
  source 1..19: mol_type = other DNA
ttgagtcgtggggctctct

SEQ ID NO: 12627 - DNA, 20 bp, synthetic construct
  misc_feature 1..20: note = Synthetic Construct
  source 1..20: mol_type = other DNA
tgtggatggccaggatgtgt

SEQ ID NO: 12628 - DNA, 22 bp, synthetic construct
  misc_feature 1..22: note = Synthetic Construct
  source 1..22: mol_type = other DNA
ccatgacagacacccagcatct

SEQ ID NO: 12629 - DNA, 24 bp, synthetic construct
  misc_feature 1..24: note = Synthetic Construct
  source 1..24: mol_type = other DNA
cctgcctcaaacagaggaactcta

SEQ ID NO: 12630 - DNA, 23 bp, synthetic construct
  misc_feature 1..23: note = Synthetic Construct
  source 1..23: mol_type = other DNA
cactgagcaatcatggcatttgt

SEQ ID NO: 12631 - DNA, 22 bp, synthetic construct
  misc_feature 1..22: note = Synthetic Construct
  source 1..22: mol_type = other DNA
tccatccctgtcccagctccta

SEQ ID NO: 12632 - DNA, 22 bp, synthetic construct
  misc_feature 1..22: note = Synthetic Construct
  source 1..22: mol_type = other DNA
ggaacagcagcctaagtcatgt

SEQ ID NO: 12633 - DNA, 22 bp, synthetic construct
  misc_feature 1..22: note = Synthetic Construct
  source 1..22: mol_type = other DNA
gtaagaaggaggcgtcggaatc

SEQ ID NO: 12634 - DNA, 20 bp, synthetic construct
  misc_feature 1..20: note = Synthetic Construct
  source 1..20: mol_type = other DNA
tgctgggtcttgcccaacat

SEQ ID NO: 12635 - DNA, 21 bp, synthetic construct
  misc_feature 1..21: note = Synthetic Construct
  source 1..21: mol_type = other DNA
gcctggagatcaagctgcaaa

SEQ ID NO: 12636 - DNA, 25 bp, synthetic construct
  misc_feature 1..25: note = Synthetic Construct
  source 1..25: mol_type = other DNA
caccagggtaggtatccaatactgt

SEQ ID NO: 12637 - DNA, 22 bp, synthetic construct
  misc_feature 1..22: note = Synthetic Construct
  source 1..22: mol_type = other DNA
gcaactgaatgcacgtgtgtga

SEQ ID NO: 12638 - DNA, 23 bp, synthetic construct
  misc_feature 1..23: note = Synthetic Construct
  source 1..23: mol_type = other DNA
ggaccttagagcaatgaccttca

SEQ ID NO: 12639 - DNA, 26 bp, synthetic construct
  misc_feature 1..26: note = Synthetic Construct
  source 1..26: mol_type = other DNA
ggagtaggtggaaacaaactgcttct

SEQ ID NO: 12640 - DNA, 22 bp, synthetic construct
  misc_feature 1..22: note = Synthetic Construct
  source 1..22: mol_type = other DNA
gaagcagtcagcagtgctcaga

SEQ ID NO: 12641 - DNA, 22 bp, synthetic construct
  misc_feature 1..22: note = Synthetic Construct
  source 1..22: mol_type = other DNA
gcagtctctcctcctccagcaa

SEQ ID NO: 12642 - DNA, 25 bp, synthetic construct
  misc_feature 1..25: note = Synthetic Construct
  source 1..25: mol_type = other DNA
gagctctacccaactcttggtccta

SEQ ID NO: 12643 - DNA, 24 bp, synthetic construct
  misc_feature 1..24: note = Synthetic Construct
  source 1..24: mol_type = other DNA
ccctgaagagctgaatcacagaca

SEQ ID NO: 12644 - DNA, 25 bp, synthetic construct
  misc_feature 1..25: note = Synthetic Construct
  source 1..25: mol_type = other DNA
aggaaggtgtaggaactgcaaatac

SEQ ID NO: 12645 - DNA, 22 bp, synthetic construct
  misc_feature 1..22: note = Synthetic Construct
  source 1..22: mol_type = other DNA
cctcaacatacgggctaccaaa

SEQ ID NO: 12646 - DNA, 21 bp, synthetic construct
  misc_feature 1..21: note = Synthetic Construct
  source 1..21: mol_type = other DNA
ggcaaggagttctgggagctt

SEQ ID NO: 12647 - DNA, 21 bp, synthetic construct
  misc_feature 1..21: note = Synthetic Construct
  source 1..21: mol_type = other DNA
ggtggagggtttggtgctatg

SEQ ID NO: 12648 - DNA, 25 bp, synthetic construct
  misc_feature 1..25: note = Synthetic Construct
  source 1..25: mol_type = other DNA
caaagcaaagaacctctacccatga

SEQ ID NO: 12649 - DNA, 20 bp, synthetic construct
  misc_feature 1..20: note = Synthetic Construct
  source 1..20: mol_type = other DNA
gccaaacagctctgcactga

SEQ ID NO: 12650 - DNA, 23 bp, synthetic construct
  misc_feature 1..23: note = Synthetic Construct
  source 1..23: mol_type = other DNA
gcagccaagaatgcacctgaaag

SEQ ID NO: 12651 - DNA, 20 bp, synthetic construct
  misc_feature 1..20: note = Synthetic Construct
  source 1..20: mol_type = other DNA
gggaaggagctctcgaccta

SEQ ID NO: 12652 - DNA, 22 bp, synthetic construct
  misc_feature 1..22: note = Synthetic Construct
  source 1..22: mol_type = other DNA
ctcccaagtcacctgcgtttgt

SEQ ID NO: 12653 - DNA, 20 bp, synthetic construct
  misc_feature 1..20: note = Synthetic Construct
  source 1..20: mol_type = other DNA
gccgtacaactgacgccaaa

SEQ ID NO: 12654 - DNA, 21 bp, synthetic construct
  misc_feature 1..21: note = Synthetic Construct
  source 1..21: mol_type = other DNA
gctcctcctccagctcaattt

SEQ ID NO: 12655 - DNA, 20 bp, synthetic construct
  misc_feature 1..20: note = Synthetic Construct
  source 1..20: mol_type = other DNA
ctcgggtgcttggattgtgt

SEQ ID NO: 12656 - DNA, 22 bp, synthetic construct
  misc_feature 1..22: note = Synthetic Construct
  source 1..22: mol_type = other DNA
tggttcctccgctccattctct

SEQ ID NO: 12657 - DNA, 22 bp, synthetic construct
  misc_feature 1..22: note = Synthetic Construct
  source 1..22: mol_type = other DNA
ctgtgtgtctggctgctgacat

SEQ ID NO: 12658 - DNA, 22 bp, synthetic construct
  misc_feature 1..22: note = Synthetic Construct
  source 1..22: mol_type = other DNA
gttagcgtgggtggctctgaat

SEQ ID NO: 12659 - DNA, 20 bp, synthetic construct
  misc_feature 1..20: note = Synthetic Construct
  source 1..20: mol_type = other DNA
gggcacttctgagtgcttga

SEQ ID NO: 12660 - DNA, 21 bp, synthetic construct
  misc_feature 1..21: note = Synthetic Construct
  source 1..21: mol_type = other DNA
ctctctgttcccacccaccta

SEQ ID NO: 12661 - DNA, 24 bp, synthetic construct
  misc_feature 1..24: note = Synthetic Construct
  source 1..24: mol_type = other DNA
gtctgaggagataaaccccacact

SEQ ID NO: 12662 - DNA, 27 bp, synthetic construct
  misc_feature 1..27: note = Synthetic Construct
  source 1..27: mol_type = other DNA
ggaatgcatgggcataaattctgtctt

SEQ ID NO: 12663 - DNA, 28 bp, synthetic construct
  misc_feature 1..28: note = Synthetic Construct
  source 1..28: mol_type = other DNA
gcaaggagcctattgttactaagagaga

SEQ ID NO: 12664 - DNA, 22 bp, synthetic construct
  misc_feature 1..22: note = Synthetic Construct
  source 1..22: mol_type = other DNA
gggttgtgtggcaaatggaagt

SEQ ID NO: 12665 - DNA, 28 bp, synthetic construct
  misc_feature 1..28: note = Synthetic Construct
  source 1..28: mol_type = other DNA
caggagcaggaggaggtagaattaatga

SEQ ID NO: 12666 - DNA, 24 bp, synthetic construct
  misc_feature 1..24: note = Synthetic Construct
  source 1..24: mol_type = other DNA
ggccccagtgatgttttaggttca

SEQ ID NO: 12667 - DNA, 25 bp, synthetic construct
  misc_feature 1..25: note = Synthetic Construct
  source 1..25: mol_type = other DNA
tgatttttccatcgtgatggtgttg

SEQ ID NO: 12668 - DNA, 22 bp, synthetic construct
  misc_feature 1..22: note = Synthetic Construct
  source 1..22: mol_type = other DNA
gggagagcagtcacttggaaga

SEQ ID NO: 12669 - DNA, 24 bp, synthetic construct
  misc_feature 1..24: note = Synthetic Construct
  source 1..24: mol_type = other DNA
cgtggctagggttgtactgtcgtt

SEQ ID NO: 12670 - DNA, 22 bp, synthetic construct
  misc_feature 1..22: note = Synthetic Construct
  source 1..22: mol_type = other DNA
ccatgcgtgcaggggagaatta

SEQ ID NO: 12671 - DNA, 24 bp, synthetic construct
  misc_feature 1..24: note = Synthetic Construct
  source 1..24: mol_type = other DNA
tgtgctcagtaagtgcttgttaga

SEQ ID NO: 12672 - DNA, 21 bp, synthetic construct
  misc_feature 1..21: note = Synthetic Construct
  source 1..21: mol_type = other DNA
tggtgaaggccctgactcgat

SEQ ID NO: 12673 - DNA, 23 bp, synthetic construct
  misc_feature 1..23: note = Synthetic Construct
  source 1..23: mol_type = other DNA
gggtccctctctaggccactttt

SEQ ID NO: 12674 - DNA, 27 bp, synthetic construct
  misc_feature 1..27: note = Synthetic Construct
  source 1..27: mol_type = other DNA
ggaccttagattcgggagaaaatcact

SEQ ID NO: 12675 - DNA, 22 bp, synthetic construct
  misc_feature 1..22: note = Synthetic Construct
  source 1..22: mol_type = other DNA
cctgaccatcctagctgcaagt

SEQ ID NO: 12676 - DNA, 21 bp, synthetic construct
  misc_feature 1..21: note = Synthetic Construct
  source 1..21: mol_type = other DNA
ggcaggcagggtgtggatttt

SEQ ID NO: 12677 - DNA, 21 bp, synthetic construct
  misc_feature 1..21: note = Synthetic Construct
  source 1..21: mol_type = other DNA
ctgtgccagtgacgaaagaca

SEQ ID NO: 12678 - DNA, 25 bp, synthetic construct
  misc_feature 1..25: note = Synthetic Construct
  source 1..25: mol_type = other DNA
gatgtgaaggtgcaatgaagttaca

SEQ ID NO: 12679 - DNA, 20 bp, synthetic construct
  misc_feature 1..20: note = Synthetic Construct
  source 1..20: mol_type = other DNA
ccccagtttggtgcttctca

SEQ ID NO: 12680 - DNA, 21 bp, synthetic construct
  misc_feature 1..21: note = Synthetic Construct
  source 1..21: mol_type = other DNA
ggacaggaagcagctctcaca

SEQ ID NO: 12681 - DNA, 23 bp, synthetic construct
  misc_feature 1..23: note = Synthetic Construct
  source 1..23: mol_type = other DNA
cggctcctgaactggaaggagat

SEQ ID NO: 12682 - DNA, 20 bp, synthetic construct
  misc_feature 1..20: note = Synthetic Construct
  source 1..20: mol_type = other DNA
actcacggccctgaagcaaa

SEQ ID NO: 12683 - DNA, 24 bp, synthetic construct
  misc_feature 1..24: note = Synthetic Construct
  source 1..24: mol_type = other DNA
caggagcaccaagactggtagatg

SEQ ID NO: 12684 - DNA, 22 bp, synthetic construct
  misc_feature 1..22: note = Synthetic Construct
  source 1..22: mol_type = other DNA
ccctccaagtgtcaccaagcaa

SEQ ID NO: 12685 - DNA, 24 bp, synthetic construct
  misc_feature 1..24: note = Synthetic Construct
  source 1..24: mol_type = other DNA
cagtgccatgtcagtttaccattg

SEQ ID NO: 12686 - DNA, 22 bp, synthetic construct
  misc_feature 1..22: note = Synthetic Construct
  source 1..22: mol_type = other DNA
aaggactggacccacccactga

SEQ ID NO: 12687 - DNA, 23 bp, synthetic construct
  misc_feature 1..23: note = Synthetic Construct
  source 1..23: mol_type = other DNA
cagagaaaagccccactcgttac

SEQ ID NO: 12688 - DNA, 22 bp, synthetic construct
  misc_feature 1..22: note = Synthetic Construct
  source 1..22: mol_type = other DNA
cacatctgcctgatgcctgcta

SEQ ID NO: 12689 - DNA, 19 bp, synthetic construct
  misc_feature 1..19: note = Synthetic Construct
  source 1..19: mol_type = other DNA
gggttatggtgggcagcaa

SEQ ID NO: 12690 - DNA, 24 bp, synthetic construct
  misc_feature 1..24: note = Synthetic Construct
  source 1..24: mol_type = other DNA
acagagaaaatgaccctccaggaa

SEQ ID NO: 12691 - DNA, 24 bp, synthetic construct
  misc_feature 1..24: note = Synthetic Construct
  source 1..24: mol_type = other DNA
ctggtgccctggttataggaagaa

SEQ ID NO: 12692 - DNA, 25 bp, synthetic construct
  misc_feature 1..25: note = Synthetic Construct
  source 1..25: mol_type = other DNA
cctttcagcctatggcattggattt

SEQ ID NO: 12693 - DNA, 22 bp, synthetic construct
  misc_feature 1..22: note = Synthetic Construct
  source 1..22: mol_type = other DNA
cagaggcagtttggaccctaca

SEQ ID NO: 12694 - DNA, 23 bp, synthetic construct
  misc_feature 1..23: note = Synthetic Construct
  source 1..23: mol_type = other DNA
agcaaaaatagcctctgggacaa

SEQ ID NO: 12695 - DNA, 22 bp, synthetic construct
  misc_feature 1..22: note = Synthetic Construct
  source 1..22: mol_type = other DNA
gcatttggagggctagggacaa

SEQ ID NO: 12696 - DNA, 23 bp, synthetic construct
  misc_feature 1..23: note = Synthetic Construct
  source 1..23: mol_type = other DNA
gcaagggcaggtagggagaaaat

SEQ ID NO: 12697 - DNA, 23 bp, synthetic construct
  misc_feature 1..23: note = Synthetic Construct
  source 1..23: mol_type = other DNA
cctcccagtggagtctgtgtttc

SEQ ID NO: 12698 - DNA, 19 bp, synthetic construct
  misc_feature 1..19: note = Synthetic Construct
  source 1..19: mol_type = other DNA
gctgtcagccccacagatg

SEQ ID NO: 12699 - DNA, 22 bp, synthetic construct
  misc_feature 1..22: note = Synthetic Construct
  source 1..22: mol_type = other DNA
gaggacgcatatggacccgaat

SEQ ID NO: 12700 - DNA, 26 bp, synthetic construct
  misc_feature 1..26: note = Synthetic Construct
  source 1..26: mol_type = other DNA
gtctagaagctgtatccccagagtca

SEQ ID NO: 12701 - DNA, 21 bp, synthetic construct
  misc_feature 1..21: note = Synthetic Construct
  source 1..21: mol_type = other DNA
cgcttccgtaagggagcatct

SEQ ID NO: 12702 - DNA, 22 bp, synthetic construct
  misc_feature 1..22: note = Synthetic Construct
  source 1..22: mol_type = other DNA
cacggtcacaatgtttgtgcat

SEQ ID NO: 12703 - DNA, 24 bp, synthetic construct
  misc_feature 1..24: note = Synthetic Construct
  source 1..24: mol_type = other DNA
gcccttggctacatttgaggttgt

SEQ ID NO: 12704 - DNA, 23 bp, synthetic construct
  misc_feature 1..23: note = Synthetic Construct
  source 1..23: mol_type = other DNA
ggattggggtgttcagagcaaga

SEQ ID NO: 12705 - DNA, 20 bp, synthetic construct
  misc_feature 1..20: note = Synthetic Construct
  source 1..20: mol_type = other DNA
aggagcgtgcgtgaatgtgt

SEQ ID NO: 12706 - DNA, 21 bp, synthetic construct
  misc_feature 1..21: note = Synthetic Construct
  source 1..21: mol_type = other DNA
ggcactgagggactggaactt

SEQ ID NO: 12707 - DNA, 22 bp, synthetic construct
  misc_feature 1..22: note = Synthetic Construct
  source 1..22: mol_type = other DNA
gagactttgaggcagactgtca

SEQ ID NO: 12708 - DNA, 26 bp, synthetic construct
  misc_feature 1..26: note = Synthetic Construct
  source 1..26: mol_type = other DNA
ctggaagtcaggaaagtacagttcta

SEQ ID NO: 12709 - DNA, 22 bp, synthetic construct
  misc_feature 1..22: note = Synthetic Construct
  source 1..22: mol_type = other DNA
ggttgtcctggttcgcagagtt

SEQ ID NO: 12710 - DNA, 23 bp, synthetic construct
  misc_feature 1..23: note = Synthetic Construct
  source 1..23: mol_type = other DNA
gcctgatgggagaatcagaaact

SEQ ID NO: 12711 - DNA, 23 bp, synthetic construct
  misc_feature 1..23: note = Synthetic Construct
  source 1..23: mol_type = other DNA
ggcaaatcaaagcctgccttttc

SEQ ID NO: 12712 - DNA, 22 bp, synthetic construct
  misc_feature 1..22: note = Synthetic Construct
  source 1..22: mol_type = other DNA
agtgtgggccctacctgtgatt

SEQ ID NO: 12713 - DNA, 19 bp, synthetic construct
  misc_feature 1..19: note = Synthetic Construct
  source 1..19: mol_type = other DNA
ttttgccgctgcccctgat

SEQ ID NO: 12714 - DNA, 22 bp, synthetic construct
  misc_feature 1..22: note = Synthetic Construct
  source 1..22: mol_type = other DNA
ggactgtgttgggtgcaataac

SEQ ID NO: 12715 - DNA, 18 bp, synthetic construct
  misc_feature 1..18: note = Synthetic Construct
  source 1..18: mol_type = other DNA
acccgatgccccatgact

SEQ ID NO: 12716 - DNA, 22 bp, synthetic construct
  misc_feature 1..22: note = Synthetic Construct
  source 1..22: mol_type = other DNA
cccagtgaagccccacctttag

SEQ ID NO: 12717 - DNA, 22 bp, synthetic construct
  misc_feature 1..22: note = Synthetic Construct
  source 1..22: mol_type = other DNA
gtggcagacaaggacagtgagt

SEQ ID NO: 12718 - DNA, 23 bp, synthetic construct
  misc_feature 1..23: note = Synthetic Construct
  source 1..23: mol_type = other DNA
ccatggcaactccatgcttccaa

SEQ ID NO: 12719 - DNA, 24 bp, synthetic construct
  misc_feature 1..24: note = Synthetic Construct
  source 1..24: mol_type = other DNA
gcttcccaggatacccacccatta

SEQ ID NO: 12720 - DNA, 21 bp, synthetic construct
  misc_feature 1..21: note = Synthetic Construct
  source 1..21: mol_type = other DNA
gctgtctcggtcctcgttagt

SEQ ID NO: 12721 - DNA, 27 bp, synthetic construct
  misc_feature 1..27: note = Synthetic Construct
  source 1..27: mol_type = other DNA
gagccgattttatatccatgcctgtag

SEQ ID NO: 12722 - DNA, 22 bp, synthetic construct
  misc_feature 1..22: note = Synthetic Construct
  source 1..22: mol_type = other DNA
cccagaaacgagccatggaaag

SEQ ID NO: 12723 - DNA, 20 bp, synthetic construct
  misc_feature 1..20: note = Synthetic Construct
  source 1..20: mol_type = other DNA
aggtcgccagagtgctgtga

SEQ ID NO: 12724 - DNA, 25 bp, synthetic construct
  misc_feature 1..25: note = Synthetic Construct
  source 1..25: mol_type = other DNA
ccaaacccaattgcagctgtgtaac

SEQ ID NO: 12725 - DNA, 24 bp, synthetic construct
  misc_feature 1..24: note = Synthetic Construct
  source 1..24: mol_type = other DNA
gctgccttcttgagctcctgattt

SEQ ID NO: 12726 - DNA, 23 bp, synthetic construct
  misc_feature 1..23: note = Synthetic Construct
  source 1..23: mol_type = other DNA
cagcctagaggcagcaaaactgt

SEQ ID NO: 12727 - DNA, 24 bp, synthetic construct
  misc_feature 1..24: note = Synthetic Construct
  source 1..24: mol_type = other DNA
gcaagtgtcaggtccctctagtca

SEQ ID NO: 12728 - DNA, 20 bp, synthetic construct
  misc_feature 1..20: note = Synthetic Construct
  source 1..20: mol_type = other DNA
agccaactgagccaggaaca

SEQ ID NO: 12729 - DNA, 24 bp, synthetic construct
  misc_feature 1..24: note = Synthetic Construct
  source 1..24: mol_type = other DNA
cctgcatgcttgggttaattcttg

SEQ ID NO: 12730 - DNA, 20 bp, synthetic construct
  misc_feature 1..20: note = Synthetic Construct
  source 1..20: mol_type = other DNA
aaggggagctgtgtgtcctt

SEQ ID NO: 12731 - DNA, 22 bp, synthetic construct
  misc_feature 1..22: note = Synthetic Construct
  source 1..22: mol_type = other DNA
ccaatcctacgacgggaccaaa

SEQ ID NO: 12732 - DNA, 21 bp, synthetic construct
  misc_feature 1..21: note = Synthetic Construct
  source 1..21: mol_type = other DNA
tgctgattgcctgtgttgcta

SEQ ID NO: 12733 - DNA, 22 bp, synthetic construct
  misc_feature 1..22: note = Synthetic Construct
  source 1..22: mol_type = other DNA
gggacactgacctgcaccaaaa

SEQ ID NO: 12734 - DNA, 25 bp, synthetic construct
  misc_feature 1..25: note = Synthetic Construct
  source 1..25: mol_type = other DNA
ggacccttctaagccactgatctct

SEQ ID NO: 12735 - DNA, 22 bp, synthetic construct
  misc_feature 1..22: note = Synthetic Construct
  source 1..22: mol_type = other DNA
ctaaccccagctcaacctcttg

SEQ ID NO: 12736 - DNA, 22 bp, synthetic construct
  misc_feature 1..22: note = Synthetic Construct
  source 1..22: mol_type = other DNA
gtgacacaggctgcttctcatc

SEQ ID NO: 12737 - DNA, 21 bp, synthetic construct
  misc_feature 1..21: note = Synthetic Construct
  source 1..21: mol_type = other DNA
ttggtgtagggagcaggagat

SEQ ID NO: 12738 - DNA, 26 bp, synthetic construct
  misc_feature 1..26: note = Synthetic Construct
  source 1..26: mol_type = other DNA
cctcttacacccactgttccactaag

SEQ ID NO: 12739 - DNA, 23 bp, synthetic construct
  misc_feature 1..23: note = Synthetic Construct
  source 1..23: mol_type = other DNA
gaagcattctgggctgagagaga

SEQ ID NO: 12740 - DNA, 22 bp, synthetic construct
  misc_feature 1..22: note = Synthetic Construct
  source 1..22: mol_type = other DNA
ggaaacctggtccaaaccacaa

SEQ ID NO: 12741 - DNA, 21 bp, synthetic construct
  misc_feature 1..21: note = Synthetic Construct
  source 1..21: mol_type = other DNA
aggcacctgtttgcccgaatg

SEQ ID NO: 12742 - DNA, 23 bp, synthetic construct
  misc_feature 1..23: note = Synthetic Construct
  source 1..23: mol_type = other DNA
gctgtcagaaccagcctgagtat

SEQ ID NO: 12743 - DNA, 24 bp, synthetic construct
  misc_feature 1..24: note = Synthetic Construct
  source 1..24: mol_type = other DNA
gcggtaggatgttaaaggcagctt

SEQ ID NO: 12744 - DNA, 22 bp, synthetic construct
  misc_feature 1..22: note = Synthetic Construct
  source 1..22: mol_type = other DNA
ggttcaatctcaggctcacact

SEQ ID NO: 12745 - DNA, 21 bp, synthetic construct
  misc_feature 1..21: note = Synthetic Construct
  source 1..21: mol_type = other DNA
gcatggatctgcgtggagaca

SEQ ID NO: 12746 - DNA, 23 bp, synthetic construct
  misc_feature 1..23: note = Synthetic Construct
  source 1..23: mol_type = other DNA
cagaactgggtggtgtcgttttg

SEQ ID NO: 12747 - DNA, 21 bp, synthetic construct
  misc_feature 1..21: note = Synthetic Construct
  source 1..21: mol_type = other DNA
cagaccacttgagagcaggtt

SEQ ID NO: 12748 - DNA, 22 bp, synthetic construct
  misc_feature 1..22: note = Synthetic Construct
  source 1..22: mol_type = other DNA
gctaccaagggaggtctcttct

SEQ ID NO: 12749 - DNA, 22 bp, synthetic construct
  misc_feature 1..22: note = Synthetic Construct
  source 1..22: mol_type = other DNA
gaggtgggtaacagacccatca

SEQ ID NO: 12750 - DNA, 23 bp, synthetic construct
  misc_feature 1..23: note = Synthetic Construct
  source 1..23: mol_type = other DNA
ggaagcaagcacatactcaccat

SEQ ID NO: 12751 - DNA, 20 bp, synthetic construct
  misc_feature 1..20: note = Synthetic Construct
  source 1..20: mol_type = other DNA
actgcgtaagcggtggcata

SEQ ID NO: 12752 - DNA, 25 bp, synthetic construct
  misc_feature 1..25: note = Synthetic Construct
  source 1..25: mol_type = other DNA
ggtatcagcagtgtgggttaaggat

SEQ ID NO: 12753 - DNA, 24 bp, synthetic construct
  misc_feature 1..24: note = Synthetic Construct
  source 1..24: mol_type = other DNA
ctcggaagtcccagcagatctttc

SEQ ID NO: 12754 - DNA, 23 bp, synthetic construct
  misc_feature 1..23: note = Synthetic Construct
  source 1..23: mol_type = other DNA
ggtgaggttcacaccctcctttc

SEQ ID NO: 12755 - DNA, 20 bp, synthetic construct
  misc_feature 1..20: note = Synthetic Construct
  source 1..20: mol_type = other DNA
ctgcagtcatggctgtggaa

SEQ ID NO: 12756 - DNA, 23 bp, synthetic construct
  misc_feature 1..23: note = Synthetic Construct
  source 1..23: mol_type = other DNA
cccctgcctgtggaccttatatt

SEQ ID NO: 12757 - DNA, 20 bp, synthetic construct
  misc_feature 1..20: note = Synthetic Construct
  source 1..20: mol_type = other DNA
gggcattgccacaatggttt

SEQ ID NO: 12758 - DNA, 20 bp, synthetic construct
  misc_feature 1..20: note = Synthetic Construct
  source 1..20: mol_type = other DNA
gtggcaacaggacagggatt

SEQ ID NO: 12759 - DNA, 22 bp, synthetic construct
  misc_feature 1..22: note = Synthetic Construct
  source 1..22: mol_type = other DNA
tctaggaccaggagccatcaga

SEQ ID NO: 12760 - DNA, 23 bp, synthetic construct
  misc_feature 1..23: note = Synthetic Construct
  source 1..23: mol_type = other DNA
cgaggggtctttgaggcaaactt

SEQ ID NO: 12761 - DNA, 26 bp, synthetic construct
  misc_feature 1..26: note = Synthetic Construct
  source 1..26: mol_type = other DNA
tccccacctctctttctttagagtat

SEQ ID NO: 12762 - DNA, 21 bp, synthetic construct
  misc_feature 1..21: note = Synthetic Construct
  source 1..21: mol_type = other DNA
ccaggaaagccaccaatgcaa

SEQ ID NO: 12763 - DNA, 26 bp, synthetic construct
  misc_feature 1..26: note = Synthetic Construct
  source 1..26: mol_type = other DNA
gggctgatataatggaggcagcttag

SEQ ID NO: 12764 - DNA, 22 bp, synthetic construct
  misc_feature 1..22: note = Synthetic Construct
  source 1..22: mol_type = other DNA
gccctgtcctgactgacattct

SEQ ID NO: 12765 - DNA, 26 bp, synthetic construct
  misc_feature 1..26: note = Synthetic Construct
  source 1..26: mol_type = other DNA
tctttggccacacagatttactctac

SEQ ID NO: 12766 - DNA, 22 bp, synthetic construct
  misc_feature 1..22: note = Synthetic Construct
  source 1..22: mol_type = other DNA
cagagtaggtgtgccgtaggaa

SEQ ID NO: 12767 - DNA, 23 bp, synthetic construct
  misc_feature 1..23: note = Synthetic Construct
  source 1..23: mol_type = other DNA
cgctgtctctccatccaagtgtt

SEQ ID NO: 12768 - DNA, 24 bp, synthetic construct
  misc_feature 1..24: note = Synthetic Construct
  source 1..24: mol_type = other DNA
cggagccttggagctaggtgatta

SEQ ID NO: 12769 - DNA, 25 bp, synthetic construct
  misc_feature 1..25: note = Synthetic Construct
  source 1..25: mol_type = other DNA
cagggttcctagctctttcctgttc

SEQ ID NO: 12770 - DNA, 24 bp, synthetic construct
  misc_feature 1..24: note = Synthetic Construct
  source 1..24: mol_type = other DNA
cattcccaaatggatgtggctaga

SEQ ID NO: 12771 - DNA, 21 bp, synthetic construct
  misc_feature 1..21: note = Synthetic Construct
  source 1..21: mol_type = other DNA
gctccactttcgccctcactt

SEQ ID NO: 12772 - DNA, 24 bp, synthetic construct
  misc_feature 1..24: note = Synthetic Construct
  source 1..24: mol_type = other DNA
ctttgctcttgtctgcactgagta

SEQ ID NO: 12773 - DNA, 19 bp, synthetic construct
  misc_feature 1..19: note = Synthetic Construct
  source 1..19: mol_type = other DNA
ttgagctgtgcaggcttgt

SEQ ID NO: 12774 - DNA, 23 bp, synthetic construct
  misc_feature 1..23: note = Synthetic Construct
  source 1..23: mol_type = other DNA
tgtggctactttcccacagtttg

SEQ ID NO: 12775 - DNA, 24 bp, synthetic construct
  misc_feature 1..24: note = Synthetic Construct
  source 1..24: mol_type = other DNA
caaaggacaatcacagagctgttc

SEQ ID NO: 12776 - DNA, 25 bp, synthetic construct
  misc_feature 1..25: note = Synthetic Construct
  source 1..25: mol_type = other DNA
ggaatggaccaagtttgtcttgatt

SEQ ID NO: 12777 - DNA, 20 bp, synthetic construct
  misc_feature 1..20: note = Synthetic Construct
  source 1..20: mol_type = other DNA
tggatgtggcccgcatttgt

SEQ ID NO: 12778 - DNA, 23 bp, synthetic construct
  misc_feature 1..23: note = Synthetic Construct
  source 1..23: mol_type = other DNA
cccctgccccaaatagcatttta

SEQ ID NO: 12779 - DNA, 22 bp, synthetic construct
  misc_feature 1..22: note = Synthetic Construct
  source 1..22: mol_type = other DNA
accaagcactggggaaactaaa

SEQ ID NO: 12780 - DNA, 19 bp, synthetic construct
  misc_feature 1..19: note = Synthetic Construct
  source 1..19: mol_type = other DNA
ggcatgctccgcaccaaga

SEQ ID NO: 12781 - DNA, 22 bp, synthetic construct
  misc_feature 1..22: note = Synthetic Construct
  source 1..22: mol_type = other DNA
caggccatgtaaacgactctca

SEQ ID NO: 12782 - DNA, 23 bp, synthetic construct
  misc_feature 1..23: note = Synthetic Construct
  source 1..23: mol_type = other DNA
tgctgaatggtttgctcagtttg

SEQ ID NO: 12783 - DNA, 24 bp, synthetic construct
  misc_feature 1..24: note = Synthetic Construct
  source 1..24: mol_type = other DNA
tcgagtcacttacctgctcaaatg

SEQ ID NO: 12784 - DNA, 20 bp, synthetic construct
  misc_feature 1..20: note = Synthetic Construct
  source 1..20: mol_type = other DNA
agcaagcgacggtcctccat

SEQ ID NO: 12785 - DNA, 22 bp, synthetic construct
  misc_feature 1..22: note = Synthetic Construct
  source 1..22: mol_type = other DNA
acctgcagaactgaggctctct

SEQ ID NO: 12786 - DNA, 21 bp, synthetic construct
  misc_feature 1..21: note = Synthetic Construct
  source 1..21: mol_type = other DNA
agtgtcaggaggggaaacgaa

SEQ ID NO: 12787 - DNA, 25 bp, synthetic construct
  misc_feature 1..25: note = Synthetic Construct
  source 1..25: mol_type = other DNA
ccactccttcccttatacccttgta

SEQ ID NO: 12788 - DNA, 21 bp, synthetic construct
  misc_feature 1..21: note = Synthetic Construct
  source 1..21: mol_type = other DNA
gcaaagattgctgcccgttca

SEQ ID NO: 12789 - DNA, 24 bp, synthetic construct
  misc_feature 1..24: note = Synthetic Construct
  source 1..24: mol_type = other DNA
tggacaagaatggagaaagacgtt

SEQ ID NO: 12790 - DNA, 22 bp, synthetic construct
  misc_feature 1..22: note = Synthetic Construct
  source 1..22: mol_type = other DNA
gcctttcccaggactcaacagt

SEQ ID NO: 12791 - DNA, 24 bp, synthetic construct
  misc_feature 1..24: note = Synthetic Construct
  source 1..24: mol_type = other DNA
ctgctttgaggcagataggagctt

SEQ ID NO: 12792 - DNA, 22 bp, synthetic construct
  misc_feature 1..22: note = Synthetic Construct
  source 1..22: mol_type = other DNA
cctgcacaaagtggctgtcaac

SEQ ID NO: 12793 - DNA, 25 bp, synthetic construct
  misc_feature 1..25: note = Synthetic Construct
  source 1..25: mol_type = other DNA
gcaggaaaccacaaaacatcaccta

SEQ ID NO: 12794 - DNA, 26 bp, synthetic construct
  misc_feature 1..26: note = Synthetic Construct
  source 1..26: mol_type = other DNA
gctttctctcccctaggacatacagt

SEQ ID NO: 12795 - DNA, 20 bp, synthetic construct
  misc_feature 1..20: note = Synthetic Construct
  source 1..20: mol_type = other DNA
agcctggctccctacacatt

SEQ ID NO: 12796 - DNA, 21 bp, synthetic construct
  misc_feature 1..21: note = Synthetic Construct
  source 1..21: mol_type = other DNA
tgctattggggcattggtgtt

SEQ ID NO: 12797 - DNA, 20 bp, synthetic construct
  misc_feature 1..20: note = Synthetic Construct
  source 1..20: mol_type = other DNA
tgcatcccgttgctgtcaag

SEQ ID NO: 12798 - DNA, 23 bp, synthetic construct
  misc_feature 1..23: note = Synthetic Construct
  source 1..23: mol_type = other DNA
gacctgtgtccctttgtccttag

SEQ ID NO: 12799 - DNA, 24 bp, synthetic construct
  misc_feature 1..24: note = Synthetic Construct
  source 1..24: mol_type = other DNA
cctttgcccttccagagtctcctt

SEQ ID NO: 12800 - DNA, 23 bp, synthetic construct
  misc_feature 1..23: note = Synthetic Construct
  source 1..23: mol_type = other DNA
gcctggtactctcccagttttag

SEQ ID NO: 12801 - DNA, 24 bp, synthetic construct
  misc_feature 1..24: note = Synthetic Construct
  source 1..24: mol_type = other DNA
gggaccagtcaactttgccagatt

SEQ ID NO: 12802 - DNA, 24 bp, synthetic construct
  misc_feature 1..24: note = Synthetic Construct
  source 1..24: mol_type = other DNA
attcccattcctaaaagccgtgta

SEQ ID NO: 12803 - DNA, 20 bp, synthetic construct
  misc_feature 1..20: note = Synthetic Construct
  source 1..20: mol_type = other DNA
tccaggcacgcacctctgat

SEQ ID NO: 12804 - DNA, 22 bp, synthetic construct
  misc_feature 1..22: note = Synthetic Construct
  source 1..22: mol_type = other DNA
ggcaggcatctgtgcagtcatt

SEQ ID NO: 12805 - DNA, 21 bp, synthetic construct
  misc_feature 1..21: note = Synthetic Construct
  source 1..21: mol_type = other DNA
tgccgacataaccccttcctt

SEQ ID NO: 12806 - DNA, 22 bp, synthetic construct
  misc_feature 1..22: note = Synthetic Construct
  source 1..22: mol_type = other DNA
cgccaatctcagtggttggaat

SEQ ID NO: 12807 - DNA, 25 bp, synthetic construct
  misc_feature 1..25: note = Synthetic Construct
  source 1..25: mol_type = other DNA
cggagcaacttggcatgttaataca

SEQ ID NO: 12808 - DNA, 22 bp, synthetic construct
  misc_feature 1..22: note = Synthetic Construct
  source 1..22: mol_type = other DNA
gtggcagcctttctgtagttga

SEQ ID NO: 12809 - DNA, 25 bp, synthetic construct
  misc_feature 1..25: note = Synthetic Construct
  source 1..25: mol_type = other DNA
gctcgttaagaattagccccacatc

SEQ ID NO: 12810 - DNA, 23 bp, synthetic construct
  misc_feature 1..23: note = Synthetic Construct
  source 1..23: mol_type = other DNA
caccagctagaacctcctgtagt

SEQ ID NO: 12811 - DNA, 18 bp, synthetic construct
  misc_feature 1..18: note = Synthetic Construct
  source 1..18: mol_type = other DNA
gctgctttgcgggacctt

SEQ ID NO: 12812 - DNA, 24 bp, synthetic construct
  misc_feature 1..24: note = Synthetic Construct
  source 1..24: mol_type = other DNA
ggcaggagtcagtgacaagtggta

SEQ ID NO: 12813 - DNA, 25 bp, synthetic construct
  misc_feature 1..25: note = Synthetic Construct
  source 1..25: mol_type = other DNA
tgtgtcaagcagatttgaagctaac

SEQ ID NO: 12814 - DNA, 22 bp, synthetic construct
  misc_feature 1..22: note = Synthetic Construct
  source 1..22: mol_type = other DNA
tgcacattccttccttggtgat

SEQ ID NO: 12815 - DNA, 19 bp, synthetic construct
  misc_feature 1..19: note = Synthetic Construct
  source 1..19: mol_type = other DNA
cctgcattgcaagccgttt

SEQ ID NO: 12816 - DNA, 21 bp, synthetic construct
  misc_feature 1..21: note = Synthetic Construct
  source 1..21: mol_type = other DNA
acctgcctgtgtggtatggaa

SEQ ID NO: 12817 - DNA, 25 bp, synthetic construct
  misc_feature 1..25: note = Synthetic Construct
  source 1..25: mol_type = other DNA
gagccgaatgttcacttatggagtt

SEQ ID NO: 12818 - DNA, 24 bp, synthetic construct
  misc_feature 1..24: note = Synthetic Construct
  source 1..24: mol_type = other DNA
ctgaagcctaatggggatccagaa

SEQ ID NO: 12819 - DNA, 24 bp, synthetic construct
  misc_feature 1..24: note = Synthetic Construct
  source 1..24: mol_type = other DNA
aaatagctgtcccattctggttgt

SEQ ID NO: 12820 - DNA, 21 bp, synthetic construct
  misc_feature 1..21: note = Synthetic Construct
  source 1..21: mol_type = other DNA
tccccggatttccacagtagt

SEQ ID NO: 12821 - DNA, 27 bp, synthetic construct
  misc_feature 1..27: note = Synthetic Construct
  source 1..27: mol_type = other DNA
gggtaggatgcatgagaagaactggat

SEQ ID NO: 12822 - DNA, 25 bp, synthetic construct
  misc_feature 1..25: note = Synthetic Construct
  source 1..25: mol_type = other DNA
gccagctgaggaactattagacact

SEQ ID NO: 12823 - DNA, 23 bp, synthetic construct
  misc_feature 1..23: note = Synthetic Construct
  source 1..23: mol_type = other DNA
ctgcagatctagccaatgaggtt

SEQ ID NO: 12824 - DNA, 25 bp, synthetic construct
  misc_feature 1..25: note = Synthetic Construct
  source 1..25: mol_type = other DNA
ggccaagattttggtgttcaagtag

SEQ ID NO: 12825 - DNA, 20 bp, synthetic construct
  misc_feature 1..20: note = Synthetic Construct
  source 1..20: mol_type = other DNA
acagctgcgaatggcctaat

SEQ ID NO: 12826 - DNA, 24 bp, synthetic construct
  misc_feature 1..24: note = Synthetic Construct
  source 1..24: mol_type = other DNA
gatctcatggctacggagatcaag

SEQ ID NO: 12827 - DNA, 25 bp, synthetic construct
  misc_feature 1..25: note = Synthetic Construct
  source 1..25: mol_type = other DNA
cctcctgggaaactggcaagtaaag

SEQ ID NO: 12828 - DNA, 24 bp, synthetic construct
  misc_feature 1..24: note = Synthetic Construct
  source 1..24: mol_type = other DNA
gtacatggttatggctaccaggaa

SEQ ID NO: 12829 - DNA, 20 bp, synthetic construct
  misc_feature 1..20: note = Synthetic Construct
  source 1..20: mol_type = other DNA
tggtcagtgctcccagagtt

SEQ ID NO: 12830 - DNA, 20 bp, synthetic construct
  misc_feature 1..20: note = Synthetic Construct
  source 1..20: mol_type = other DNA
cgcacatgtctcgtgtcact

SEQ ID NO: 12831 - DNA, 21 bp, synthetic construct
  misc_feature 1..21: note = Synthetic Construct
  source 1..21: mol_type = other DNA
accactgacaaacctgtgcat

SEQ ID NO: 12832 - DNA, 26 bp, synthetic construct
  misc_feature 1..26: note = Synthetic Construct
  source 1..26: mol_type = other DNA
cagggatgaataagcctcatgaaaga

SEQ ID NO: 12833 - DNA, 24 bp, synthetic construct
  misc_feature 1..24: note = Synthetic Construct
  source 1..24: mol_type = other DNA
actgcaacactgtgattgtcttca

SEQ ID NO: 12834 - DNA, 20 bp, synthetic construct
  misc_feature 1..20: note = Synthetic Construct
  source 1..20: mol_type = other DNA
ttggctccccagagtgttgt

SEQ ID NO: 12835 - DNA, 24 bp, synthetic construct
  misc_feature 1..24: note = Synthetic Construct
  source 1..24: mol_type = other DNA
cagtcgaaagagtggaaaggatga

SEQ ID NO: 12836 - DNA, 21 bp, synthetic construct
  misc_feature 1..21: note = Synthetic Construct
  source 1..21: mol_type = other DNA
tgaagcatctggcctgtctga

SEQ ID NO: 12837 - DNA, 20 bp, synthetic construct
  misc_feature 1..20: note = Synthetic Construct
  source 1..20: mol_type = other DNA
ttcggggtgcatcctcacat

SEQ ID NO: 12838 - DNA, 22 bp, synthetic construct
  misc_feature 1..22: note = Synthetic Construct
  source 1..22: mol_type = other DNA
catccacagctgtctccgtgta

SEQ ID NO: 12839 - DNA, 25 bp, synthetic construct
  misc_feature 1..25: note = Synthetic Construct
  source 1..25: mol_type = other DNA
ttccaggttgttttctgcaaagtag

SEQ ID NO: 12840 - DNA, 26 bp, synthetic construct
  misc_feature 1..26: note = Synthetic Construct
  source 1..26: mol_type = other DNA
tcccagagacacagctagttaaaaac

SEQ ID NO: 12841 - DNA, 21 bp, synthetic construct
  misc_feature 1..21: note = Synthetic Construct
  source 1..21: mol_type = other DNA
tgctgctcgtacagtggaaag

SEQ ID NO: 12842 - DNA, 25 bp, synthetic construct
  misc_feature 1..25: note = Synthetic Construct
  source 1..25: mol_type = other DNA
ggagcagtatcattttggtgcattg

SEQ ID NO: 12843 - DNA, 22 bp, synthetic construct
  misc_feature 1..22: note = Synthetic Construct
  source 1..22: mol_type = other DNA
cggtggtgcctttgttttaact

SEQ ID NO: 12844 - DNA, 25 bp, synthetic construct
  misc_feature 1..25: note = Synthetic Construct
  source 1..25: mol_type = other DNA
ggagaaggaatgtcaggaagcaaac

SEQ ID NO: 12845 - DNA, 21 bp, synthetic construct
  misc_feature 1..21: note = Synthetic Construct
  source 1..21: mol_type = other DNA
agtaggtgtgatggccaggat

SEQ ID NO: 12846 - DNA, 23 bp, synthetic construct
  misc_feature 1..23: note = Synthetic Construct
  source 1..23: mol_type = other DNA
tgtcttcctagcctcatctctca

SEQ ID NO: 12847 - DNA, 24 bp, synthetic construct
  misc_feature 1..24: note = Synthetic Construct
  source 1..24: mol_type = other DNA
gctaggggatactgagtcctgcat

SEQ ID NO: 12848 - DNA, 22 bp, synthetic construct
  misc_feature 1..22: note = Synthetic Construct
  source 1..22: mol_type = other DNA
cccaaagagtccccatctggtt

SEQ ID NO: 12849 - DNA, 20 bp, synthetic construct
  misc_feature 1..20: note = Synthetic Construct
  source 1..20: mol_type = other DNA
agacctaggcggcaaacaaa

SEQ ID NO: 12850 - DNA, 25 bp, synthetic construct
  misc_feature 1..25: note = Synthetic Construct
  source 1..25: mol_type = other DNA
agtttcctggaagccagctattaaa

SEQ ID NO: 12851 - DNA, 22 bp, synthetic construct
  misc_feature 1..22: note = Synthetic Construct
  source 1..22: mol_type = other DNA
cgtaagcataggggctgcagta

SEQ ID NO: 12852 - DNA, 25 bp, synthetic construct
  misc_feature 1..25: note = Synthetic Construct
  source 1..25: mol_type = other DNA
gcagttgagggagttcaactaaaga

SEQ ID NO: 12853 - DNA, 23 bp, synthetic construct
  misc_feature 1..23: note = Synthetic Construct
  source 1..23: mol_type = other DNA
cctaggctagaagcccagaaaac

SEQ ID NO: 12854 - DNA, 23 bp, synthetic construct
  misc_feature 1..23: note = Synthetic Construct
  source 1..23: mol_type = other DNA
ccttccctttgtcacaccacatc

SEQ ID NO: 12855 - DNA, 24 bp, synthetic construct
  misc_feature 1..24: note = Synthetic Construct
  source 1..24: mol_type = other DNA
cctgtgttcaggaagaatgaggat

SEQ ID NO: 12856 - DNA, 26 bp, synthetic construct
  misc_feature 1..26: note = Synthetic Construct
  source 1..26: mol_type = other DNA
gaaggaaactgactttgcagcttaac

SEQ ID NO: 12857 - DNA, 24 bp, synthetic construct
  misc_feature 1..24: note = Synthetic Construct
  source 1..24: mol_type = other DNA
agggagaaaatcacactcttgcat

SEQ ID NO: 12858 - DNA, 21 bp, synthetic construct
  misc_feature 1..21: note = Synthetic Construct
  source 1..21: mol_type = other DNA
ggggacgaagtcaaggtgtag

SEQ ID NO: 12859 - DNA, 25 bp, synthetic construct
  misc_feature 1..25: note = Synthetic Construct
  source 1..25: mol_type = other DNA
ccagagaaaacagagggcattggtt

SEQ ID NO: 12860 - DNA, 21 bp, synthetic construct
  misc_feature 1..21: note = Synthetic Construct
  source 1..21: mol_type = other DNA
tggtccccaggtttggatttc

SEQ ID NO: 12861 - DNA, 26 bp, synthetic construct
  misc_feature 1..26: note = Synthetic Construct
  source 1..26: mol_type = other DNA
gaaagtacaggctatagctgatggat

SEQ ID NO: 12862 - DNA, 20 bp, synthetic construct
  misc_feature 1..20: note = Synthetic Construct
  source 1..20: mol_type = other DNA
gggccattgtgctggtctct

SEQ ID NO: 12863 - DNA, 24 bp, synthetic construct
  misc_feature 1..24: note = Synthetic Construct
  source 1..24: mol_type = other DNA
ctgtgaaaactgggactagcaaag

SEQ ID NO: 12864 - DNA, 25 bp, synthetic construct
  misc_feature 1..25: note = Synthetic Construct
  source 1..25: mol_type = other DNA
ctccttgtaatcccagtgagagaaa

SEQ ID NO: 12865 - DNA, 23 bp, synthetic construct
  misc_feature 1..23: note = Synthetic Construct
  source 1..23: mol_type = other DNA
gggtgggagcagaaagtatgttg

SEQ ID NO: 12866 - DNA, 20 bp, synthetic construct
  misc_feature 1..20: note = Synthetic Construct
  source 1..20: mol_type = other DNA
acaagaacgcagagctgtca

SEQ ID NO: 12867 - DNA, 23 bp, synthetic construct
  misc_feature 1..23: note = Synthetic Construct
  source 1..23: mol_type = other DNA
tggagtctgctccagtagctaag

SEQ ID NO: 12868 - DNA, 22 bp, synthetic construct
  misc_feature 1..22: note = Synthetic Construct
  source 1..22: mol_type = other DNA
gtccacagtgagtgtctggaaa

SEQ ID NO: 12869 - DNA, 22 bp, synthetic construct
  misc_feature 1..22: note = Synthetic Construct
  source 1..22: mol_type = other DNA
tgcctggccctatagcttggta

SEQ ID NO: 12870 - DNA, 21 bp, synthetic construct
  misc_feature 1..21: note = Synthetic Construct
  source 1..21: mol_type = other DNA
tcttgggattctggggctttc

SEQ ID NO: 12871 - DNA, 19 bp, synthetic construct
  misc_feature 1..19: note = Synthetic Construct
  source 1..19: mol_type = other DNA
cgtctgcgccgagaccttt

SEQ ID NO: 12872 - DNA, 20 bp, synthetic construct
  misc_feature 1..20: note = Synthetic Construct
  source 1..20: mol_type = other DNA
ggcctgtcatctcagcatgt

SEQ ID NO: 12873 - DNA, 24 bp, synthetic construct
  misc_feature 1..24: note = Synthetic Construct
  source 1..24: mol_type = other DNA
gaggagtcctaactgcagggatac

SEQ ID NO: 12874 - DNA, 25 bp, synthetic construct
  misc_feature 1..25: note = Synthetic Construct
  source 1..25: mol_type = other DNA
ggctgagtttctttgtggcatgtaa

SEQ ID NO: 12875 - DNA, 27 bp, synthetic construct
  misc_feature 1..27: note = Synthetic Construct
  source 1..27: mol_type = other DNA
gacccttgcatagttagaagagtggtt

SEQ ID NO: 12876 - DNA, 29 bp, synthetic construct
  misc_feature 1..29: note = Synthetic Construct
  source 1..29: mol_type = other DNA
gccctaaataacctctactcacgggattt

SEQ ID NO: 12877 - DNA, 20 bp, synthetic construct
  misc_feature 1..20: note = Synthetic Construct
  source 1..20: mol_type = other DNA
acccagtgctttggtgttca

SEQ ID NO: 12878 - DNA, 22 bp, synthetic construct
  misc_feature 1..22: note = Synthetic Construct
  source 1..22: mol_type = other DNA
gccccatccatgacttggtgaa

SEQ ID NO: 12879 - DNA, 19 bp, synthetic construct
  misc_feature 1..19: note = Synthetic Construct
  source 1..19: mol_type = other DNA
ggggcctggggtcaaagaa

SEQ ID NO: 12880 - DNA, 22 bp, synthetic construct
  misc_feature 1..22: note = Synthetic Construct
  source 1..22: mol_type = other DNA
gccaagaacctaccctgcattg

SEQ ID NO: 12881 - DNA, 20 bp, synthetic construct
  misc_feature 1..20: note = Synthetic Construct
  source 1..20: mol_type = other DNA
ttccctggccctgtttctct

SEQ ID NO: 12882 - DNA, 23 bp, synthetic construct
  misc_feature 1..23: note = Synthetic Construct
  source 1..23: mol_type = other DNA
cccactttgctggtctatagctt

SEQ ID NO: 12883 - DNA, 21 bp, synthetic construct
  misc_feature 1..21: note = Synthetic Construct
  source 1..21: mol_type = other DNA
cctgagcatgtggtgtggttt

SEQ ID NO: 12884 - DNA, 23 bp, synthetic construct
  misc_feature 1..23: note = Synthetic Construct
  source 1..23: mol_type = other DNA
cctcaaaatgggagccagcgata

SEQ ID NO: 12885 - DNA, 27 bp, synthetic construct
  misc_feature 1..27: note = Synthetic Construct
  source 1..27: mol_type = other DNA
gacatagggaaaagtgtgtctacttca

SEQ ID NO: 12886 - DNA, 26 bp, synthetic construct
  misc_feature 1..26: note = Synthetic Construct
  source 1..26: mol_type = other DNA
agatctcaaggtaggaatgtgtctca

SEQ ID NO: 12887 - DNA, 24 bp, synthetic construct
  misc_feature 1..24: note = Synthetic Construct
  source 1..24: mol_type = other DNA
ggcaggtagaaaggcacaccctat

SEQ ID NO: 12888 - DNA, 22 bp, synthetic construct
  misc_feature 1..22: note = Synthetic Construct
  source 1..22: mol_type = other DNA
tgactccagctccagggttaca

SEQ ID NO: 12889 - DNA, 20 bp, synthetic construct
  misc_feature 1..20: note = Synthetic Construct
  source 1..20: mol_type = other DNA
aggcaacgggacacaccatt

SEQ ID NO: 12890 - DNA, 25 bp, synthetic construct
  misc_feature 1..25: note = Synthetic Construct
  source 1..25: mol_type = other DNA
cagggataccatggagaagttggta

SEQ ID NO: 12891 - DNA, 24 bp, synthetic construct
  misc_feature 1..24: note = Synthetic Construct
  source 1..24: mol_type = other DNA
aaatgactgcttccttcactgaga

SEQ ID NO: 12892 - DNA, 25 bp, synthetic construct
  misc_feature 1..25: note = Synthetic Construct
  source 1..25: mol_type = other DNA
gtatcccatgtcccattacttctgt

SEQ ID NO: 12893 - DNA, 19 bp, synthetic construct
  misc_feature 1..19: note = Synthetic Construct
  source 1..19: mol_type = other DNA
tcgcaggggttgcctcagt

SEQ ID NO: 12894 - DNA, 23 bp, synthetic construct
  misc_feature 1..23: note = Synthetic Construct
  source 1..23: mol_type = other DNA
caagacagagtgtgggcaatcaa

SEQ ID NO: 12895 - DNA, 19 bp, synthetic construct
  misc_feature 1..19: note = Synthetic Construct
  source 1..19: mol_type = other DNA
tgtccatggccacctctgt

SEQ ID NO: 12896 - DNA, 25 bp, synthetic construct
  misc_feature 1..25: note = Synthetic Construct
  source 1..25: mol_type = other DNA
tgctgatcaagccaaaatctaccat

SEQ ID NO: 12897 - DNA, 24 bp, synthetic construct
  misc_feature 1..24: note = Synthetic Construct
  source 1..24: mol_type = other DNA
ccatcattcctggcacagggtttg

SEQ ID NO: 12898 - DNA, 24 bp, synthetic construct
  misc_feature 1..24: note = Synthetic Construct
  source 1..24: mol_type = other DNA
gcaactccagccaaacatcttttc

SEQ ID NO: 12899 - DNA, 25 bp, synthetic construct
  misc_feature 1..25: note = Synthetic Construct
  source 1..25: mol_type = other DNA
cagcagtatcacctccattttgcta

SEQ ID NO: 12900 - DNA, 22 bp, synthetic construct
  misc_feature 1..22: note = Synthetic Construct
  source 1..22: mol_type = other DNA
ccagctcacattggcagcgatt

SEQ ID NO: 12901 - DNA, 20 bp, synthetic construct
  misc_feature 1..20: note = Synthetic Construct
  source 1..20: mol_type = other DNA
aggggcagcaccttacttca

SEQ ID NO: 12902 - DNA, 22 bp, synthetic construct
  misc_feature 1..22: note = Synthetic Construct
  source 1..22: mol_type = other DNA
cagagcgcaggcatgcttattg

SEQ ID NO: 12903 - DNA, 24 bp, synthetic construct
  misc_feature 1..24: note = Synthetic Construct
  source 1..24: mol_type = other DNA
tttacccaaccttcacgcttagat

SEQ ID NO: 12904 - DNA, 25 bp, synthetic construct
  misc_feature 1..25: note = Synthetic Construct
  source 1..25: mol_type = other DNA
gagcctaagaggcatattggcattg

SEQ ID NO: 12905 - DNA, 22 bp, synthetic construct
  misc_feature 1..22: note = Synthetic Construct
  source 1..22: mol_type = other DNA
ccccaaaggagtcactctggtt

SEQ ID NO: 12906 - DNA, 20 bp, synthetic construct
  misc_feature 1..20: note = Synthetic Construct
  source 1..20: mol_type = other DNA
ggaagtgcgtggagcacaga

SEQ ID NO: 12907 - DNA, 22 bp, synthetic construct
  misc_feature 1..22: note = Synthetic Construct
  source 1..22: mol_type = other DNA
ggagatgctgatgcgtccttag

SEQ ID NO: 12908 - DNA, 24 bp, synthetic construct
  misc_feature 1..24: note = Synthetic Construct
  source 1..24: mol_type = other DNA
ggtctcaattctggcacactatca

SEQ ID NO: 12909 - DNA, 22 bp, synthetic construct
  misc_feature 1..22: note = Synthetic Construct
  source 1..22: mol_type = other DNA
gcatgaggctgttttcccatgt

SEQ ID NO: 12910 - DNA, 23 bp, synthetic construct
  misc_feature 1..23: note = Synthetic Construct
  source 1..23: mol_type = other DNA
caggaccatgcttcctctgaaac

SEQ ID NO: 12911 - DNA, 21 bp, synthetic construct
  misc_feature 1..21: note = Synthetic Construct
  source 1..21: mol_type = other DNA
gatgctgcaggacagcaatca

SEQ ID NO: 12912 - DNA, 24 bp, synthetic construct
  misc_feature 1..24: note = Synthetic Construct
  source 1..24: mol_type = other DNA
gcccataaaggactctctctccat

SEQ ID NO: 12913 - DNA, 21 bp, synthetic construct
  misc_feature 1..21: note = Synthetic Construct
  source 1..21: mol_type = other DNA
cccgcttgatcttgggaaagt

SEQ ID NO: 12914 - DNA, 21 bp, synthetic construct
  misc_feature 1..21: note = Synthetic Construct
  source 1..21: mol_type = other DNA
acacctcaacacggcgactct

SEQ ID NO: 12915 - DNA, 25 bp, synthetic construct
  misc_feature 1..25: note = Synthetic Construct
  source 1..25: mol_type = other DNA
gttggtgacagaagtgatctaggaa

SEQ ID NO: 12916 - DNA, 19 bp, synthetic construct
  misc_feature 1..19: note = Synthetic Construct
  source 1..19: mol_type = other DNA
gccactgggacgcctgttt

SEQ ID NO: 12917 - DNA, 21 bp, synthetic construct
  misc_feature 1..21: note = Synthetic Construct
  source 1..21: mol_type = other DNA
ctgagagtgggcatgcattgt

SEQ ID NO: 12918 - DNA, 22 bp, synthetic construct
  misc_feature 1..22: note = Synthetic Construct
  source 1..22: mol_type = other DNA
ggaacaaaaatgcgtggtcaga

SEQ ID NO: 12919 - DNA, 23 bp, synthetic construct
  misc_feature 1..23: note = Synthetic Construct
  source 1..23: mol_type = other DNA
ctgtccttcccctcctgacatct

SEQ ID NO: 12920 - DNA, 20 bp, synthetic construct
  misc_feature 1..20: note = Synthetic Construct
  source 1..20: mol_type = other DNA
tgtcctcctgggtggtgagt

SEQ ID NO: 12921 - DNA, 19 bp, synthetic construct
  misc_feature 1..19: note = Synthetic Construct
  source 1..19: mol_type = other DNA
agggcggtgagggtgttga

SEQ ID NO: 12922 - DNA, 23 bp, synthetic construct
  misc_feature 1..23: note = Synthetic Construct
  source 1..23: mol_type = other DNA
acccatgacttctggttccaaat

SEQ ID NO: 12923 - DNA, 22 bp, synthetic construct
  misc_feature 1..22: note = Synthetic Construct
  source 1..22: mol_type = other DNA
gagggaaagttggccctcatca

SEQ ID NO: 12924 - DNA, 27 bp, synthetic construct
  misc_feature 1..27: note = Synthetic Construct
  source 1..27: mol_type = other DNA
ccctactgcttttgtcttaactgagaa

SEQ ID NO: 12925 - DNA, 24 bp, synthetic construct
  misc_feature 1..24: note = Synthetic Construct
  source 1..24: mol_type = other DNA
gctcagcaatactgcagttaggaa

SEQ ID NO: 12926 - DNA, 19 bp, synthetic construct
  misc_feature 1..19: note = Synthetic Construct
  source 1..19: mol_type = other DNA
gtggtaggggcgtctcact

SEQ ID NO: 12927 - DNA, 20 bp, synthetic construct
  misc_feature 1..20: note = Synthetic Construct
  source 1..20: mol_type = other DNA
ctgctggctgctcaaagcta

SEQ ID NO: 12928 - DNA, 25 bp, synthetic construct
  misc_feature 1..25: note = Synthetic Construct
  source 1..25: mol_type = other DNA
caagacatccaccatcagacagcta

SEQ ID NO: 12929 - DNA, 21 bp, synthetic construct
  misc_feature 1..21: note = Synthetic Construct
  source 1..21: mol_type = other DNA
ggcagacaccgagcatctaca

SEQ ID NO: 12930 - DNA, 26 bp, synthetic construct
  misc_feature 1..26: note = Synthetic Construct
  source 1..26: mol_type = other DNA
caaggaccatatgtaacctaccatca

SEQ ID NO: 12931 - DNA, 22 bp, synthetic construct
  misc_feature 1..22: note = Synthetic Construct
  source 1..22: mol_type = other DNA
ccgcttttgctcctcacacatc

SEQ ID NO: 12932 - DNA, 24 bp, synthetic construct
  misc_feature 1..24: note = Synthetic Construct
  source 1..24: mol_type = other DNA
ggaacaaaaatggctcttggacat

SEQ ID NO: 12933 - DNA, 20 bp, synthetic construct
  misc_feature 1..20: note = Synthetic Construct
  source 1..20: mol_type = other DNA
ccgtggtttcctcacaccat

SEQ ID NO: 12934 - DNA, 20 bp, synthetic construct
  misc_feature 1..20: note = Synthetic Construct
  source 1..20: mol_type = other DNA
tgcgcttccaaactccagaa

SEQ ID NO: 12935 - DNA, 25 bp, synthetic construct
  misc_feature 1..25: note = Synthetic Construct
  source 1..25: mol_type = other DNA
cgtgtccgttcctctaggtcattag

SEQ ID NO: 12936 - DNA, 23 bp, synthetic construct
  misc_feature 1..23: note = Synthetic Construct
  source 1..23: mol_type = other DNA
tgtctggaacacctaaggactca

SEQ ID NO: 12937 - DNA, 26 bp, synthetic construct
  misc_feature 1..26: note = Synthetic Construct
  source 1..26: mol_type = other DNA
ccccttttcctaaagcagaatgatgt

SEQ ID NO: 12938 - DNA, 21 bp, synthetic construct
  misc_feature 1..21: note = Synthetic Construct
  source 1..21: mol_type = other DNA
cggtaaccgggaaaactcaga

SEQ ID NO: 12939 - DNA, 21 bp, synthetic construct
  misc_feature 1..21: note = Synthetic Construct
  source 1..21: mol_type = other DNA
tctgctagccactggacttca

SEQ ID NO: 12940 - DNA, 22 bp, synthetic construct
  misc_feature 1..22: note = Synthetic Construct
  source 1..22: mol_type = other DNA
cacctggcaggaatgatggttt

SEQ ID NO: 12941 - DNA, 24 bp, synthetic construct
  misc_feature 1..24: note = Synthetic Construct
  source 1..24: mol_type = other DNA
gggcttcattcatcacatgactct

SEQ ID NO: 12942 - DNA, 26 bp, synthetic construct
  misc_feature 1..26: note = Synthetic Construct
  source 1..26: mol_type = other DNA
gcagaaatgttcccatgtgcttgaaa

SEQ ID NO: 12943 - DNA, 24 bp, synthetic construct
  misc_feature 1..24: note = Synthetic Construct
  source 1..24: mol_type = other DNA
caggctgaaggagagtttccaatc

SEQ ID NO: 12944 - DNA, 20 bp, synthetic construct
  misc_feature 1..20: note = Synthetic Construct
  source 1..20: mol_type = other DNA
caacgtgccgcattgtgttg

SEQ ID NO: 12945 - DNA, 20 bp, synthetic construct
  misc_feature 1..20: note = Synthetic Construct
  source 1..20: mol_type = other DNA
gcaacagcctgcagatggat

SEQ ID NO: 12946 - DNA, 22 bp, synthetic construct
  misc_feature 1..22: note = Synthetic Construct
  source 1..22: mol_type = other DNA
ctcctccaccttttgctacagt

SEQ ID NO: 12947 - DNA, 24 bp, synthetic construct
  misc_feature 1..24: note = Synthetic Construct
  source 1..24: mol_type = other DNA
gagggaacgatagctttgcagtta

SEQ ID NO: 12948 - DNA, 27 bp, synthetic construct
  misc_feature 1..27: note = Synthetic Construct
  source 1..27: mol_type = other DNA
caagttctattctgcaggtgtcttttg

SEQ ID NO: 12949 - DNA, 24 bp, synthetic construct
  misc_feature 1..24: note = Synthetic Construct
  source 1..24: mol_type = other DNA
catagggcagtagcagtgagattt

SEQ ID NO: 12950 - DNA, 21 bp, synthetic construct
  misc_feature 1..21: note = Synthetic Construct
  source 1..21: mol_type = other DNA
ccgatcaggcgtctgtcttgt

SEQ ID NO: 12951 - DNA, 23 bp, synthetic construct
  misc_feature 1..23: note = Synthetic Construct
  source 1..23: mol_type = other DNA
gtccttcagactgtccgttttca

SEQ ID NO: 12952 - DNA, 21 bp, synthetic construct
  misc_feature 1..21: note = Synthetic Construct
  source 1..21: mol_type = other DNA
agtgctgtgggctggagttga

SEQ ID NO: 12953 - DNA, 21 bp, synthetic construct
  misc_feature 1..21: note = Synthetic Construct
  source 1..21: mol_type = other DNA
ccattgggcaggttccacatc

SEQ ID NO: 12954 - DNA, 25 bp, synthetic construct
  misc_feature 1..25: note = Synthetic Construct
  source 1..25: mol_type = other DNA
cacataggaaggactggaagctatg

SEQ ID NO: 12955 - DNA, 22 bp, synthetic construct
  misc_feature 1..22: note = Synthetic Construct
  source 1..22: mol_type = other DNA
taggggcatgctgtagctctga

SEQ ID NO: 12956 - DNA, 22 bp, synthetic construct
  misc_feature 1..22: note = Synthetic Construct
  source 1..22: mol_type = other DNA
cagccacaccaaattgctggtt

SEQ ID NO: 12957 - DNA, 24 bp, synthetic construct
  misc_feature 1..24: note = Synthetic Construct
  source 1..24: mol_type = other DNA
ctggcacaacggtgtttttagtgt

SEQ ID NO: 12958 - DNA, 21 bp, synthetic construct
  misc_feature 1..21: note = Synthetic Construct
  source 1..21: mol_type = other DNA
gcccacagtatcctggactga

SEQ ID NO: 12959 - DNA, 27 bp, synthetic construct
  misc_feature 1..27: note = Synthetic Construct
  source 1..27: mol_type = other DNA
ggcttagttgtaagggctttaggatca

SEQ ID NO: 12960 - DNA, 24 bp, synthetic construct
  misc_feature 1..24: note = Synthetic Construct
  source 1..24: mol_type = other DNA
ggcagacgggtttagtcttcaagt

SEQ ID NO: 12961 - DNA, 23 bp, synthetic construct
  misc_feature 1..23: note = Synthetic Construct
  source 1..23: mol_type = other DNA
tgcacatcatccattgcaagaac

SEQ ID NO: 12962 - DNA, 23 bp, synthetic construct
  misc_feature 1..23: note = Synthetic Construct
  source 1..23: mol_type = other DNA
gaggtaaatgggtcaagcacact

SEQ ID NO: 12963 - DNA, 21 bp, synthetic construct
  misc_feature 1..21: note = Synthetic Construct
  source 1..21: mol_type = other DNA
tgggtaggccctaatggactt

SEQ ID NO: 12964 - DNA, 22 bp, synthetic construct
  misc_feature 1..22: note = Synthetic Construct
  source 1..22: mol_type = other DNA
tcggcctctgactggtgaatgt

SEQ ID NO: 12965 - DNA, 24 bp, synthetic construct
  misc_feature 1..24: note = Synthetic Construct
  source 1..24: mol_type = other DNA
gtgagaggctggtagcaaggtaga

SEQ ID NO: 12966 - DNA, 21 bp, synthetic construct
  misc_feature 1..21: note = Synthetic Construct
  source 1..21: mol_type = other DNA
cccgaaatccaaaggcaggaa

SEQ ID NO: 12967 - DNA, 23 bp, synthetic construct
  misc_feature 1..23: note = Synthetic Construct
  source 1..23: mol_type = other DNA
ggttggttcatgccctttgtact

SEQ ID NO: 12968 - DNA, 21 bp, synthetic construct
  misc_feature 1..21: note = Synthetic Construct
  source 1..21: mol_type = other DNA
caccttcattgcagcgtgtga

SEQ ID NO: 12969 - DNA, 20 bp, synthetic construct
  misc_feature 1..20: note = Synthetic Construct
  source 1..20: mol_type = other DNA
tggccttgttggtcctcagt

SEQ ID NO: 12970 - DNA, 23 bp, synthetic construct
  misc_feature 1..23: note = Synthetic Construct
  source 1..23: mol_type = other DNA
gggttgaacttgactgggtggtt

SEQ ID NO: 12971 - DNA, 20 bp, synthetic construct
  misc_feature 1..20: note = Synthetic Construct
  source 1..20: mol_type = other DNA
agctgaatgctgccagttgt

SEQ ID NO: 12972 - DNA, 25 bp, synthetic construct
  misc_feature 1..25: note = Synthetic Construct
  source 1..25: mol_type = other DNA
gccgaaaggaaagcatgagtcatca

SEQ ID NO: 12973 - DNA, 26 bp, synthetic construct
  misc_feature 1..26: note = Synthetic Construct
  source 1..26: mol_type = other DNA
ctttccctgcatttttgacacctaac

SEQ ID NO: 12974 - DNA, 23 bp, synthetic construct
  misc_feature 1..23: note = Synthetic Construct
  source 1..23: mol_type = other DNA
cctcactttgttccccaaagaca

SEQ ID NO: 12975 - DNA, 24 bp, synthetic construct
  misc_feature 1..24: note = Synthetic Construct
  source 1..24: mol_type = other DNA
gcatcattctgcctgggtttgaag

SEQ ID NO: 12976 - DNA, 27 bp, synthetic construct
  misc_feature 1..27: note = Synthetic Construct
  source 1..27: mol_type = other DNA
gtgaaacaagcagtaagtgtgggatga

SEQ ID NO: 12977 - DNA, 22 bp, synthetic construct
  misc_feature 1..22: note = Synthetic Construct
  source 1..22: mol_type = other DNA
gagtgtgaccgagacaggatgt

SEQ ID NO: 12978 - DNA, 20 bp, synthetic construct
  misc_feature 1..20: note = Synthetic Construct
  source 1..20: mol_type = other DNA
gcttgaccaggcagctttga

SEQ ID NO: 12979 - DNA, 19 bp, synthetic construct
  misc_feature 1..19: note = Synthetic Construct
  source 1..19: mol_type = other DNA
gcccacatgccacccacta

SEQ ID NO: 12980 - DNA, 21 bp, synthetic construct
  misc_feature 1..21: note = Synthetic Construct
  source 1..21: mol_type = other DNA
gggacacaggctgtagtgtca

SEQ ID NO: 12981 - DNA, 22 bp, synthetic construct
  misc_feature 1..22: note = Synthetic Construct
  source 1..22: mol_type = other DNA
gcctactcaccttcaagctcaa

SEQ ID NO: 12982 - DNA, 21 bp, synthetic construct
  misc_feature 1..21: note = Synthetic Construct
  source 1..21: mol_type = other DNA
aatgcctgaagtggctgatgt

SEQ ID NO: 12983 - DNA, 22 bp, synthetic construct
  misc_feature 1..22: note = Synthetic Construct
  source 1..22: mol_type = other DNA
ggacatggtgacattccacagt

SEQ ID NO: 12984 - DNA, 23 bp, synthetic construct
  misc_feature 1..23: note = Synthetic Construct
  source 1..23: mol_type = other DNA
gtcttcccacaatgtcaggcttt

SEQ ID NO: 12985 - DNA, 24 bp, synthetic construct
  misc_feature 1..24: note = Synthetic Construct
  source 1..24: mol_type = other DNA
gctcagccttcatgtgacctggat

SEQ ID NO: 12986 - DNA, 21 bp, synthetic construct
  misc_feature 1..21: note = Synthetic Construct
  source 1..21: mol_type = other DNA
tacggacagagcccggtaatc

SEQ ID NO: 12987 - DNA, 24 bp, synthetic construct
  misc_feature 1..24: note = Synthetic Construct
  source 1..24: mol_type = other DNA
tcctcataggatggcatctctcaa

SEQ ID NO: 12988 - DNA, 22 bp, synthetic construct
  misc_feature 1..22: note = Synthetic Construct
  source 1..22: mol_type = other DNA
ggatgagcccaaagcacacaga

SEQ ID NO: 12989 - DNA, 22 bp, synthetic construct
  misc_feature 1..22: note = Synthetic Construct
  source 1..22: mol_type = other DNA
aagcttgccatcatggtgtact

SEQ ID NO: 12990 - DNA, 21 bp, synthetic construct
  misc_feature 1..21: note = Synthetic Construct
  source 1..21: mol_type = other DNA
cccaccacacccagaacacaa

SEQ ID NO: 12991 - DNA, 20 bp, synthetic construct
  misc_feature 1..20: note = Synthetic Construct
  source 1..20: mol_type = other DNA
cccaaagtggctcccaaaga

SEQ ID NO: 12992 - DNA, 24 bp, synthetic construct
  misc_feature 1..24: note = Synthetic Construct
  source 1..24: mol_type = other DNA
gttggaaaaggagggaaagacaga

SEQ ID NO: 12993 - DNA, 24 bp, synthetic construct
  misc_feature 1..24: note = Synthetic Construct
  source 1..24: mol_type = other DNA
ggggtaggcagtttttcctgtgat

SEQ ID NO: 12994 - DNA, 22 bp, synthetic construct
  misc_feature 1..22: note = Synthetic Construct
  source 1..22: mol_type = other DNA
agtaccccatggcactggaaga

SEQ ID NO: 12995 - DNA, 21 bp, synthetic construct
  misc_feature 1..21: note = Synthetic Construct
  source 1..21: mol_type = other DNA
tgagctgggatagccccagaa

SEQ ID NO: 12996 - DNA, 23 bp, synthetic construct
  misc_feature 1..23: note = Synthetic Construct
  source 1..23: mol_type = other DNA
cagctcgttcctgtccaatccat

SEQ ID NO: 12997 - DNA, 28 bp, synthetic construct
  misc_feature 1..28: note = Synthetic Construct
  source 1..28: mol_type = other DNA
ggtagtggagtaggtaaaagggtactgt

SEQ ID NO: 12998 - DNA, 23 bp, synthetic construct
  misc_feature 1..23: note = Synthetic Construct
  source 1..23: mol_type = other DNA
tgccgtgagaactaatcaaggtt

SEQ ID NO: 12999 - DNA, 25 bp, synthetic construct
  misc_feature 1..25: note = Synthetic Construct
  source 1..25: mol_type = other DNA
cttcatgtgccatgagactttcctt

SEQ ID NO: 13000 - DNA, 23 bp, synthetic construct
  misc_feature 1..23: note = Synthetic Construct
  source 1..23: mol_type = other DNA
agggtgggacatggcaaataaag

SEQ ID NO: 13001 - DNA, 27 bp, synthetic construct
  misc_feature 1..27: note = Synthetic Construct
  source 1..27: mol_type = other DNA
gagttgacgcctgtaacatcaatttca

SEQ ID NO: 13002 - DNA, 21 bp, synthetic construct
  misc_feature 1..21: note = Synthetic Construct
  source 1..21: mol_type = other DNA
agggtgtccgtggtgtagcaa

SEQ ID NO: 13003 - DNA, 25 bp, synthetic construct
  misc_feature 1..25: note = Synthetic Construct
  source 1..25: mol_type = other DNA
cacttccaagatgaccattctctgt

SEQ ID NO: 13004 - DNA, 23 bp, synthetic construct
  misc_feature 1..23: note = Synthetic Construct
  source 1..23: mol_type = other DNA
gctggagggtagagagtcctgtt

SEQ ID NO: 13005 - DNA, 22 bp, synthetic construct
  misc_feature 1..22: note = Synthetic Construct
  source 1..22: mol_type = other DNA
ttgcttcgagcttggggtcatc

SEQ ID NO: 13006 - DNA, 23 bp, synthetic construct
  misc_feature 1..23: note = Synthetic Construct
  source 1..23: mol_type = other DNA
gggcccagctctgaactatcctt

SEQ ID NO: 13007 - DNA, 22 bp, synthetic construct
  misc_feature 1..22: note = Synthetic Construct
  source 1..22: mol_type = other DNA
gccatcttctcactggttccaa

SEQ ID NO: 13008 - DNA, 22 bp, synthetic construct
  misc_feature 1..22: note = Synthetic Construct
  source 1..22: mol_type = other DNA
gtgccaggttgtagcagagaag

SEQ ID NO: 13009 - DNA, 23 bp, synthetic construct
  misc_feature 1..23: note = Synthetic Construct
  source 1..23: mol_type = other DNA
tgtaggttgtcaggaggaagtca

SEQ ID NO: 13010 - DNA, 22 bp, synthetic construct
  misc_feature 1..22: note = Synthetic Construct
  source 1..22: mol_type = other DNA
agcccttcttggtggaagttac

SEQ ID NO: 13011 - DNA, 20 bp, synthetic construct
  misc_feature 1..20: note = Synthetic Construct
  source 1..20: mol_type = other DNA
tcccaaccactgccatcctt

SEQ ID NO: 13012 - DNA, 20 bp, synthetic construct
  misc_feature 1..20: note = Synthetic Construct
  source 1..20: mol_type = other DNA
gcaggagtgggtcgaagatg

SEQ ID NO: 13013 - DNA, 22 bp, synthetic construct
  misc_feature 1..22: note = Synthetic Construct
  source 1..22: mol_type = other DNA
ccccacaaaaagcaaaccaaga

SEQ ID NO: 13014 - DNA, 21 bp, synthetic construct
  misc_feature 1..21: note = Synthetic Construct
  source 1..21: mol_type = other DNA
tctgcaggaagtgctgtctct

SEQ ID NO: 13015 - DNA, 22 bp, synthetic construct
  misc_feature 1..22: note = Synthetic Construct
  source 1..22: mol_type = other DNA
ctcaatgctgcgaaggcgaatc

SEQ ID NO: 13016 - DNA, 25 bp, synthetic construct
  misc_feature 1..25: note = Synthetic Construct
  source 1..25: mol_type = other DNA
ggagttcaaagctgctgggattagt

SEQ ID NO: 13017 - DNA, 23 bp, synthetic construct
  misc_feature 1..23: note = Synthetic Construct
  source 1..23: mol_type = other DNA
ggtactccattgcttccggtact

SEQ ID NO: 13018 - DNA, 22 bp, synthetic construct
  misc_feature 1..22: note = Synthetic Construct
  source 1..22: mol_type = other DNA
ccagtcatcctccgtgtctgat

SEQ ID NO: 13019 - DNA, 24 bp, synthetic construct
  misc_feature 1..24: note = Synthetic Construct
  source 1..24: mol_type = other DNA
ccaaccctcctagtgatgcagtat

SEQ ID NO: 13020 - DNA, 20 bp, synthetic construct
  misc_feature 1..20: note = Synthetic Construct
  source 1..20: mol_type = other DNA
acagcacttcacctgcatga

SEQ ID NO: 13021 - DNA, 26 bp, synthetic construct
  misc_feature 1..26: note = Synthetic Construct
  source 1..26: mol_type = other DNA
caacaggatgtatctcaaccaagtca

SEQ ID NO: 13022 - DNA, 20 bp, synthetic construct
  misc_feature 1..20: note = Synthetic Construct
  source 1..20: mol_type = other DNA
tccccattccaccccaccaa

SEQ ID NO: 13023 - DNA, 22 bp, synthetic construct
  misc_feature 1..22: note = Synthetic Construct
  source 1..22: mol_type = other DNA
cggggattgtcatccaggttgt

SEQ ID NO: 13024 - DNA, 23 bp, synthetic construct
  misc_feature 1..23: note = Synthetic Construct
  source 1..23: mol_type = other DNA
cgttctcacggaagacaacttct

SEQ ID NO: 13025 - DNA, 23 bp, synthetic construct
  misc_feature 1..23: note = Synthetic Construct
  source 1..23: mol_type = other DNA
ctctgtcacaaccactccattct

SEQ ID NO: 13026 - DNA, 24 bp, synthetic construct
  misc_feature 1..24: note = Synthetic Construct
  source 1..24: mol_type = other DNA
gttcccagaatgaattcccacgta

SEQ ID NO: 13027 - DNA, 21 bp, synthetic construct
  misc_feature 1..21: note = Synthetic Construct
  source 1..21: mol_type = other DNA
aaggacctgcccctcctcagt

SEQ ID NO: 13028 - DNA, 26 bp, synthetic construct
  misc_feature 1..26: note = Synthetic Construct
  source 1..26: mol_type = other DNA
cctatcaaaaagatgaggcactggaa

SEQ ID NO: 13029 - DNA, 24 bp, synthetic construct
  misc_feature 1..24: note = Synthetic Construct
  source 1..24: mol_type = other DNA
gactgttacctcgggattgctttg

SEQ ID NO: 13030 - DNA, 22 bp, synthetic construct
  misc_feature 1..22: note = Synthetic Construct
  source 1..22: mol_type = other DNA
gggaaggttggggtgttcattg

SEQ ID NO: 13031 - DNA, 24 bp, synthetic construct
  misc_feature 1..24: note = Synthetic Construct
  source 1..24: mol_type = other DNA
ccccagcttattgccaggagagtt

SEQ ID NO: 13032 - DNA, 22 bp, synthetic construct
  misc_feature 1..22: note = Synthetic Construct
  source 1..22: mol_type = other DNA
gccaggattgaagcccaagtca

SEQ ID NO: 13033 - DNA, 25 bp, synthetic construct
  misc_feature 1..25: note = Synthetic Construct
  source 1..25: mol_type = other DNA
tccatgcactagtggttttcttaca

SEQ ID NO: 13034 - DNA, 24 bp, synthetic construct
  misc_feature 1..24: note = Synthetic Construct
  source 1..24: mol_type = other DNA
cctttctaacagactctggctcaa

SEQ ID NO: 13035 - DNA, 20 bp, synthetic construct
  misc_feature 1..20: note = Synthetic Construct
  source 1..20: mol_type = other DNA
agcactgtgccatcctgtga

SEQ ID NO: 13036 - DNA, 24 bp, synthetic construct
  misc_feature 1..24: note = Synthetic Construct
  source 1..24: mol_type = other DNA
gctgcctgagctgaatttcaaaac

SEQ ID NO: 13037 - DNA, 20 bp, synthetic construct
  misc_feature 1..20: note = Synthetic Construct
  source 1..20: mol_type = other DNA
tagggtctgcgaggcactga

SEQ ID NO: 13038 - DNA, 24 bp, synthetic construct
  misc_feature 1..24: note = Synthetic Construct
  source 1..24: mol_type = other DNA
catgacattgcaactccctctgtt

SEQ ID NO: 13039 - DNA, 24 bp, synthetic construct
  misc_feature 1..24: note = Synthetic Construct
  source 1..24: mol_type = other DNA
gaaaacgcggtaggatacaaggtt

SEQ ID NO: 13040 - DNA, 21 bp, synthetic construct
  misc_feature 1..21: note = Synthetic Construct
  source 1..21: mol_type = other DNA
tgagctggttagagcacgttt

SEQ ID NO: 13041 - DNA, 23 bp, synthetic construct
  misc_feature 1..23: note = Synthetic Construct
  source 1..23: mol_type = other DNA
acatggggtattcagccaaatgt

SEQ ID NO: 13042 - DNA, 21 bp, synthetic construct
  misc_feature 1..21: note = Synthetic Construct
  source 1..21: mol_type = other DNA
agcaactccgtggtcaagaat

SEQ ID NO: 13043 - DNA, 24 bp, synthetic construct
  misc_feature 1..24: note = Synthetic Construct
  source 1..24: mol_type = other DNA
cacagtgacctgcatttaaccttt

SEQ ID NO: 13044 - DNA, 22 bp, synthetic construct
  misc_feature 1..22: note = Synthetic Construct
  source 1..22: mol_type = other DNA
gctcaggtcagctggtcttcaa

SEQ ID NO: 13045 - DNA, 27 bp, synthetic construct
  misc_feature 1..27: note = Synthetic Construct
  source 1..27: mol_type = other DNA
gtgagactaagaggttaagtgccttgt

SEQ ID NO: 13046 - DNA, 20 bp, synthetic construct
  misc_feature 1..20: note = Synthetic Construct
  source 1..20: mol_type = other DNA
gagcagcaaacgtcctcaac

SEQ ID NO: 13047 - DNA, 19 bp, synthetic construct
  misc_feature 1..19: note = Synthetic Construct
  source 1..19: mol_type = other DNA
ccacagaggggctgcaaaa

SEQ ID NO: 13048 - DNA, 24 bp, synthetic construct
  misc_feature 1..24: note = Synthetic Construct
  source 1..24: mol_type = other DNA
ggcctcagaacactatacaccaaa

SEQ ID NO: 13049 - DNA, 22 bp, synthetic construct
  misc_feature 1..22: note = Synthetic Construct
  source 1..22: mol_type = other DNA
gcctccagagaccgcaaataca

SEQ ID NO: 13050 - DNA, 22 bp, synthetic construct
  misc_feature 1..22: note = Synthetic Construct
  source 1..22: mol_type = other DNA
aggcctccatctgctcttctgt

SEQ ID NO: 13051 - DNA, 25 bp, synthetic construct
  misc_feature 1..25: note = Synthetic Construct
  source 1..25: mol_type = other DNA
cctgcagcttccatgtggacattac

SEQ ID NO: 13052 - DNA, 22 bp, synthetic construct
  misc_feature 1..22: note = Synthetic Construct
  source 1..22: mol_type = other DNA
cctgtgtggtaccagcttcttc

SEQ ID NO: 13053 - DNA, 22 bp, synthetic construct
  misc_feature 1..22: note = Synthetic Construct
  source 1..22: mol_type = other DNA
tggagggcaaaaccaaaaggat

SEQ ID NO: 13054 - DNA, 23 bp, synthetic construct
  misc_feature 1..23: note = Synthetic Construct
  source 1..23: mol_type = other DNA
cctcctccatgtggccatattac

SEQ ID NO: 13055 - DNA, 26 bp, synthetic construct
  misc_feature 1..26: note = Synthetic Construct
  source 1..26: mol_type = other DNA
cctaaccgctagaccatatgggaagt

SEQ ID NO: 13056 - DNA, 18 bp, synthetic construct
  misc_feature 1..18: note = Synthetic Construct
  source 1..18: mol_type = other DNA
accgccaccaccaactgt

SEQ ID NO: 13057 - DNA, 24 bp, synthetic construct
  misc_feature 1..24: note = Synthetic Construct
  source 1..24: mol_type = other DNA
gttcaatagctgcagtggggttac

SEQ ID NO: 13058 - DNA, 20 bp, synthetic construct
  misc_feature 1..20: note = Synthetic Construct
  source 1..20: mol_type = other DNA
ccccagattccccactgtca

SEQ ID NO: 13059 - DNA, 25 bp, synthetic construct
  misc_feature 1..25: note = Synthetic Construct
  source 1..25: mol_type = other DNA
gacctgaagatggtagatgctcttg

SEQ ID NO: 13060 - DNA, 22 bp, synthetic construct
  misc_feature 1..22: note = Synthetic Construct
  source 1..22: mol_type = other DNA
tgggtcctgtcttctccacctt

SEQ ID NO: 13061 - DNA, 22 bp, synthetic construct
  misc_feature 1..22: note = Synthetic Construct
  source 1..22: mol_type = other DNA
tgtggtggaacgggtacaggat

SEQ ID NO: 13062 - DNA, 24 bp, synthetic construct
  misc_feature 1..24: note = Synthetic Construct
  source 1..24: mol_type = other DNA
agaaacacttacccacccaatcaa

SEQ ID NO: 13063 - DNA, 26 bp, synthetic construct
  misc_feature 1..26: note = Synthetic Construct
  source 1..26: mol_type = other DNA
ccaaaccagcatgaagcatttacaga

SEQ ID NO: 13064 - DNA, 23 bp, synthetic construct
  misc_feature 1..23: note = Synthetic Construct
  source 1..23: mol_type = other DNA
ccacctaggacatgaaggagtca

SEQ ID NO: 13065 - DNA, 23 bp, synthetic construct
  misc_feature 1..23: note = Synthetic Construct
  source 1..23: mol_type = other DNA
gcggctagaactaagtgcgaaca

SEQ ID NO: 13066 - DNA, 23 bp, synthetic construct
  misc_feature 1..23: note = Synthetic Construct
  source 1..23: mol_type = other DNA
atggatcgcgtttgagaacaatc

SEQ ID NO: 13067 - DNA, 26 bp, synthetic construct
  misc_feature 1..26: note = Synthetic Construct
  source 1..26: mol_type = other DNA
gggtagaaagcagtttgtaggggtta

SEQ ID NO: 13068 - DNA, 25 bp, synthetic construct
  misc_feature 1..25: note = Synthetic Construct
  source 1..25: mol_type = other DNA
gcgagcaaacctttgacttttcctt

SEQ ID NO: 13069 - DNA, 22 bp, synthetic construct
  misc_feature 1..22: note = Synthetic Construct
  source 1..22: mol_type = other DNA
agccatcatgtccacattccat

SEQ ID NO: 13070 - DNA, 23 bp, synthetic construct
  misc_feature 1..23: note = Synthetic Construct
  source 1..23: mol_type = other DNA
gttctgtcagagggtgtgcttca

SEQ ID NO: 13071 - DNA, 27 bp, synthetic construct
  misc_feature 1..27: note = Synthetic Construct
  source 1..27: mol_type = other DNA
ggaaggcttagtcaacagacgacattt

SEQ ID NO: 13072 - DNA, 19 bp, synthetic construct
  misc_feature 1..19: note = Synthetic Construct
  source 1..19: mol_type = other DNA
gctgaaagggccaggttgt

SEQ ID NO: 13073 - DNA, 22 bp, synthetic construct
  misc_feature 1..22: note = Synthetic Construct
  source 1..22: mol_type = other DNA
catgaccggcttctgtctagtt

SEQ ID NO: 13074 - DNA, 22 bp, synthetic construct
  misc_feature 1..22: note = Synthetic Construct
  source 1..22: mol_type = other DNA
cagaccctgctatcaccagttt

SEQ ID NO: 13075 - DNA, 22 bp, synthetic construct
  misc_feature 1..22: note = Synthetic Construct
  source 1..22: mol_type = other DNA
tgagagtcagcaagtgccttag

SEQ ID NO: 13076 - DNA, 24 bp, synthetic construct
  misc_feature 1..24: note = Synthetic Construct
  source 1..24: mol_type = other DNA
gcagatgcactgtcaagctgtact

SEQ ID NO: 13077 - DNA, 24 bp, synthetic construct
  misc_feature 1..24: note = Synthetic Construct
  source 1..24: mol_type = other DNA
cgatgggtgtggttcaaggtcaaa

SEQ ID NO: 13078 - DNA, 21 bp, synthetic construct
  misc_feature 1..21: note = Synthetic Construct
  source 1..21: mol_type = other DNA
ggctcccacccactgagtttt

SEQ ID NO: 13079 - DNA, 27 bp, synthetic construct
  misc_feature 1..27: note = Synthetic Construct
  source 1..27: mol_type = other DNA
caccctgtaaacatcattttcgcatca

SEQ ID NO: 13080 - DNA, 20 bp, synthetic construct
  misc_feature 1..20: note = Synthetic Construct
  source 1..20: mol_type = other DNA
ttcctgacctcgcgatcctt

SEQ ID NO: 13081 - DNA, 24 bp, synthetic construct
  misc_feature 1..24: note = Synthetic Construct
  source 1..24: mol_type = other DNA
ccttcattcagccactgtcctgta

SEQ ID NO: 13082 - DNA, 23 bp, synthetic construct
  misc_feature 1..23: note = Synthetic Construct
  source 1..23: mol_type = other DNA
gcccacctcagtcagggaagata

SEQ ID NO: 13083 - DNA, 24 bp, synthetic construct
  misc_feature 1..24: note = Synthetic Construct
  source 1..24: mol_type = other DNA
ggagtcaagcaaaggcaatagtga

SEQ ID NO: 13084 - DNA, 21 bp, synthetic construct
  misc_feature 1..21: note = Synthetic Construct
  source 1..21: mol_type = other DNA
gggctgtggaaaccacaaatg

SEQ ID NO: 13085 - DNA, 22 bp, synthetic construct
  misc_feature 1..22: note = Synthetic Construct
  source 1..22: mol_type = other DNA
acgagagaggtgaagtcacaga

SEQ ID NO: 13086 - DNA, 20 bp, synthetic construct
  misc_feature 1..20: note = Synthetic Construct
  source 1..20: mol_type = other DNA
agccctgaaggtcgtccata

SEQ ID NO: 13087 - DNA, 24 bp, synthetic construct
  misc_feature 1..24: note = Synthetic Construct
  source 1..24: mol_type = other DNA
ccttgaagctgagctgaagcagtt

SEQ ID NO: 13088 - DNA, 23 bp, synthetic construct
  misc_feature 1..23: note = Synthetic Construct
  source 1..23: mol_type = other DNA
tcaggcttagatccctggagtag

SEQ ID NO: 13089 - DNA, 23 bp, synthetic construct
  misc_feature 1..23: note = Synthetic Construct
  source 1..23: mol_type = other DNA
gctgcttatagcacaggcaccaa

SEQ ID NO: 13090 - DNA, 21 bp, synthetic construct
  misc_feature 1..21: note = Synthetic Construct
  source 1..21: mol_type = other DNA
tgttgggacccacctctgcaa

SEQ ID NO: 13091 - DNA, 20 bp, synthetic construct
  misc_feature 1..20: note = Synthetic Construct
  source 1..20: mol_type = other DNA
gctgatctgctggcgaggtt

SEQ ID NO: 13092 - DNA, 23 bp, synthetic construct
  misc_feature 1..23: note = Synthetic Construct
  source 1..23: mol_type = other DNA
cacatggccttggatggtattct

SEQ ID NO: 13093 - DNA, 23 bp, synthetic construct
  misc_feature 1..23: note = Synthetic Construct
  source 1..23: mol_type = other DNA
ggtgtttgagccactcagtcaag

SEQ ID NO: 13094 - DNA, 21 bp, synthetic construct
  misc_feature 1..21: note = Synthetic Construct
  source 1..21: mol_type = other DNA
caggtttccaggcatgtgtca

SEQ ID NO: 13095 - DNA, 20 bp, synthetic construct
  misc_feature 1..20: note = Synthetic Construct
  source 1..20: mol_type = other DNA
cagcagcccaaactcgcttt

SEQ ID NO: 13096 - DNA, 22 bp, synthetic construct
  misc_feature 1..22: note = Synthetic Construct
  source 1..22: mol_type = other DNA
gcagaactcaggccctctgtat

SEQ ID NO: 13097 - DNA, 24 bp, synthetic construct
  misc_feature 1..24: note = Synthetic Construct
  source 1..24: mol_type = other DNA
gctgcctgaatggatttgaagttg

SEQ ID NO: 13098 - DNA, 25 bp, synthetic construct
  misc_feature 1..25: note = Synthetic Construct
  source 1..25: mol_type = other DNA
gtgtggaaaatggcaagacagttct

SEQ ID NO: 13099 - DNA, 21 bp, synthetic construct
  misc_feature 1..21: note = Synthetic Construct
  source 1..21: mol_type = other DNA
cctcacctttcaggctcaagt

SEQ ID NO: 13100 - DNA, 21 bp, synthetic construct
  misc_feature 1..21: note = Synthetic Construct
  source 1..21: mol_type = other DNA
tttacccaggctgtggacaag

SEQ ID NO: 13101 - DNA, 23 bp, synthetic construct
  misc_feature 1..23: note = Synthetic Construct
  source 1..23: mol_type = other DNA
gagggtagggactgtgttgatct

SEQ ID NO: 13102 - DNA, 25 bp, synthetic construct
  misc_feature 1..25: note = Synthetic Construct
  source 1..25: mol_type = other DNA
gctgggacactaagtcatgaagcta

SEQ ID NO: 13103 - DNA, 25 bp, synthetic construct
  misc_feature 1..25: note = Synthetic Construct
  source 1..25: mol_type = other DNA
gactgatgtccacatatccctctga

SEQ ID NO: 13104 - DNA, 24 bp, synthetic construct
  misc_feature 1..24: note = Synthetic Construct
  source 1..24: mol_type = other DNA
ctggtcccagggatttgtttcttg

SEQ ID NO: 13105 - DNA, 22 bp, synthetic construct
  misc_feature 1..22: note = Synthetic Construct
  source 1..22: mol_type = other DNA
ctgccaagcaacaatggctatg

SEQ ID NO: 13106 - DNA, 21 bp, synthetic construct
  misc_feature 1..21: note = Synthetic Construct
  source 1..21: mol_type = other DNA
gcgagggaaattcagccagat

SEQ ID NO: 13107 - DNA, 21 bp, synthetic construct
  misc_feature 1..21: note = Synthetic Construct
  source 1..21: mol_type = other DNA
gtcctgggctcgaaacacact

SEQ ID NO: 13108 - DNA, 22 bp, synthetic construct
  misc_feature 1..22: note = Synthetic Construct
  source 1..22: mol_type = other DNA
ggaacagactatgtgggcatca

SEQ ID NO: 13109 - DNA, 22 bp, synthetic construct
  misc_feature 1..22: note = Synthetic Construct
  source 1..22: mol_type = other DNA
acctcccgttcctctctacctt

SEQ ID NO: 13110 - DNA, 25 bp, synthetic construct
  misc_feature 1..25: note = Synthetic Construct
  source 1..25: mol_type = other DNA
ctgaaacatctgcactgtctaggaa

SEQ ID NO: 13111 - DNA, 24 bp, synthetic construct
  misc_feature 1..24: note = Synthetic Construct
  source 1..24: mol_type = other DNA
cctgtcttcagcaagaagcagatg

SEQ ID NO: 13112 - DNA, 23 bp, synthetic construct
  misc_feature 1..23: note = Synthetic Construct
  source 1..23: mol_type = other DNA
tgcttgctccctatggaaaatgt

SEQ ID NO: 13113 - DNA, 21 bp, synthetic construct
  misc_feature 1..21: note = Synthetic Construct
  source 1..21: mol_type = other DNA
atgggaagggaggctgcagtt

SEQ ID NO: 13114 - DNA, 23 bp, synthetic construct
  misc_feature 1..23: note = Synthetic Construct
  source 1..23: mol_type = other DNA
tcccctcttctgtgatggaaaga

SEQ ID NO: 13115 - DNA, 22 bp, synthetic construct
  misc_feature 1..22: note = Synthetic Construct
  source 1..22: mol_type = other DNA
cccaggcttcttcacccttttg

SEQ ID NO: 13116 - DNA, 24 bp, synthetic construct
  misc_feature 1..24: note = Synthetic Construct
  source 1..24: mol_type = other DNA
cctaaacaaaggcgagcatgatga

SEQ ID NO: 13117 - DNA, 22 bp, synthetic construct
  misc_feature 1..22: note = Synthetic Construct
  source 1..22: mol_type = other DNA
agtggacgggattcagaactca

SEQ ID NO: 13118 - DNA, 24 bp, synthetic construct
  misc_feature 1..24: note = Synthetic Construct
  source 1..24: mol_type = other DNA
ggagggaagtgttgtggttgaaga

SEQ ID NO: 13119 - DNA, 22 bp, synthetic construct
  misc_feature 1..22: note = Synthetic Construct
  source 1..22: mol_type = other DNA
ggtgtgaactctccagctcatc

SEQ ID NO: 13120 - DNA, 21 bp, synthetic construct
  misc_feature 1..21: note = Synthetic Construct
  source 1..21: mol_type = other DNA
tcatctgcagtttgcccttga

SEQ ID NO: 13121 - DNA, 24 bp, synthetic construct
  misc_feature 1..24: note = Synthetic Construct
  source 1..24: mol_type = other DNA
ccctggacctgtaagtgccttttc

SEQ ID NO: 13122 - DNA, 25 bp, synthetic construct
  misc_feature 1..25: note = Synthetic Construct
  source 1..25: mol_type = other DNA
gcggagatcctgtagaagaggacaa

SEQ ID NO: 13123 - DNA, 24 bp, synthetic construct
  misc_feature 1..24: note = Synthetic Construct
  source 1..24: mol_type = other DNA
ggccactttccatggagttagtca

SEQ ID NO: 13124 - DNA, 27 bp, synthetic construct
  misc_feature 1..27: note = Synthetic Construct
  source 1..27: mol_type = other DNA
ggcctggaatctaaaatcgcaatcaga

SEQ ID NO: 13125 - DNA, 22 bp, synthetic construct
  misc_feature 1..22: note = Synthetic Construct
  source 1..22: mol_type = other DNA
tacctccggaccttcccacagt

SEQ ID NO: 13126 - DNA, 21 bp, synthetic construct
  misc_feature 1..21: note = Synthetic Construct
  source 1..21: mol_type = other DNA
ttgccagacccgctgagtaca

SEQ ID NO: 13127 - DNA, 22 bp, synthetic construct
  misc_feature 1..22: note = Synthetic Construct
  source 1..22: mol_type = other DNA
ctctcacctcaaggccttcttc

SEQ ID NO: 13128 - DNA, 26 bp, synthetic construct
  misc_feature 1..26: note = Synthetic Construct
  source 1..26: mol_type = other DNA
cctctgatgggccagatggattttta

SEQ ID NO: 13129 - DNA, 26 bp, synthetic construct
  misc_feature 1..26: note = Synthetic Construct
  source 1..26: mol_type = other DNA
gttcaaatagtagtgcctggtgttac

SEQ ID NO: 13130 - DNA, 24 bp, synthetic construct
  misc_feature 1..24: note = Synthetic Construct
  source 1..24: mol_type = other DNA
gctccttccccacaagagagagaa

SEQ ID NO: 13131 - DNA, 24 bp, synthetic construct
  misc_feature 1..24: note = Synthetic Construct
  source 1..24: mol_type = other DNA
gcttttccgactccaaccatcact

SEQ ID NO: 13132 - DNA, 22 bp, synthetic construct
  misc_feature 1..22: note = Synthetic Construct
  source 1..22: mol_type = other DNA
gaaaaggtgaccacctgagcaa

SEQ ID NO: 13133 - DNA, 27 bp, synthetic construct
  misc_feature 1..27: note = Synthetic Construct
  source 1..27: mol_type = other DNA
ccttttctttagagcctccttcccaat

SEQ ID NO: 13134 - DNA, 21 bp, synthetic construct
  misc_feature 1..21: note = Synthetic Construct
  source 1..21: mol_type = other DNA
gcttgttcagcttgcatgtgt

SEQ ID NO: 13135 - DNA, 21 bp, synthetic construct
  misc_feature 1..21: note = Synthetic Construct
  source 1..21: mol_type = other DNA
aggcctggccctttattgttg

SEQ ID NO: 13136 - DNA, 25 bp, synthetic construct
  misc_feature 1..25: note = Synthetic Construct
  source 1..25: mol_type = other DNA
ctgactgatagcagtttgcctctct

SEQ ID NO: 13137 - DNA, 20 bp, synthetic construct
  misc_feature 1..20: note = Synthetic Construct
  source 1..20: mol_type = other DNA
acgcagctcagccctgatga

SEQ ID NO: 13138 - DNA, 26 bp, synthetic construct
  misc_feature 1..26: note = Synthetic Construct
  source 1..26: mol_type = other DNA
caaagggcatgtgtaatctgtaggta

SEQ ID NO: 13139 - DNA, 23 bp, synthetic construct
  misc_feature 1..23: note = Synthetic Construct
  source 1..23: mol_type = other DNA
tgagctggtgtaggattgactct

SEQ ID NO: 13140 - DNA, 22 bp, synthetic construct
  misc_feature 1..22: note = Synthetic Construct
  source 1..22: mol_type = other DNA
ccaacatgcaggccatatgtga

SEQ ID NO: 13141 - DNA, 21 bp, synthetic construct
  misc_feature 1..21: note = Synthetic Construct
  source 1..21: mol_type = other DNA
cactggtgcacttggggatga

SEQ ID NO: 13142 - DNA, 23 bp, synthetic construct
  misc_feature 1..23: note = Synthetic Construct
  source 1..23: mol_type = other DNA
gccaagatccacccatctcaaca

SEQ ID NO: 13143 - DNA, 25 bp, synthetic construct
  misc_feature 1..25: note = Synthetic Construct
  source 1..25: mol_type = other DNA
ccctagttccagcttcctattcatc

SEQ ID NO: 13144 - DNA, 23 bp, synthetic construct
  misc_feature 1..23: note = Synthetic Construct
  source 1..23: mol_type = other DNA
cctagaaatgggtggtacagcaa

SEQ ID NO: 13145 - DNA, 22 bp, synthetic construct
  misc_feature 1..22: note = Synthetic Construct
  source 1..22: mol_type = other DNA
acagagtggtgggagggtatca

SEQ ID NO: 13146 - DNA, 23 bp, synthetic construct
  misc_feature 1..23: note = Synthetic Construct
  source 1..23: mol_type = other DNA
ggcctggatttctggcagtgatt

SEQ ID NO: 13147 - DNA, 24 bp, synthetic construct
  misc_feature 1..24: note = Synthetic Construct
  source 1..24: mol_type = other DNA
cgcttccttaatgcccactttact

SEQ ID NO: 13148 - DNA, 20 bp, synthetic construct
  misc_feature 1..20: note = Synthetic Construct
  source 1..20: mol_type = other DNA
tgctggagcgtggtgacatc

SEQ ID NO: 13149 - DNA, 23 bp, synthetic construct
  misc_feature 1..23: note = Synthetic Construct
  source 1..23: mol_type = other DNA
gcagtgctacctatcgtctccaa

SEQ ID NO: 13150 - DNA, 22 bp, synthetic construct
  misc_feature 1..22: note = Synthetic Construct
  source 1..22: mol_type = other DNA
agctggtgagttggtctgtttg

SEQ ID NO: 13151 - DNA, 22 bp, synthetic construct
  misc_feature 1..22: note = Synthetic Construct
  source 1..22: mol_type = other DNA
gtccagagcaactgagggtttc

SEQ ID NO: 13152 - DNA, 22 bp, synthetic construct
  misc_feature 1..22: note = Synthetic Construct
  source 1..22: mol_type = other DNA
gtcaccacatggatgggtttca

SEQ ID NO: 13153 - DNA, 21 bp, synthetic construct
  misc_feature 1..21: note = Synthetic Construct
  source 1..21: mol_type = other DNA
cagggacaaggctggcaaaga

SEQ ID NO: 13154 - DNA, 20 bp, synthetic construct
  misc_feature 1..20: note = Synthetic Construct
  source 1..20: mol_type = other DNA
gtgacggaccatgagccaaa

SEQ ID NO: 13155 - DNA, 21 bp, synthetic construct
  misc_feature 1..21: note = Synthetic Construct
  source 1..21: mol_type = other DNA
ccctcgatggaggtggtcaga

SEQ ID NO: 13156 - DNA, 23 bp, synthetic construct
  misc_feature 1..23: note = Synthetic Construct
  source 1..23: mol_type = other DNA
cacccagatggatgagtctccta

SEQ ID NO: 13157 - DNA, 20 bp, synthetic construct
  misc_feature 1..20: note = Synthetic Construct
  source 1..20: mol_type = other DNA
gaacacactccgtggcagat

SEQ ID NO: 13158 - DNA, 22 bp, synthetic construct
  misc_feature 1..22: note = Synthetic Construct
  source 1..22: mol_type = other DNA
caggctgccaattagggaggta

SEQ ID NO: 13159 - DNA, 27 bp, synthetic construct
  misc_feature 1..27: note = Synthetic Construct
  source 1..27: mol_type = other DNA
ccctaaatatcagccactttgggctta

SEQ ID NO: 13160 - DNA, 18 bp, synthetic construct
  misc_feature 1..18: note = Synthetic Construct
  source 1..18: mol_type = other DNA
tctgccgggtgagcactt

SEQ ID NO: 13161 - DNA, 25 bp, synthetic construct
  misc_feature 1..25: note = Synthetic Construct
  source 1..25: mol_type = other DNA
gggaacttcttccctctgaatgtct

SEQ ID NO: 13162 - DNA, 24 bp, synthetic construct
  misc_feature 1..24: note = Synthetic Construct
  source 1..24: mol_type = other DNA
gagaggaaatgactcccacaagat

SEQ ID NO: 13163 - DNA, 25 bp, synthetic construct
  misc_feature 1..25: note = Synthetic Construct
  source 1..25: mol_type = other DNA
tgacagtgccttatgaagcaaagat

SEQ ID NO: 13164 - DNA, 21 bp, synthetic construct
  misc_feature 1..21: note = Synthetic Construct
  source 1..21: mol_type = other DNA
ctttgctcggtcagtgaggat

SEQ ID NO: 13165 - DNA, 19 bp, synthetic construct
  misc_feature 1..19: note = Synthetic Construct
  source 1..19: mol_type = other DNA
aaagtccggcccagtgatg

SEQ ID NO: 13166 - DNA, 25 bp, synthetic construct
  misc_feature 1..25: note = Synthetic Construct
  source 1..25: mol_type = other DNA
cgggtctctgtgcttaacgcaattc

SEQ ID NO: 13167 - DNA, 20 bp, synthetic construct
  misc_feature 1..20: note = Synthetic Construct
  source 1..20: mol_type = other DNA
cttcgcgccgttccaaacta

SEQ ID NO: 13168 - DNA, 25 bp, synthetic construct
  misc_feature 1..25: note = Synthetic Construct
  source 1..25: mol_type = other DNA
ctgagcaaatatcagtgagcaccta

SEQ ID NO: 13169 - DNA, 22 bp, synthetic construct
  misc_feature 1..22: note = Synthetic Construct
  source 1..22: mol_type = other DNA
tgacattttcccaccaggtgtt

SEQ ID NO: 13170 - DNA, 24 bp, synthetic construct
  misc_feature 1..24: note = Synthetic Construct
  source 1..24: mol_type = other DNA
ccagcagatcctgaaggagaggaa

SEQ ID NO: 13171 - DNA, 22 bp, synthetic construct
  misc_feature 1..22: note = Synthetic Construct
  source 1..22: mol_type = other DNA
gctcctgaagaggctgtgagat

SEQ ID NO: 13172 - DNA, 22 bp, synthetic construct
  misc_feature 1..22: note = Synthetic Construct
  source 1..22: mol_type = other DNA
cccatccttgttggcccatagt

SEQ ID NO: 13173 - DNA, 22 bp, synthetic construct
  misc_feature 1..22: note = Synthetic Construct
  source 1..22: mol_type = other DNA
gcaaagtcacggtcaagctcat

SEQ ID NO: 13174 - DNA, 20 bp, synthetic construct
  misc_feature 1..20: note = Synthetic Construct
  source 1..20: mol_type = other DNA
tcctccagtcccgagagcta

SEQ ID NO: 13175 - DNA, 20 bp, synthetic construct
  misc_feature 1..20: note = Synthetic Construct
  source 1..20: mol_type = other DNA
cctggggtagaggccaaatg

SEQ ID NO: 13176 - DNA, 23 bp, synthetic construct
  misc_feature 1..23: note = Synthetic Construct
  source 1..23: mol_type = other DNA
gtggacagattcctcactgttct

SEQ ID NO: 13177 - DNA, 21 bp, synthetic construct
  misc_feature 1..21: note = Synthetic Construct
  source 1..21: mol_type = other DNA
aggggaggcaagcagaggaaa

SEQ ID NO: 13178 - DNA, 24 bp, synthetic construct
  misc_feature 1..24: note = Synthetic Construct
  source 1..24: mol_type = other DNA
tgccatagttctcggcttactttc

SEQ ID NO: 13179 - DNA, 24 bp, synthetic construct
  misc_feature 1..24: note = Synthetic Construct
  source 1..24: mol_type = other DNA
cacagactcgtcttgataggtgat

SEQ ID NO: 13180 - DNA, 22 bp, synthetic construct
  misc_feature 1..22: note = Synthetic Construct
  source 1..22: mol_type = other DNA
cggtatcgctgaaggctcttgt

SEQ ID NO: 13181 - DNA, 22 bp, synthetic construct
  misc_feature 1..22: note = Synthetic Construct
  source 1..22: mol_type = other DNA
ccttagtgctggtgctcgtttg

SEQ ID NO: 13182 - DNA, 22 bp, synthetic construct
  misc_feature 1..22: note = Synthetic Construct
  source 1..22: mol_type = other DNA
gcaggttcctgggatgagaaag

SEQ ID NO: 13183 - DNA, 23 bp, synthetic construct
  misc_feature 1..23: note = Synthetic Construct
  source 1..23: mol_type = other DNA
gggctgactcacaaaaccatcta

SEQ ID NO: 13184 - DNA, 24 bp, synthetic construct
  misc_feature 1..24: note = Synthetic Construct
  source 1..24: mol_type = other DNA
ccaccctactgtcccctctagttt

SEQ ID NO: 13185 - DNA, 23 bp, synthetic construct
  misc_feature 1..23: note = Synthetic Construct
  source 1..23: mol_type = other DNA
tgattgtgagccaagaactggat

SEQ ID NO: 13186 - DNA, 25 bp, synthetic construct
  misc_feature 1..25: note = Synthetic Construct
  source 1..25: mol_type = other DNA
ggcagctgttaaactgcctctctaa

SEQ ID NO: 13187 - DNA, 20 bp, synthetic construct
  misc_feature 1..20: note = Synthetic Construct
  source 1..20: mol_type = other DNA
tcccaggccgtgaaggtaag

SEQ ID NO: 13188 - DNA, 26 bp, synthetic construct
  misc_feature 1..26: note = Synthetic Construct
  source 1..26: mol_type = other DNA
gtggtggggatgaattgagaaaacat

SEQ ID NO: 13189 - DNA, 25 bp, synthetic construct
  misc_feature 1..25: note = Synthetic Construct
  source 1..25: mol_type = other DNA
gctgagtccaggatctttgagcaat

SEQ ID NO: 13190 - DNA, 21 bp, synthetic construct
  misc_feature 1..21: note = Synthetic Construct
  source 1..21: mol_type = other DNA
actcacctgccctctgtctgt

SEQ ID NO: 13191 - DNA, 19 bp, synthetic construct
  misc_feature 1..19: note = Synthetic Construct
  source 1..19: mol_type = other DNA
tgagctgcagccaccatgt

SEQ ID NO: 13192 - DNA, 25 bp, synthetic construct
  misc_feature 1..25: note = Synthetic Construct
  source 1..25: mol_type = other DNA
tggatgagaaagtggagcttcatag

SEQ ID NO: 13193 - DNA, 22 bp, synthetic construct
  misc_feature 1..22: note = Synthetic Construct
  source 1..22: mol_type = other DNA
ctgggtttgcatttccgcctta

SEQ ID NO: 13194 - DNA, 28 bp, synthetic construct
  misc_feature 1..28: note = Synthetic Construct
  source 1..28: mol_type = other DNA
gtgcagactctaatacaagtgaggttct

SEQ ID NO: 13195 - DNA, 22 bp, synthetic construct
  misc_feature 1..22: note = Synthetic Construct
  source 1..22: mol_type = other DNA
tgtgctgctttacactctgctt

SEQ ID NO: 13196 - DNA, 24 bp, synthetic construct
  misc_feature 1..24: note = Synthetic Construct
  source 1..24: mol_type = other DNA
ttcaagagaggtcgctttgttttg

SEQ ID NO: 13197 - DNA, 21 bp, synthetic construct
  misc_feature 1..21: note = Synthetic Construct
  source 1..21: mol_type = other DNA
cccaccaccacacctttcaca

SEQ ID NO: 13198 - DNA, 20 bp, synthetic construct
  misc_feature 1..20: note = Synthetic Construct
  source 1..20: mol_type = other DNA
ggcggcagaattccatgttg

SEQ ID NO: 13199 - DNA, 22 bp, synthetic construct
  misc_feature 1..22: note = Synthetic Construct
  source 1..22: mol_type = other DNA
ggagatccagcatgtggtgaca

SEQ ID NO: 13200 - DNA, 23 bp, synthetic construct
  misc_feature 1..23: note = Synthetic Construct
  source 1..23: mol_type = other DNA
cactgtatttgcagcaggtggtt

SEQ ID NO: 13201 - DNA, 24 bp, synthetic construct
  misc_feature 1..24: note = Synthetic Construct
  source 1..24: mol_type = other DNA
gacagttctcagcatggggatttg

SEQ ID NO: 13202 - DNA, 23 bp, synthetic construct
  misc_feature 1..23: note = Synthetic Construct
  source 1..23: mol_type = other DNA
cggtgcgactaaagggtagtttg

SEQ ID NO: 13203 - DNA, 24 bp, synthetic construct
  misc_feature 1..24: note = Synthetic Construct
  source 1..24: mol_type = other DNA
cagtgggcctagaaacttccactt

SEQ ID NO: 13204 - DNA, 21 bp, synthetic construct
  misc_feature 1..21: note = Synthetic Construct
  source 1..21: mol_type = other DNA
actccacagacaggaggacat

SEQ ID NO: 13205 - DNA, 22 bp, synthetic construct
  misc_feature 1..22: note = Synthetic Construct
  source 1..22: mol_type = other DNA
tctccctcacacactgtgacat

SEQ ID NO: 13206 - DNA, 21 bp, synthetic construct
  misc_feature 1..21: note = Synthetic Construct
  source 1..21: mol_type = other DNA
ggagggtacaggcatgccaaa

SEQ ID NO: 13207 - DNA, 22 bp, synthetic construct
  misc_feature 1..22: note = Synthetic Construct
  source 1..22: mol_type = other DNA
acagggagcccactgtcatttg

SEQ ID NO: 13208 - DNA, 26 bp, synthetic construct
  misc_feature 1..26: note = Synthetic Construct
  source 1..26: mol_type = other DNA
ggcagatgcttccagacaaaagaaaa

SEQ ID NO: 13209 - DNA, 27 bp, synthetic construct
  misc_feature 1..27: note = Synthetic Construct
  source 1..27: mol_type = other DNA
gctaaacctggaatataacgtctgtct

SEQ ID NO: 13210 - DNA, 23 bp, synthetic construct
  misc_feature 1..23: note = Synthetic Construct
  source 1..23: mol_type = other DNA
acttttgattcctgggtcccaat

SEQ ID NO: 13211 - DNA, 21 bp, synthetic construct
  misc_feature 1..21: note = Synthetic Construct
  source 1..21: mol_type = other DNA
ggtctttgttcgccactgtct

SEQ ID NO: 13212 - DNA, 24 bp, synthetic construct
  misc_feature 1..24: note = Synthetic Construct
  source 1..24: mol_type = other DNA
cggctttccatgctgaagtcagtt

SEQ ID NO: 13213 - DNA, 24 bp, synthetic construct
  misc_feature 1..24: note = Synthetic Construct
  source 1..24: mol_type = other DNA
gcatcaacggaaccagtgcatttt

SEQ ID NO: 13214 - DNA, 21 bp, synthetic construct
  misc_feature 1..21: note = Synthetic Construct
  source 1..21: mol_type = other DNA
cccctgttgggcataaagcaa

SEQ ID NO: 13215 - DNA, 20 bp, synthetic construct
  misc_feature 1..20: note = Synthetic Construct
  source 1..20: mol_type = other DNA
agtggcaggctgctctcata

SEQ ID NO: 13216 - DNA, 24 bp, synthetic construct
  misc_feature 1..24: note = Synthetic Construct
  source 1..24: mol_type = other DNA
gtggtgctttagggaaatccaatc

SEQ ID NO: 13217 - DNA, 28 bp, synthetic construct
  misc_feature 1..28: note = Synthetic Construct
  source 1..28: mol_type = other DNA
gtgcctcctataatgataatggctcact

SEQ ID NO: 13218 - DNA, 25 bp, synthetic construct
  misc_feature 1..25: note = Synthetic Construct
  source 1..25: mol_type = other DNA
caggagtgtgtgtatccaaggctat

SEQ ID NO: 13219 - DNA, 22 bp, synthetic construct
  misc_feature 1..22: note = Synthetic Construct
  source 1..22: mol_type = other DNA
ggcaaggtctacccaggatcaa

SEQ ID NO: 13220 - DNA, 22 bp, synthetic construct
  misc_feature 1..22: note = Synthetic Construct
  source 1..22: mol_type = other DNA
tgcctgagaggatctggtgaca

SEQ ID NO: 13221 - DNA, 24 bp, synthetic construct
  misc_feature 1..24: note = Synthetic Construct
  source 1..24: mol_type = other DNA
gcagacaaaagtagcaactggaaa

SEQ ID NO: 13222 - DNA, 20 bp, synthetic construct
  misc_feature 1..20: note = Synthetic Construct
  source 1..20: mol_type = other DNA
ggttcagggacacaggcttt

SEQ ID NO: 13223 - DNA, 21 bp, synthetic construct
  misc_feature 1..21: note = Synthetic Construct
  source 1..21: mol_type = other DNA
gcaagctcaaaccccagaagt

SEQ ID NO: 13224 - DNA, 22 bp, synthetic construct
  misc_feature 1..22: note = Synthetic Construct
  source 1..22: mol_type = other DNA
ggtgcccaggtctcatgaatgt

SEQ ID NO: 13225 - DNA, 22 bp, synthetic construct
  misc_feature 1..22: note = Synthetic Construct
  source 1..22: mol_type = other DNA
ggaaatcagccaccctcagcaa

SEQ ID NO: 13226 - DNA, 27 bp, synthetic construct
  misc_feature 1..27: note = Synthetic Construct
  source 1..27: mol_type = other DNA
ggtactgtaggtggttttatgagtcaa

SEQ ID NO: 13227 - DNA, 22 bp, synthetic construct
  misc_feature 1..22: note = Synthetic Construct
  source 1..22: mol_type = other DNA
ccagcatggtgggtttctgttg

SEQ ID NO: 13228 - DNA, 23 bp, synthetic construct
  misc_feature 1..23: note = Synthetic Construct
  source 1..23: mol_type = other DNA
actccaggatgcacaatttgtct

SEQ ID NO: 13229 - DNA, 22 bp, synthetic construct
  misc_feature 1..22: note = Synthetic Construct
  source 1..22: mol_type = other DNA
gcactccagcttcactgacaag

SEQ ID NO: 13230 - DNA, 25 bp, synthetic construct
  misc_feature 1..25: note = Synthetic Construct
  source 1..25: mol_type = other DNA
gaaggagattttcctcccattgcta

SEQ ID NO: 13231 - DNA, 25 bp, synthetic construct
  misc_feature 1..25: note = Synthetic Construct
  source 1..25: mol_type = other DNA
gccagactatcgctgatgtttcctt

SEQ ID NO: 13232 - DNA, 20 bp, synthetic construct
  misc_feature 1..20: note = Synthetic Construct
  source 1..20: mol_type = other DNA
tgaacagccccagagtctca

SEQ ID NO: 13233 - DNA, 25 bp, synthetic construct
  misc_feature 1..25: note = Synthetic Construct
  source 1..25: mol_type = other DNA
gctgctgaagtgagtatctctgttg

SEQ ID NO: 13234 - DNA, 23 bp, synthetic construct
  misc_feature 1..23: note = Synthetic Construct
  source 1..23: mol_type = other DNA
gctgacccatacttgggtaggaa

SEQ ID NO: 13235 - DNA, 21 bp, synthetic construct
  misc_feature 1..21: note = Synthetic Construct
  source 1..21: mol_type = other DNA
gccaatgcaaagaccctgaag

SEQ ID NO: 13236 - DNA, 24 bp, synthetic construct
  misc_feature 1..24: note = Synthetic Construct
  source 1..24: mol_type = other DNA
cactctgcgcttatgcttacactt

SEQ ID NO: 13237 - DNA, 28 bp, synthetic construct
  misc_feature 1..28: note = Synthetic Construct
  source 1..28: mol_type = other DNA
gcctgttactgtatgtgacaaggatagt

SEQ ID NO: 13238 - DNA, 22 bp, synthetic construct
  misc_feature 1..22: note = Synthetic Construct
  source 1..22: mol_type = other DNA
gtgctgtgcattctgcggtttg

SEQ ID NO: 13239 - DNA, 23 bp, synthetic construct
  misc_feature 1..23: note = Synthetic Construct
  source 1..23: mol_type = other DNA
ccctgacaggttctccttcattc

SEQ ID NO: 13240 - DNA, 22 bp, synthetic construct
  misc_feature 1..22: note = Synthetic Construct
  source 1..22: mol_type = other DNA
agtgtgggaagggaagtggata

SEQ ID NO: 13241 - DNA, 26 bp, synthetic construct
  misc_feature 1..26: note = Synthetic Construct
  source 1..26: mol_type = other DNA
gggagtctaggattgtggagttcagt

SEQ ID NO: 13242 - DNA, 21 bp, synthetic construct
  misc_feature 1..21: note = Synthetic Construct
  source 1..21: mol_type = other DNA
aggcttttctccctgggttga

SEQ ID NO: 13243 - DNA, 21 bp, synthetic construct
  misc_feature 1..21: note = Synthetic Construct
  source 1..21: mol_type = other DNA
tggtggcacccaaaggcattc

SEQ ID NO: 13244 - DNA, 25 bp, synthetic construct
  misc_feature 1..25: note = Synthetic Construct
  source 1..25: mol_type = other DNA
gatggcttggacatgaaggatggta

SEQ ID NO: 13245 - DNA, 22 bp, synthetic construct
  misc_feature 1..22: note = Synthetic Construct
  source 1..22: mol_type = other DNA
cccaaaatgcaacacaccatga

SEQ ID NO: 13246 - DNA, 24 bp, synthetic construct
  misc_feature 1..24: note = Synthetic Construct
  source 1..24: mol_type = other DNA
gtgttggcctaagttcccgagttc

SEQ ID NO: 13247 - DNA, 22 bp, synthetic construct
  misc_feature 1..22: note = Synthetic Construct
  source 1..22: mol_type = other DNA
gggaagctgacttcacatccat

SEQ ID NO: 13248 - DNA, 21 bp, synthetic construct
  misc_feature 1..21: note = Synthetic Construct
  source 1..21: mol_type = other DNA
tttggtcccaggctcctccta

SEQ ID NO: 13249 - DNA, 19 bp, synthetic construct
  misc_feature 1..19: note = Synthetic Construct
  source 1..19: mol_type = other DNA
ctctcacgcccagcactct

SEQ ID NO: 13250 - DNA, 25 bp, synthetic construct
  misc_feature 1..25: note = Synthetic Construct
  source 1..25: mol_type = other DNA
cgtggcaacaattccctctatctca

SEQ ID NO: 13251 - DNA, 25 bp, synthetic construct
  misc_feature 1..25: note = Synthetic Construct
  source 1..25: mol_type = other DNA
ggcagtggtacaatcatagctccat

SEQ ID NO: 13252 - DNA, 22 bp, synthetic construct
  misc_feature 1..22: note = Synthetic Construct
  source 1..22: mol_type = other DNA
gatcccttaggctgtgcgaaag

SEQ ID NO: 13253 - DNA, 25 bp, synthetic construct
  misc_feature 1..25: note = Synthetic Construct
  source 1..25: mol_type = other DNA
cactgttttctagtcccagttctgt

SEQ ID NO: 13254 - DNA, 19 bp, synthetic construct
  misc_feature 1..19: note = Synthetic Construct
  source 1..19: mol_type = other DNA
gcgcagtacctcgggcata

SEQ ID NO: 13255 - DNA, 25 bp, synthetic construct
  misc_feature 1..25: note = Synthetic Construct
  source 1..25: mol_type = other DNA
cctgtggattctggctgaggatttg

SEQ ID NO: 13256 - DNA, 23 bp, synthetic construct
  misc_feature 1..23: note = Synthetic Construct
  source 1..23: mol_type = other DNA
gggctccacacattccaccttag

SEQ ID NO: 13257 - DNA, 25 bp, synthetic construct
  misc_feature 1..25: note = Synthetic Construct
  source 1..25: mol_type = other DNA
gtcaagaaactgactgtcactccta

SEQ ID NO: 13258 - DNA, 24 bp, synthetic construct
  misc_feature 1..24: note = Synthetic Construct
  source 1..24: mol_type = other DNA
ctgaatcaccatcacacgaaccat

SEQ ID NO: 13259 - DNA, 23 bp, synthetic construct
  misc_feature 1..23: note = Synthetic Construct
  source 1..23: mol_type = other DNA
cgctgtgtatcaggcataccata

SEQ ID NO: 13260 - DNA, 26 bp, synthetic construct
  misc_feature 1..26: note = Synthetic Construct
  source 1..26: mol_type = other DNA
agagggaaagactctgaaatctgaac

SEQ ID NO: 13261 - DNA, 23 bp, synthetic construct
  misc_feature 1..23: note = Synthetic Construct
  source 1..23: mol_type = other DNA
ccagcgtgtttcaaaggcaaatg

SEQ ID NO: 13262 - DNA, 21 bp, synthetic construct
  misc_feature 1..21: note = Synthetic Construct
  source 1..21: mol_type = other DNA
agggcctagaggacgatgctt

SEQ ID NO: 13263 - DNA, 24 bp, synthetic construct
  misc_feature 1..24: note = Synthetic Construct
  source 1..24: mol_type = other DNA
cctcctgccatgtggttagagagt

SEQ ID NO: 13264 - DNA, 27 bp, synthetic construct
  misc_feature 1..27: note = Synthetic Construct
  source 1..27: mol_type = other DNA
ggattagttactgtgagagtgggttgt

SEQ ID NO: 13265 - DNA, 26 bp, synthetic construct
  misc_feature 1..26: note = Synthetic Construct
  source 1..26: mol_type = other DNA
gcaagacatttggtagccttttcaga

SEQ ID NO: 13266 - DNA, 25 bp, synthetic construct
  misc_feature 1..25: note = Synthetic Construct
  source 1..25: mol_type = other DNA
tcccaatgtaatttgaggcagaaca

SEQ ID NO: 13267 - DNA, 23 bp, synthetic construct
  misc_feature 1..23: note = Synthetic Construct
  source 1..23: mol_type = other DNA
ggggtgaaaacaacaaccactac

SEQ ID NO: 13268 - DNA, 23 bp, synthetic construct
  misc_feature 1..23: note = Synthetic Construct
  source 1..23: mol_type = other DNA
ggaacttcgggaggatgtaggta

SEQ ID NO: 13269 - DNA, 22 bp, synthetic construct
  misc_feature 1..22: note = Synthetic Construct
  source 1..22: mol_type = other DNA
cgcacaaaagacctggcacaga

SEQ ID NO: 13270 - DNA, 25 bp, synthetic construct
  misc_feature 1..25: note = Synthetic Construct
  source 1..25: mol_type = other DNA
cccagtctgctcctttggaatcttg

SEQ ID NO: 13271 - DNA, 24 bp, synthetic construct
  misc_feature 1..24: note = Synthetic Construct
  source 1..24: mol_type = other DNA
ttccaagtgtaaggctgaagaagt

SEQ ID NO: 13272 - DNA, 23 bp, synthetic construct
  misc_feature 1..23: note = Synthetic Construct
  source 1..23: mol_type = other DNA
ggctggagaaagtagtccacaga

SEQ ID NO: 13273 - DNA, 21 bp, synthetic construct
  misc_feature 1..21: note = Synthetic Construct
  source 1..21: mol_type = other DNA
gtggaccacgtgcagaagtca

SEQ ID NO: 13274 - DNA, 22 bp, synthetic construct
  misc_feature 1..22: note = Synthetic Construct
  source 1..22: mol_type = other DNA
gcatggtaggacagtggacgaa

SEQ ID NO: 13275 - DNA, 20 bp, synthetic construct
  misc_feature 1..20: note = Synthetic Construct
  source 1..20: mol_type = other DNA
gggatgcagaggctgtttca

SEQ ID NO: 13276 - DNA, 22 bp, synthetic construct
  misc_feature 1..22: note = Synthetic Construct
  source 1..22: mol_type = other DNA
cccatgcctaccaagagctagt

SEQ ID NO: 13277 - DNA, 24 bp, synthetic construct
  misc_feature 1..24: note = Synthetic Construct
  source 1..24: mol_type = other DNA
agggctctgaccttgaagaatttg

SEQ ID NO: 13278 - DNA, 24 bp, synthetic construct
  misc_feature 1..24: note = Synthetic Construct
  source 1..24: mol_type = other DNA
ttctccatcaaactcgggatgaat

SEQ ID NO: 13279 - DNA, 25 bp, synthetic construct
  misc_feature 1..25: note = Synthetic Construct
  source 1..25: mol_type = other DNA
ccttctaccaggttggacaaagtct

SEQ ID NO: 13280 - DNA, 25 bp, synthetic construct
  misc_feature 1..25: note = Synthetic Construct
  source 1..25: mol_type = other DNA
caggaatcctcagataggaggtaga

SEQ ID NO: 13281 - DNA, 22 bp, synthetic construct
  misc_feature 1..22: note = Synthetic Construct
  source 1..22: mol_type = other DNA
accaggacgaaccttcccattc

SEQ ID NO: 13282 - DNA, 26 bp, synthetic construct
  misc_feature 1..26: note = Synthetic Construct
  source 1..26: mol_type = other DNA
ctggactctgggacttctttttgagt

SEQ ID NO: 13283 - DNA, 25 bp, synthetic construct
  misc_feature 1..25: note = Synthetic Construct
  source 1..25: mol_type = other DNA
accaacttatacgagcttcttggat

SEQ ID NO: 13284 - DNA, 20 bp, synthetic construct
  misc_feature 1..20: note = Synthetic Construct
  source 1..20: mol_type = other DNA
agcttcaggtcgccccacta

SEQ ID NO: 13285 - DNA, 25 bp, synthetic construct
  misc_feature 1..25: note = Synthetic Construct
  source 1..25: mol_type = other DNA
tgtacagatacttggtggaagcaat

SEQ ID NO: 13286 - DNA, 23 bp, synthetic construct
  misc_feature 1..23: note = Synthetic Construct
  source 1..23: mol_type = other DNA
agtgatgcaattgaaggcactga

SEQ ID NO: 13287 - DNA, 20 bp, synthetic construct
  misc_feature 1..20: note = Synthetic Construct
  source 1..20: mol_type = other DNA
agacgtgtgccctgttcatc

SEQ ID NO: 13288 - DNA, 22 bp, synthetic construct
  misc_feature 1..22: note = Synthetic Construct
  source 1..22: mol_type = other DNA
actggaccagcaccttctcttc

SEQ ID NO: 13289 - DNA, 22 bp, synthetic construct
  misc_feature 1..22: note = Synthetic Construct
  source 1..22: mol_type = other DNA
gagattggcccagtcctgtttg

SEQ ID NO: 13290 - DNA, 20 bp, synthetic construct
  misc_feature 1..20: note = Synthetic Construct
  source 1..20: mol_type = other DNA
agcagcagtaccacgtctga

SEQ ID NO: 13291 - DNA, 23 bp, synthetic construct
  misc_feature 1..23: note = Synthetic Construct
  source 1..23: mol_type = other DNA
tggtgctgtttcaggactaggat

SEQ ID NO: 13292 - DNA, 18 bp, synthetic construct
  misc_feature 1..18: note = Synthetic Construct
  source 1..18: mol_type = other DNA
tgcaggcacgtgacgaat

SEQ ID NO: 13293 - DNA, 24 bp, synthetic construct
  misc_feature 1..24: note = Synthetic Construct
  source 1..24: mol_type = other DNA
cctgggaaggatcggcattatttg

SEQ ID NO: 13294 - DNA, 21 bp, synthetic construct
  misc_feature 1..21: note = Synthetic Construct
  source 1..21: mol_type = other DNA
gctttcagcagcgtcccagat

SEQ ID NO: 13295 - DNA, 24 bp, synthetic construct
  misc_feature 1..24: note = Synthetic Construct
  source 1..24: mol_type = other DNA
aggtcgtgcttttagtagcaatgt

SEQ ID NO: 13296 - DNA, 22 bp, synthetic construct
  misc_feature 1..22: note = Synthetic Construct
  source 1..22: mol_type = other DNA
gcttcgcacttgaatcctgact

SEQ ID NO: 13297 - DNA, 21 bp, synthetic construct
  misc_feature 1..21: note = Synthetic Construct
  source 1..21: mol_type = other DNA
gggacaggcttcctgtgaact

SEQ ID NO: 13298 - DNA, 26 bp, synthetic construct
  misc_feature 1..26: note = Synthetic Construct
  source 1..26: mol_type = other DNA
gtcatccaagctcaaaatccaagaga

SEQ ID NO: 13299 - DNA, 20 bp, synthetic construct
  misc_feature 1..20: note = Synthetic Construct
  source 1..20: mol_type = other DNA
cccacttcccgtgtttctca

SEQ ID NO: 13300 - DNA, 20 bp, synthetic construct
  misc_feature 1..20: note = Synthetic Construct
  source 1..20: mol_type = other DNA
ctcagcctgctagggagtga

SEQ ID NO: 13301 - DNA, 25 bp, synthetic construct
  misc_feature 1..25: note = Synthetic Construct
  source 1..25: mol_type = other DNA
cctctctgtgtgggctagaatgctt

SEQ ID NO: 13302 - DNA, 27 bp, synthetic construct
  misc_feature 1..27: note = Synthetic Construct
  source 1..27: mol_type = other DNA
gcacctggtgttttacagtttgacaat

SEQ ID NO: 13303 - DNA, 24 bp, synthetic construct
  misc_feature 1..24: note = Synthetic Construct
  source 1..24: mol_type = other DNA
gcacagtgggtgagagagaagcat

SEQ ID NO: 13304 - DNA, 23 bp, synthetic construct
  misc_feature 1..23: note = Synthetic Construct
  source 1..23: mol_type = other DNA
gttgtccattgcccctttactga

SEQ ID NO: 13305 - DNA, 20 bp, synthetic construct
  misc_feature 1..20: note = Synthetic Construct
  source 1..20: mol_type = other DNA
tggtggtgccactcttggaa

SEQ ID NO: 13306 - DNA, 25 bp, synthetic construct
  misc_feature 1..25: note = Synthetic Construct
  source 1..25: mol_type = other DNA
ctgcatagctttgcttcacttcttc

SEQ ID NO: 13307 - DNA, 22 bp, synthetic construct
  misc_feature 1..22: note = Synthetic Construct
  source 1..22: mol_type = other DNA
gtgagagctgctagaggctgat

SEQ ID NO: 13308 - DNA, 22 bp, synthetic construct
  misc_feature 1..22: note = Synthetic Construct
  source 1..22: mol_type = other DNA
atcttaggcctagggagcaagt

SEQ ID NO: 13309 - DNA, 26 bp, synthetic construct
  misc_feature 1..26: note = Synthetic Construct
  source 1..26: mol_type = other DNA
gctagaaggtgatgctacaggacgaa

SEQ ID NO: 13310 - DNA, 24 bp, synthetic construct
  misc_feature 1..24: note = Synthetic Construct
  source 1..24: mol_type = other DNA
ctttgaagtctctgcacctcagtt

SEQ ID NO: 13311 - DNA, 21 bp, synthetic construct
  misc_feature 1..21: note = Synthetic Construct
  source 1..21: mol_type = other DNA
tgatgcctgctcgagacattg

SEQ ID NO: 13312 - DNA, 19 bp, synthetic construct
  misc_feature 1..19: note = Synthetic Construct
  source 1..19: mol_type = other DNA
tgtcggccgagcccatttt

SEQ ID NO: 13313 - DNA, 22 bp, synthetic construct
  misc_feature 1..22: note = Synthetic Construct
  source 1..22: mol_type = other DNA
tccctgcaaaggggtcaaggta

SEQ ID NO: 13314 - DNA, 26 bp, synthetic construct
  misc_feature 1..26: note = Synthetic Construct
  source 1..26: mol_type = other DNA
ccctaatcacagcaaatctgctcctt

SEQ ID NO: 13315 - DNA, 22 bp, synthetic construct
  misc_feature 1..22: note = Synthetic Construct
  source 1..22: mol_type = other DNA
gcttgcgggatgtatcttcctt

SEQ ID NO: 13316 - DNA, 23 bp, synthetic construct
  misc_feature 1..23: note = Synthetic Construct
  source 1..23: mol_type = other DNA
ggtgaggctcagccgtctatact

SEQ ID NO: 13317 - DNA, 20 bp, synthetic construct
  misc_feature 1..20: note = Synthetic Construct
  source 1..20: mol_type = other DNA
ctgccacttgctctgtctca

SEQ ID NO: 13318 - DNA, 24 bp, synthetic construct
  misc_feature 1..24: note = Synthetic Construct
  source 1..24: mol_type = other DNA
gcttggctcaaacatcacctccta

SEQ ID NO: 13319 - DNA, 20 bp, synthetic construct
  misc_feature 1..20: note = Synthetic Construct
  source 1..20: mol_type = other DNA
acaggcctaccaaccacaga

SEQ ID NO: 13320 - DNA, 20 bp, synthetic construct
  misc_feature 1..20: note = Synthetic Construct
  source 1..20: mol_type = other DNA
tcaggtggactgcgagtctt

SEQ ID NO: 13321 - DNA, 27 bp, synthetic construct
  misc_feature 1..27: note = Synthetic Construct
  source 1..27: mol_type = other DNA
ggtaaggtatccatccttatggagttt

SEQ ID NO: 13322 - DNA, 22 bp, synthetic construct
  misc_feature 1..22: note = Synthetic Construct
  source 1..22: mol_type = other DNA
cctgccctaacctccgtttaca

SEQ ID NO: 13323 - DNA, 20 bp, synthetic construct
  misc_feature 1..20: note = Synthetic Construct
  source 1..20: mol_type = other DNA
tgccctctgggctccccttt

SEQ ID NO: 13324 - DNA, 26 bp, synthetic construct
  misc_feature 1..26: note = Synthetic Construct
  source 1..26: mol_type = other DNA
gcatgcttattcaagcgagagatgat

SEQ ID NO: 13325 - DNA, 23 bp, synthetic construct
  misc_feature 1..23: note = Synthetic Construct
  source 1..23: mol_type = other DNA
gtaagccagggaagagtggaaag

SEQ ID NO: 13326 - DNA, 25 bp, synthetic construct
  misc_feature 1..25: note = Synthetic Construct
  source 1..25: mol_type = other DNA
gacagagttgatgtgggattacctt

SEQ ID NO: 13327 - DNA, 24 bp, synthetic construct
  misc_feature 1..24: note = Synthetic Construct
  source 1..24: mol_type = other DNA
caggcctccccttaaaatgtcatc

SEQ ID NO: 13328 - DNA, 20 bp, synthetic construct
  misc_feature 1..20: note = Synthetic Construct
  source 1..20: mol_type = other DNA
agggctgtgctgatggaaca

SEQ ID NO: 13329 - DNA, 26 bp, synthetic construct
  misc_feature 1..26: note = Synthetic Construct
  source 1..26: mol_type = other DNA
ctccaactgttgctgaatatgtctac

SEQ ID NO: 13330 - DNA, 27 bp, synthetic construct
  misc_feature 1..27: note = Synthetic Construct
  source 1..27: mol_type = other DNA
gacaacacagttccctttccattttca

SEQ ID NO: 13331 - DNA, 22 bp, synthetic construct
  misc_feature 1..22: note = Synthetic Construct
  source 1..22: mol_type = other DNA
gtggacctctcagggctacatc

SEQ ID NO: 13332 - DNA, 20 bp, synthetic construct
  misc_feature 1..20: note = Synthetic Construct
  source 1..20: mol_type = other DNA
agtcgatgggtggtggaaga

SEQ ID NO: 13333 - DNA, 26 bp, synthetic construct
  misc_feature 1..26: note = Synthetic Construct
  source 1..26: mol_type = other DNA
tccaggaaagtcaattcatggagtag

SEQ ID NO: 13334 - DNA, 21 bp, synthetic construct
  misc_feature 1..21: note = Synthetic Construct
  source 1..21: mol_type = other DNA
gggccaggtaaggagcagtag

SEQ ID NO: 13335 - DNA, 22 bp, synthetic construct
  misc_feature 1..22: note = Synthetic Construct
  source 1..22: mol_type = other DNA
ctgtgaatgcaggtccttgttg

SEQ ID NO: 13336 - DNA, 26 bp, synthetic construct
  misc_feature 1..26: note = Synthetic Construct
  source 1..26: mol_type = other DNA
ctcaacattgcatgctacaacctgaa

SEQ ID NO: 13337 - DNA, 27 bp, synthetic construct
  misc_feature 1..27: note = Synthetic Construct
  source 1..27: mol_type = other DNA
ctcacagagctatcaaggtcattcaca

SEQ ID NO: 13338 - DNA, 23 bp, synthetic construct
  misc_feature 1..23: note = Synthetic Construct
  source 1..23: mol_type = other DNA
ggcagaggagtgacataagttga

SEQ ID NO: 13339 - DNA, 21 bp, synthetic construct
  misc_feature 1..21: note = Synthetic Construct
  source 1..21: mol_type = other DNA
acctgcggttcgtttaacaca

SEQ ID NO: 13340 - DNA, 24 bp, synthetic construct
  misc_feature 1..24: note = Synthetic Construct
  source 1..24: mol_type = other DNA
ctggagagccaccaataccctaga

SEQ ID NO: 13341 - DNA, 20 bp, synthetic construct
  misc_feature 1..20: note = Synthetic Construct
  source 1..20: mol_type = other DNA
ggcctggagatggacagctt

SEQ ID NO: 13342 - DNA, 22 bp, synthetic construct
  misc_feature 1..22: note = Synthetic Construct
  source 1..22: mol_type = other DNA
accccgtcttggttcttacctt

SEQ ID NO: 13343 - DNA, 23 bp, synthetic construct
  misc_feature 1..23: note = Synthetic Construct
  source 1..23: mol_type = other DNA
ctcggatttccatccagcgttga

SEQ ID NO: 13344 - DNA, 21 bp, synthetic construct
  misc_feature 1..21: note = Synthetic Construct
  source 1..21: mol_type = other DNA
ggctcacagcagcttcagtct

SEQ ID NO: 13345 - DNA, 24 bp, synthetic construct
  misc_feature 1..24: note = Synthetic Construct
  source 1..24: mol_type = other DNA
cccgtcccaccctttgtttagaag

SEQ ID NO: 13346 - DNA, 23 bp, synthetic construct
  misc_feature 1..23: note = Synthetic Construct
  source 1..23: mol_type = other DNA
cccgcatggctacagagttaata

SEQ ID NO: 13347 - DNA, 23 bp, synthetic construct
  misc_feature 1..23: note = Synthetic Construct
  source 1..23: mol_type = other DNA
tgccttgttgaacttaggccatt

SEQ ID NO: 13348 - DNA, 21 bp, synthetic construct
  misc_feature 1..21: note = Synthetic Construct
  source 1..21: mol_type = other DNA
gggctggcagacaggaaaaca

SEQ ID NO: 13349 - DNA, 24 bp, synthetic construct
  misc_feature 1..24: note = Synthetic Construct
  source 1..24: mol_type = other DNA
ccagttccagagtccctcgttttc

SEQ ID NO: 13350 - DNA, 24 bp, synthetic construct
  misc_feature 1..24: note = Synthetic Construct
  source 1..24: mol_type = other DNA
gactcggtgcattcactgtttatc

SEQ ID NO: 13351 - DNA, 27 bp, synthetic construct
  misc_feature 1..27: note = Synthetic Construct
  source 1..27: mol_type = other DNA
gtgtttgcaagttatagggtctcacaa

SEQ ID NO: 13352 - DNA, 27 bp, synthetic construct
  misc_feature 1..27: note = Synthetic Construct
  source 1..27: mol_type = other DNA
ccatccccatcaccttattttgacaag

SEQ ID NO: 13353 - DNA, 23 bp, synthetic construct
  misc_feature 1..23: note = Synthetic Construct
  source 1..23: mol_type = other DNA
gcgcaagtcctatactggtctgt

SEQ ID NO: 13354 - DNA, 22 bp, synthetic construct
  misc_feature 1..22: note = Synthetic Construct
  source 1..22: mol_type = other DNA
ctccctgccaatatgccagttc

SEQ ID NO: 13355 - DNA, 24 bp, synthetic construct
  misc_feature 1..24: note = Synthetic Construct
  source 1..24: mol_type = other DNA
tggatgctcaagagttggatcttc

SEQ ID NO: 13356 - DNA, 24 bp, synthetic construct
  misc_feature 1..24: note = Synthetic Construct
  source 1..24: mol_type = other DNA
tgagctgaagttcttgctgagatt

SEQ ID NO: 13357 - DNA, 23 bp, synthetic construct
  misc_feature 1..23: note = Synthetic Construct
  source 1..23: mol_type = other DNA
ccctgaggctatccagggaagat

SEQ ID NO: 13358 - DNA, 25 bp, synthetic construct
  misc_feature 1..25: note = Synthetic Construct
  source 1..25: mol_type = other DNA
tggctcataggcagcaaattattca

SEQ ID NO: 13359 - DNA, 24 bp, synthetic construct
  misc_feature 1..24: note = Synthetic Construct
  source 1..24: mol_type = other DNA
ccaggttggttaggctctgctcaa

SEQ ID NO: 13360 - DNA, 24 bp, synthetic construct
  misc_feature 1..24: note = Synthetic Construct
  source 1..24: mol_type = other DNA
caccaaaggcatactcccatcagt

SEQ ID NO: 13361 - DNA, 20 bp, synthetic construct
  misc_feature 1..20: note = Synthetic Construct
  source 1..20: mol_type = other DNA
tcttccctgctgcccaccaa

SEQ ID NO: 13362 - DNA, 22 bp, synthetic construct
  misc_feature 1..22: note = Synthetic Construct
  source 1..22: mol_type = other DNA
gcaaagaggccccatgatccta

SEQ ID NO: 13363 - DNA, 22 bp, synthetic construct
  misc_feature 1..22: note = Synthetic Construct
  source 1..22: mol_type = other DNA
tcttctgctggagatgcgattc

SEQ ID NO: 13364 - DNA, 24 bp, synthetic construct
  misc_feature 1..24: note = Synthetic Construct
  source 1..24: mol_type = other DNA
gatggccattccttactctcagtt

SEQ ID NO: 13365 - DNA, 22 bp, synthetic construct
  misc_feature 1..22: note = Synthetic Construct
  source 1..22: mol_type = other DNA
ggtgctttatcccagggagatg

SEQ ID NO: 13366 - DNA, 22 bp, synthetic construct
  misc_feature 1..22: note = Synthetic Construct
  source 1..22: mol_type = other DNA
cacaagggtggaggttaccttt

SEQ ID NO: 13367 - DNA, 19 bp, synthetic construct
  misc_feature 1..19: note = Synthetic Construct
  source 1..19: mol_type = other DNA
tgcgatggcattcgtcaca

SEQ ID NO: 13368 - DNA, 21 bp, synthetic construct
  misc_feature 1..21: note = Synthetic Construct
  source 1..21: mol_type = other DNA
tgcatgaggagaggtgtccaa

SEQ ID NO: 13369 - DNA, 22 bp, synthetic construct
  misc_feature 1..22: note = Synthetic Construct
  source 1..22: mol_type = other DNA
ctgcacatcagtttgcttgcat

SEQ ID NO: 13370 - DNA, 23 bp, synthetic construct
  misc_feature 1..23: note = Synthetic Construct
  source 1..23: mol_type = other DNA
ggtcccaagttacagccaaccat

SEQ ID NO: 13371 - DNA, 23 bp, synthetic construct
  misc_feature 1..23: note = Synthetic Construct
  source 1..23: mol_type = other DNA
ggggtcatccacaaatgtcttct

SEQ ID NO: 13372 - DNA, 20 bp, synthetic construct
  misc_feature 1..20: note = Synthetic Construct
  source 1..20: mol_type = other DNA
acaccatcccctgagtgaca

SEQ ID NO: 13373 - DNA, 22 bp, synthetic construct
  misc_feature 1..22: note = Synthetic Construct
  source 1..22: mol_type = other DNA
gcaggactttggaggctgacta

SEQ ID NO: 13374 - DNA, 22 bp, synthetic construct
  misc_feature 1..22: note = Synthetic Construct
  source 1..22: mol_type = other DNA
agctcaacctgagcccttcctt

SEQ ID NO: 13375 - DNA, 21 bp, synthetic construct
  misc_feature 1..21: note = Synthetic Construct
  source 1..21: mol_type = other DNA
agtggcccaggtgaatacaga

SEQ ID NO: 13376 - DNA, 20 bp, synthetic construct
  misc_feature 1..20: note = Synthetic Construct
  source 1..20: mol_type = other DNA
caggtcaggaacggcaggta

SEQ ID NO: 13377 - DNA, 27 bp, synthetic construct
  misc_feature 1..27: note = Synthetic Construct
  source 1..27: mol_type = other DNA
ggaacagtattctgactccagatccta

SEQ ID NO: 13378 - DNA, 21 bp, synthetic construct
  misc_feature 1..21: note = Synthetic Construct
  source 1..21: mol_type = other DNA
tctttgcacccacctcacatc

SEQ ID NO: 13379 - DNA, 26 bp, synthetic construct
  misc_feature 1..26: note = Synthetic Construct
  source 1..26: mol_type = other DNA
gcaatgacctagcaaggtgtatgtct

SEQ ID NO: 13380 - DNA, 23 bp, synthetic construct
  misc_feature 1..23: note = Synthetic Construct
  source 1..23: mol_type = other DNA
ccaagccccaagtcagaaaagtt

SEQ ID NO: 13381 - DNA, 24 bp, synthetic construct
  misc_feature 1..24: note = Synthetic Construct
  source 1..24: mol_type = other DNA
gctttaggtaatgagccagactga

SEQ ID NO: 13382 - DNA, 25 bp, synthetic construct
  misc_feature 1..25: note = Synthetic Construct
  source 1..25: mol_type = other DNA
tttacaggacccctttttctgtctt

SEQ ID NO: 13383 - DNA, 22 bp, synthetic construct
  misc_feature 1..22: note = Synthetic Construct
  source 1..22: mol_type = other DNA
gtctggctctcgggaaagagaa

SEQ ID NO: 13384 - DNA, 24 bp, synthetic construct
  misc_feature 1..24: note = Synthetic Construct
  source 1..24: mol_type = other DNA
gcctgctagacaggagagttgctt

SEQ ID NO: 13385 - DNA, 24 bp, synthetic construct
  misc_feature 1..24: note = Synthetic Construct
  source 1..24: mol_type = other DNA
cctggccttaggattgggagatga

SEQ ID NO: 13386 - DNA, 22 bp, synthetic construct
  misc_feature 1..22: note = Synthetic Construct
  source 1..22: mol_type = other DNA
gaagctgcaggtgctgtactct

SEQ ID NO: 13387 - DNA, 22 bp, synthetic construct
  misc_feature 1..22: note = Synthetic Construct
  source 1..22: mol_type = other DNA
tgggtggactggattcctgctt

SEQ ID NO: 13388 - DNA, 26 bp, synthetic construct
  misc_feature 1..26: note = Synthetic Construct
  source 1..26: mol_type = other DNA
ggaaccccagtaaagatagagcagaa

SEQ ID NO: 13389 - DNA, 21 bp, synthetic construct
  misc_feature 1..21: note = Synthetic Construct
  source 1..21: mol_type = other DNA
ggtgggagtagtggggagaaa

SEQ ID NO: 13390 - DNA, 23 bp, synthetic construct
  misc_feature 1..23: note = Synthetic Construct
  source 1..23: mol_type = other DNA
gccggagtcaggtattggcaaag

SEQ ID NO: 13391 - DNA, 22 bp, synthetic construct
  misc_feature 1..22: note = Synthetic Construct
  source 1..22: mol_type = other DNA
ggcaggccccaaatcacttaca

SEQ ID NO: 13392 - DNA, 21 bp, synthetic construct
  misc_feature 1..21: note = Synthetic Construct
  source 1..21: mol_type = other DNA
agagccagcccagtggtctta

SEQ ID NO: 13393 - DNA, 20 bp, synthetic construct
  misc_feature 1..20: note = Synthetic Construct
  source 1..20: mol_type = other DNA
tgggtcacgccaacctattc

SEQ ID NO: 13394 - DNA, 20 bp, synthetic construct
  misc_feature 1..20: note = Synthetic Construct
  source 1..20: mol_type = other DNA
aagctgcagccctccttttg

SEQ ID NO: 13395 - DNA, 23 bp, synthetic construct
  misc_feature 1..23: note = Synthetic Construct
  source 1..23: mol_type = other DNA
attaacgctgggtacctgaaagt

SEQ ID NO: 13396 - DNA, 22 bp, synthetic construct
  misc_feature 1..22: note = Synthetic Construct
  source 1..22: mol_type = other DNA
ctgcaacaaacgccacttatca

SEQ ID NO: 13397 - DNA, 26 bp, synthetic construct
  misc_feature 1..26: note = Synthetic Construct
  source 1..26: mol_type = other DNA
gcttctgagggtttctaccactaact

SEQ ID NO: 13398 - DNA, 25 bp, synthetic construct
  misc_feature 1..25: note = Synthetic Construct
  source 1..25: mol_type = other DNA
caaagaaaggaaagccaggtagcat

SEQ ID NO: 13399 - DNA, 21 bp, synthetic construct
  misc_feature 1..21: note = Synthetic Construct
  source 1..21: mol_type = other DNA
cacttgctgttggcagagcta

SEQ ID NO: 13400 - DNA, 26 bp, synthetic construct
  misc_feature 1..26: note = Synthetic Construct
  source 1..26: mol_type = other DNA
cacctgaaggcaagaattgctacaaa

SEQ ID NO: 13401 - DNA, 22 bp, synthetic construct
  misc_feature 1..22: note = Synthetic Construct
  source 1..22: mol_type = other DNA
ccaacacggaacggtgctgata

SEQ ID NO: 13402 - DNA, 22 bp, synthetic construct
  misc_feature 1..22: note = Synthetic Construct
  source 1..22: mol_type = other DNA
gcacgggccacttttctagatg

SEQ ID NO: 13403 - DNA, 27 bp, synthetic construct
  misc_feature 1..27: note = Synthetic Construct
  source 1..27: mol_type = other DNA
gcaacacttgagaaatgctggttctct

SEQ ID NO: 13404 - DNA, 22 bp, synthetic construct
  misc_feature 1..22: note = Synthetic Construct
  source 1..22: mol_type = other DNA
tctattgctggcccctctatct

SEQ ID NO: 13405 - DNA, 24 bp, synthetic construct
  misc_feature 1..24: note = Synthetic Construct
  source 1..24: mol_type = other DNA
aagaatccagaaggaaaccagtgt

SEQ ID NO: 13406 - DNA, 18 bp, synthetic construct
  misc_feature 1..18: note = Synthetic Construct
  source 1..18: mol_type = other DNA
taggagagcgccgtgcat

SEQ ID NO: 13407 - DNA, 20 bp, synthetic construct
  misc_feature 1..20: note = Synthetic Construct
  source 1..20: mol_type = other DNA
tgaggctagctcggtgaact

SEQ ID NO: 13408 - DNA, 23 bp, synthetic construct
  misc_feature 1..23: note = Synthetic Construct
  source 1..23: mol_type = other DNA
ctctactggtctggggtcctagt

SEQ ID NO: 13409 - DNA, 19 bp, synthetic construct
  misc_feature 1..19: note = Synthetic Construct
  source 1..19: mol_type = other DNA
gtggcagcctcgtgcagta

SEQ ID NO: 13410 - DNA, 21 bp, synthetic construct
  misc_feature 1..21: note = Synthetic Construct
  source 1..21: mol_type = other DNA
gctgacttgctgtgggtctct

SEQ ID NO: 13411 - DNA, 26 bp, synthetic construct
  misc_feature 1..26: note = Synthetic Construct
  source 1..26: mol_type = other DNA
gcccatcagcaagtcttattgactct

SEQ ID NO: 13412 - DNA, 25 bp, synthetic construct
  misc_feature 1..25: note = Synthetic Construct
  source 1..25: mol_type = other DNA
ccttccctgtgtgtaagactgatct

SEQ ID NO: 13413 - DNA, 24 bp, synthetic construct
  misc_feature 1..24: note = Synthetic Construct
  source 1..24: mol_type = other DNA
ctcgggttggctgttacaatcgaa

SEQ ID NO: 13414 - DNA, 19 bp, synthetic construct
  misc_feature 1..19: note = Synthetic Construct
  source 1..19: mol_type = other DNA
tggccggtggggtctaagt

SEQ ID NO: 13415 - DNA, 23 bp, synthetic construct
  misc_feature 1..23: note = Synthetic Construct
  source 1..23: mol_type = other DNA
cctggcagagtagcttcccattc

SEQ ID NO: 13416 - DNA, 21 bp, synthetic construct
  misc_feature 1..21: note = Synthetic Construct
  source 1..21: mol_type = other DNA
agcggtgtttgaggagacatt

SEQ ID NO: 13417 - DNA, 22 bp, synthetic construct
  misc_feature 1..22: note = Synthetic Construct
  source 1..22: mol_type = other DNA
gcctctaggagaactggcaaca

SEQ ID NO: 13418 - DNA, 23 bp, synthetic construct
  misc_feature 1..23: note = Synthetic Construct
  source 1..23: mol_type = other DNA
gaggggaaatcagagctttgtca

SEQ ID NO: 13419 - DNA, 20 bp, synthetic construct
  misc_feature 1..20: note = Synthetic Construct
  source 1..20: mol_type = other DNA
cgccccaacacttccagtct

SEQ ID NO: 13420 - DNA, 24 bp, synthetic construct
  misc_feature 1..24: note = Synthetic Construct
  source 1..24: mol_type = other DNA
cactcagatctctggttccaatgt

SEQ ID NO: 13421 - DNA, 24 bp, synthetic construct
  misc_feature 1..24: note = Synthetic Construct
  source 1..24: mol_type = other DNA
caggaagccccaaagagttgaaga

SEQ ID NO: 13422 - DNA, 24 bp, synthetic construct
  misc_feature 1..24: note = Synthetic Construct
  source 1..24: mol_type = other DNA
tcggactctgtacctctcttcttt

SEQ ID NO: 13423 - DNA, 27 bp, synthetic construct
  misc_feature 1..27: note = Synthetic Construct
  source 1..27: mol_type = other DNA
gcaggaacttactaatgggatccagaa

SEQ ID NO: 13424 - DNA, 21 bp, synthetic construct
  misc_feature 1..21: note = Synthetic Construct
  source 1..21: mol_type = other DNA
cggtgggaatccctgactttc

SEQ ID NO: 13425 - DNA, 26 bp, synthetic construct
  misc_feature 1..26: note = Synthetic Construct
  source 1..26: mol_type = other DNA
cagatgtatcttttcagggccattac

SEQ ID NO: 13426 - DNA, 21 bp, synthetic construct
  misc_feature 1..21: note = Synthetic Construct
  source 1..21: mol_type = other DNA
ggacggtttggccaggtttct

SEQ ID NO: 13427 - DNA, 22 bp, synthetic construct
  misc_feature 1..22: note = Synthetic Construct
  source 1..22: mol_type = other DNA
aggagggctgcaccaatcctat

SEQ ID NO: 13428 - DNA, 26 bp, synthetic construct
  misc_feature 1..26: note = Synthetic Construct
  source 1..26: mol_type = other DNA
cccctgtgaattctaacctaggaagt

SEQ ID NO: 13429 - DNA, 23 bp, synthetic construct
  misc_feature 1..23: note = Synthetic Construct
  source 1..23: mol_type = other DNA
gcttctcccaagctgatctctgt

SEQ ID NO: 13430 - DNA, 22 bp, synthetic construct
  misc_feature 1..22: note = Synthetic Construct
  source 1..22: mol_type = other DNA
ggaagtgaccaggtgccatgat

SEQ ID NO: 13431 - DNA, 22 bp, synthetic construct
  misc_feature 1..22: note = Synthetic Construct
  source 1..22: mol_type = other DNA
caccagaccttcccttcagtgt

SEQ ID NO: 13432 - DNA, 21 bp, synthetic construct
  misc_feature 1..21: note = Synthetic Construct
  source 1..21: mol_type = other DNA
agggaacagagaggcagtaca

SEQ ID NO: 13433 - DNA, 20 bp, synthetic construct
  misc_feature 1..20: note = Synthetic Construct
  source 1..20: mol_type = other DNA
ccccagttgcacatgactgt

SEQ ID NO: 13434 - DNA, 19 bp, synthetic construct
  misc_feature 1..19: note = Synthetic Construct
  source 1..19: mol_type = other DNA
aggctggagcgagacactt

SEQ ID NO: 13435 - DNA, 25 bp, synthetic construct
  misc_feature 1..25: note = Synthetic Construct
  source 1..25: mol_type = other DNA
gccagggataagttccttctctaac

SEQ ID NO: 13436 - DNA, 23 bp, synthetic construct
  misc_feature 1..23: note = Synthetic Construct
  source 1..23: mol_type = other DNA
ctacttctgccattctggtccaa

SEQ ID NO: 13437 - DNA, 25 bp, synthetic construct
  misc_feature 1..25: note = Synthetic Construct
  source 1..25: mol_type = other DNA
gcttccatctgtaccctgttaccta

SEQ ID NO: 13438 - DNA, 22 bp, synthetic construct
  misc_feature 1..22: note = Synthetic Construct
  source 1..22: mol_type = other DNA
caggaggccaatccaaatcaca

SEQ ID NO: 13439 - DNA, 25 bp, synthetic construct
  misc_feature 1..25: note = Synthetic Construct
  source 1..25: mol_type = other DNA
caccctcccagatctgacgatctaa

SEQ ID NO: 13440 - DNA, 22 bp, synthetic construct
  misc_feature 1..22: note = Synthetic Construct
  source 1..22: mol_type = other DNA
cagtcacaacaggggcatctca

SEQ ID NO: 13441 - DNA, 24 bp, synthetic construct
  misc_feature 1..24: note = Synthetic Construct
  source 1..24: mol_type = other DNA
ggagcccttatctggagacagaac

SEQ ID NO: 13442 - DNA, 21 bp, synthetic construct
  misc_feature 1..21: note = Synthetic Construct
  source 1..21: mol_type = other DNA
tggtcgtcctgatggaacttg

SEQ ID NO: 13443 - DNA, 24 bp, synthetic construct
  misc_feature 1..24: note = Synthetic Construct
  source 1..24: mol_type = other DNA
tcattgaggctggatgtgtatcaa

SEQ ID NO: 13444 - DNA, 22 bp, synthetic construct
  misc_feature 1..22: note = Synthetic Construct
  source 1..22: mol_type = other DNA
ggggtcagctgagctaatgtgt

SEQ ID NO: 13445 - DNA, 21 bp, synthetic construct
  misc_feature 1..21: note = Synthetic Construct
  source 1..21: mol_type = other DNA
gtcgaagttggcatccgttca

SEQ ID NO: 13446 - DNA, 25 bp, synthetic construct
  misc_feature 1..25: note = Synthetic Construct
  source 1..25: mol_type = other DNA
cttcctaagaaggcaaagactgaga

SEQ ID NO: 13447 - DNA, 20 bp, synthetic construct
  misc_feature 1..20: note = Synthetic Construct
  source 1..20: mol_type = other DNA
ggcctgtctggatggtggtt

SEQ ID NO: 13448 - DNA, 23 bp, synthetic construct
  misc_feature 1..23: note = Synthetic Construct
  source 1..23: mol_type = other DNA
ccccaagccctgtcatccaatac

SEQ ID NO: 13449 - DNA, 21 bp, synthetic construct
  misc_feature 1..21: note = Synthetic Construct
  source 1..21: mol_type = other DNA
cagaaccgtctctgcgtccaa

SEQ ID NO: 13450 - DNA, 27 bp, synthetic construct
  misc_feature 1..27: note = Synthetic Construct
  source 1..27: mol_type = other DNA
ggattggctaaattgatagctcctcat

SEQ ID NO: 13451 - DNA, 22 bp, synthetic construct
  misc_feature 1..22: note = Synthetic Construct
  source 1..22: mol_type = other DNA
caaagcaggcgggagaactaga

SEQ ID NO: 13452 - DNA, 22 bp, synthetic construct
  misc_feature 1..22: note = Synthetic Construct
  source 1..22: mol_type = other DNA
cagctatctcgctcttgacact

SEQ ID NO: 13453 - DNA, 22 bp, synthetic construct
  misc_feature 1..22: note = Synthetic Construct
  source 1..22: mol_type = other DNA
cctcctactcaccaagcaggaa

SEQ ID NO: 13454 - DNA, 22 bp, synthetic construct
  misc_feature 1..22: note = Synthetic Construct
  source 1..22: mol_type = other DNA
cagcctcttcacgttgccttgt

SEQ ID NO: 13455 - DNA, 21 bp, synthetic construct
  misc_feature 1..21: note = Synthetic Construct
  source 1..21: mol_type = other DNA
agcatggcaacactcaaccaa

SEQ ID NO: 13456 - DNA, 24 bp, synthetic construct
  misc_feature 1..24: note = Synthetic Construct
  source 1..24: mol_type = other DNA
ctcagggacctacggtgtcatttg

SEQ ID NO: 13457 - DNA, 22 bp, synthetic construct
  misc_feature 1..22: note = Synthetic Construct
  source 1..22: mol_type = other DNA
ccccgtgatcctggtctacaca

SEQ ID NO: 13458 - DNA, 23 bp, synthetic construct
  misc_feature 1..23: note = Synthetic Construct
  source 1..23: mol_type = other DNA
cacaaacctggctgtctttgtga

SEQ ID NO: 13459 - DNA, 22 bp, synthetic construct
  misc_feature 1..22: note = Synthetic Construct
  source 1..22: mol_type = other DNA
gtcgctgggatgcataggaaca

SEQ ID NO: 13460 - DNA, 21 bp, synthetic construct
  misc_feature 1..21: note = Synthetic Construct
  source 1..21: mol_type = other DNA
gtgactgtttgcctgcctttc

SEQ ID NO: 13461 - DNA, 22 bp, synthetic construct
  misc_feature 1..22: note = Synthetic Construct
  source 1..22: mol_type = other DNA
gctgacaggtgagactctgaag

SEQ ID NO: 13462 - DNA, 24 bp, synthetic construct
  misc_feature 1..24: note = Synthetic Construct
  source 1..24: mol_type = other DNA
gtcgcgggaagctaaagataacat

SEQ ID NO: 13463 - DNA, 21 bp, synthetic construct
  misc_feature 1..21: note = Synthetic Construct
  source 1..21: mol_type = other DNA
ggggtggaatcaggactgtga

SEQ ID NO: 13464 - DNA, 25 bp, synthetic construct
  misc_feature 1..25: note = Synthetic Construct
  source 1..25: mol_type = other DNA
ggaggccttaacatacgaggtgaga

SEQ ID NO: 13465 - DNA, 21 bp, synthetic construct
  misc_feature 1..21: note = Synthetic Construct
  source 1..21: mol_type = other DNA
ggttgtgggctacgcttgtca

SEQ ID NO: 13466 - DNA, 24 bp, synthetic construct
  misc_feature 1..24: note = Synthetic Construct
  source 1..24: mol_type = other DNA
catcaggccctacttccagagatg

SEQ ID NO: 13467 - DNA, 22 bp, synthetic construct
  misc_feature 1..22: note = Synthetic Construct
  source 1..22: mol_type = other DNA
cgggtaagccgtgaacagtagt

SEQ ID NO: 13468 - DNA, 23 bp, synthetic construct
  misc_feature 1..23: note = Synthetic Construct
  source 1..23: mol_type = other DNA
gccttggaagggagtctgggaat

SEQ ID NO: 13469 - DNA, 27 bp, synthetic construct
  misc_feature 1..27: note = Synthetic Construct
  source 1..27: mol_type = other DNA
caacactaagacatgcccttgaagaag

SEQ ID NO: 13470 - DNA, 25 bp, synthetic construct
  misc_feature 1..25: note = Synthetic Construct
  source 1..25: mol_type = other DNA
gcatacaatatgacccactcagctt

SEQ ID NO: 13471 - DNA, 22 bp, synthetic construct
  misc_feature 1..22: note = Synthetic Construct
  source 1..22: mol_type = other DNA
gaggtgcggcagctactttttc

SEQ ID NO: 13472 - DNA, 20 bp, synthetic construct
  misc_feature 1..20: note = Synthetic Construct
  source 1..20: mol_type = other DNA
cgtagcccgtccttcagaga

SEQ ID NO: 13473 - DNA, 26 bp, synthetic construct
  misc_feature 1..26: note = Synthetic Construct
  source 1..26: mol_type = other DNA
gagctgtgtatgtactgagagatcaa

SEQ ID NO: 13474 - DNA, 22 bp, synthetic construct
  misc_feature 1..22: note = Synthetic Construct
  source 1..22: mol_type = other DNA
gagagaccgcttcaccatcttc

SEQ ID NO: 13475 - DNA, 20 bp, synthetic construct
  misc_feature 1..20: note = Synthetic Construct
  source 1..20: mol_type = other DNA
ctgtgcctttccaccgaaga

SEQ ID NO: 13476 - DNA, 27 bp, synthetic construct
  misc_feature 1..27: note = Synthetic Construct
  source 1..27: mol_type = other DNA
ggaaatacgactcagggaaaatacagt

SEQ ID NO: 13477 - DNA, 21 bp, synthetic construct
  misc_feature 1..21: note = Synthetic Construct
  source 1..21: mol_type = other DNA
tgctccaaccccacagtaaag

SEQ ID NO: 13478 - DNA, 20 bp, synthetic construct
  misc_feature 1..20: note = Synthetic Construct
  source 1..20: mol_type = other DNA
gccatgggccatcctgacat

SEQ ID NO: 13479 - DNA, 23 bp, synthetic construct
  misc_feature 1..23: note = Synthetic Construct
  source 1..23: mol_type = other DNA
ctggtggattttgcggagagtag

SEQ ID NO: 13480 - DNA, 23 bp, synthetic construct
  misc_feature 1..23: note = Synthetic Construct
  source 1..23: mol_type = other DNA
tcccaggtgtgttcaaagattgt

SEQ ID NO: 13481 - DNA, 22 bp, synthetic construct
  misc_feature 1..22: note = Synthetic Construct
  source 1..22: mol_type = other DNA
cctctgcccttttgccattttt

SEQ ID NO: 13482 - DNA, 24 bp, synthetic construct
  misc_feature 1..24: note = Synthetic Construct
  source 1..24: mol_type = other DNA
cttcaggttggggagatgccttag

SEQ ID NO: 13483 - DNA, 22 bp, synthetic construct
  misc_feature 1..22: note = Synthetic Construct
  source 1..22: mol_type = other DNA
gtgttggtcattcctggagagt

SEQ ID NO: 13484 - DNA, 26 bp, synthetic construct
  misc_feature 1..26: note = Synthetic Construct
  source 1..26: mol_type = other DNA
gctgagagcttgggttattcccatac

SEQ ID NO: 13485 - DNA, 23 bp, synthetic construct
  misc_feature 1..23: note = Synthetic Construct
  source 1..23: mol_type = other DNA
cttttgtgccagacaccaattct

SEQ ID NO: 13486 - DNA, 26 bp, synthetic construct
  misc_feature 1..26: note = Synthetic Construct
  source 1..26: mol_type = other DNA
ggactgtgtacttgctgaatgaggta

SEQ ID NO: 13487 - DNA, 23 bp, synthetic construct
  misc_feature 1..23: note = Synthetic Construct
  source 1..23: mol_type = other DNA
cttcaaggaggagaaggcaccta

SEQ ID NO: 13488 - DNA, 22 bp, synthetic construct
  misc_feature 1..22: note = Synthetic Construct
  source 1..22: mol_type = other DNA
gctgaaaattgccctgcacact

SEQ ID NO: 13489 - DNA, 20 bp, synthetic construct
  misc_feature 1..20: note = Synthetic Construct
  source 1..20: mol_type = other DNA
agtgaagggacgccacgttt

SEQ ID NO: 13490 - DNA, 21 bp, synthetic construct
  misc_feature 1..21: note = Synthetic Construct
  source 1..21: mol_type = other DNA
agtgagagacccagggaccaa

SEQ ID NO: 13491 - DNA, 22 bp, synthetic construct
  misc_feature 1..22: note = Synthetic Construct
  source 1..22: mol_type = other DNA
gcaacactggatcctggagagt

SEQ ID NO: 13492 - DNA, 22 bp, synthetic construct
  misc_feature 1..22: note = Synthetic Construct
  source 1..22: mol_type = other DNA
tggtcgagaaatgtgacccaaa

SEQ ID NO: 13493 - DNA, 25 bp, synthetic construct
  misc_feature 1..25: note = Synthetic Construct
  source 1..25: mol_type = other DNA
ccaggaccaatgggtaaaagtaaca

SEQ ID NO: 13494 - DNA, 20 bp, synthetic construct
  misc_feature 1..20: note = Synthetic Construct
  source 1..20: mol_type = other DNA
gcctttccaagggcatgaca

SEQ ID NO: 13495 - DNA, 23 bp, synthetic construct
  misc_feature 1..23: note = Synthetic Construct
  source 1..23: mol_type = other DNA
cctgtttggccagtagacaaatg

SEQ ID NO: 13496 - DNA, 25 bp, synthetic construct
  misc_feature 1..25: note = Synthetic Construct
  source 1..25: mol_type = other DNA
cgtcattggatctgtctcctttttc

SEQ ID NO: 13497 - DNA, 21 bp, synthetic construct
  misc_feature 1..21: note = Synthetic Construct
  source 1..21: mol_type = other DNA
ctgaccgcatttgaggagtct

SEQ ID NO: 13498 - DNA, 22 bp, synthetic construct
  misc_feature 1..22: note = Synthetic Construct
  source 1..22: mol_type = other DNA
ggccttcctggagcgagttaat

SEQ ID NO: 13499 - DNA, 20 bp, synthetic construct
  misc_feature 1..20: note = Synthetic Construct
  source 1..20: mol_type = other DNA
tgcaccatggagacctggaa

SEQ ID NO: 13500 - DNA, 21 bp, synthetic construct
  misc_feature 1..21: note = Synthetic Construct
  source 1..21: mol_type = other DNA
aaatgggtgaccagcaagtga

SEQ ID NO: 13501 - DNA, 20 bp, synthetic construct
  misc_feature 1..20: note = Synthetic Construct
  source 1..20: mol_type = other DNA
gcatccagttgcctgacact

SEQ ID NO: 13502 - DNA, 22 bp, synthetic construct
  misc_feature 1..22: note = Synthetic Construct
  source 1..22: mol_type = other DNA
ggcactgacttgagtggaaagt

SEQ ID NO: 13503 - DNA, 26 bp, synthetic construct
  misc_feature 1..26: note = Synthetic Construct
  source 1..26: mol_type = other DNA
cgaatccattctacccgcctaatttc

SEQ ID NO: 13504 - DNA, 23 bp, synthetic construct
  misc_feature 1..23: note = Synthetic Construct
  source 1..23: mol_type = other DNA
aggtggtgaccttagccaataac

SEQ ID NO: 13505 - DNA, 21 bp, synthetic construct
  misc_feature 1..21: note = Synthetic Construct
  source 1..21: mol_type = other DNA
aacacgagggatttcgcagat

SEQ ID NO: 13506 - DNA, 22 bp, synthetic construct
  misc_feature 1..22: note = Synthetic Construct
  source 1..22: mol_type = other DNA
ggaatctcccttcgtggactgt

SEQ ID NO: 13507 - DNA, 20 bp, synthetic construct
  misc_feature 1..20: note = Synthetic Construct
  source 1..20: mol_type = other DNA
tcccggtctctggcttttca

SEQ ID NO: 13508 - DNA, 24 bp, synthetic construct
  misc_feature 1..24: note = Synthetic Construct
  source 1..24: mol_type = other DNA
tggttttatcagctcacccaaact

SEQ ID NO: 13509 - DNA, 23 bp, synthetic construct
  misc_feature 1..23: note = Synthetic Construct
  source 1..23: mol_type = other DNA
tgggagattgcaaaggtcacaat

SEQ ID NO: 13510 - DNA, 23 bp, synthetic construct
  misc_feature 1..23: note = Synthetic Construct
  source 1..23: mol_type = other DNA
agagctccatgcaaattccagat

SEQ ID NO: 13511 - DNA, 22 bp, synthetic construct
  misc_feature 1..22: note = Synthetic Construct
  source 1..22: mol_type = other DNA
tggcacattcctccctgataca

SEQ ID NO: 13512 - DNA, 19 bp, synthetic construct
  misc_feature 1..19: note = Synthetic Construct
  source 1..19: mol_type = other DNA
tggggctttgggctgacaa

SEQ ID NO: 13513 - DNA, 22 bp, synthetic construct
  misc_feature 1..22: note = Synthetic Construct
  source 1..22: mol_type = other DNA
tgtggggagaaatggcaaaact

SEQ ID NO: 13514 - DNA, 20 bp, synthetic construct
  misc_feature 1..20: note = Synthetic Construct
  source 1..20: mol_type = other DNA
gttcgcaccttggcttctgt

SEQ ID NO: 13515 - DNA, 22 bp, synthetic construct
  misc_feature 1..22: note = Synthetic Construct
  source 1..22: mol_type = other DNA
ccggtgcatctctcatgcctta

SEQ ID NO: 13516 - DNA, 21 bp, synthetic construct
  misc_feature 1..21: note = Synthetic Construct
  source 1..21: mol_type = other DNA
tccggtcacttggccttcttg

SEQ ID NO: 13517 - DNA, 24 bp, synthetic construct
  misc_feature 1..24: note = Synthetic Construct
  source 1..24: mol_type = other DNA
gcctggaataccctttgcctgtct

SEQ ID NO: 13518 - DNA, 25 bp, synthetic construct
  misc_feature 1..25: note = Synthetic Construct
  source 1..25: mol_type = other DNA
gataaggctcagggcttaatgatga

SEQ ID NO: 13519 - DNA, 24 bp, synthetic construct
  misc_feature 1..24: note = Synthetic Construct
  source 1..24: mol_type = other DNA
cctccccaaatcctcactccattg

SEQ ID NO: 13520 - DNA, 23 bp, synthetic construct
  misc_feature 1..23: note = Synthetic Construct
  source 1..23: mol_type = other DNA
ccttcctgtaggagacccagcta

SEQ ID NO: 13521 - DNA, 22 bp, synthetic construct
  misc_feature 1..22: note = Synthetic Construct
  source 1..22: mol_type = other DNA
cagcttaagcctggtgaactct

SEQ ID NO: 13522 - DNA, 20 bp, synthetic construct
  misc_feature 1..20: note = Synthetic Construct
  source 1..20: mol_type = other DNA
gcccattttgccctctgttg

SEQ ID NO: 13523 - DNA, 22 bp, synthetic construct
  misc_feature 1..22: note = Synthetic Construct
  source 1..22: mol_type = other DNA
gtctcgcccaacctcattcttc

SEQ ID NO: 13524 - DNA, 27 bp, synthetic construct
  misc_feature 1..27: note = Synthetic Construct
  source 1..27: mol_type = other DNA
cactccattcacagctaatgttacgat

SEQ ID NO: 13525 - DNA, 20 bp, synthetic construct
  misc_feature 1..20: note = Synthetic Construct
  source 1..20: mol_type = other DNA
gcactagcagttggggcaat

SEQ ID NO: 13526 - DNA, 20 bp, synthetic construct
  misc_feature 1..20: note = Synthetic Construct
  source 1..20: mol_type = other DNA
cccctaccccaaagccaaaa

SEQ ID NO: 13527 - DNA, 21 bp, synthetic construct
  misc_feature 1..21: note = Synthetic Construct
  source 1..21: mol_type = other DNA
gctgtcgctcagccagttctt

SEQ ID NO: 13528 - DNA, 21 bp, synthetic construct
  misc_feature 1..21: note = Synthetic Construct
  source 1..21: mol_type = other DNA
gcaggccctgtgatggatgat

SEQ ID NO: 13529 - DNA, 27 bp, synthetic construct
  misc_feature 1..27: note = Synthetic Construct
  source 1..27: mol_type = other DNA
gccaatatccatggcataaatgaggtt

SEQ ID NO: 13530 - DNA, 24 bp, synthetic construct
  misc_feature 1..24: note = Synthetic Construct
  source 1..24: mol_type = other DNA
gccagttgccgttgatctaagact

SEQ ID NO: 13531 - DNA, 22 bp, synthetic construct
  misc_feature 1..22: note = Synthetic Construct
  source 1..22: mol_type = other DNA
cagcaggatgacttctgcgtta

SEQ ID NO: 13532 - DNA, 24 bp, synthetic construct
  misc_feature 1..24: note = Synthetic Construct
  source 1..24: mol_type = other DNA
cttcctgagtggatggttgactct

SEQ ID NO: 13533 - DNA, 20 bp, synthetic construct
  misc_feature 1..20: note = Synthetic Construct
  source 1..20: mol_type = other DNA
tgcgtgcagtgcagacagat

SEQ ID NO: 13534 - DNA, 21 bp, synthetic construct
  misc_feature 1..21: note = Synthetic Construct
  source 1..21: mol_type = other DNA
aggactcctggaagcatgaga

SEQ ID NO: 13535 - DNA, 22 bp, synthetic construct
  misc_feature 1..22: note = Synthetic Construct
  source 1..22: mol_type = other DNA
acactgtcccttccctcagcta

SEQ ID NO: 13536 - DNA, 21 bp, synthetic construct
  misc_feature 1..21: note = Synthetic Construct
  source 1..21: mol_type = other DNA
tgacggaggtagacggtcagt

SEQ ID NO: 13537 - DNA, 25 bp, synthetic construct
  misc_feature 1..25: note = Synthetic Construct
  source 1..25: mol_type = other DNA
gtggaaaagggtagcagtgatatgt

SEQ ID NO: 13538 - DNA, 20 bp, synthetic construct
  misc_feature 1..20: note = Synthetic Construct
  source 1..20: mol_type = other DNA
acaggctgggaagtgtgctt

SEQ ID NO: 13539 - DNA, 22 bp, synthetic construct
  misc_feature 1..22: note = Synthetic Construct
  source 1..22: mol_type = other DNA
cttcccctgtccttggcataac

SEQ ID NO: 13540 - DNA, 21 bp, synthetic construct
  misc_feature 1..21: note = Synthetic Construct
  source 1..21: mol_type = other DNA
tgagttgaggcagggacatca

SEQ ID NO: 13541 - DNA, 23 bp, synthetic construct
  misc_feature 1..23: note = Synthetic Construct
  source 1..23: mol_type = other DNA
cctgggagaccatttggaaaact

SEQ ID NO: 13542 - DNA, 22 bp, synthetic construct
  misc_feature 1..22: note = Synthetic Construct
  source 1..22: mol_type = other DNA
tccctcctgtgtcctgttggaa

SEQ ID NO: 13543 - DNA, 20 bp, synthetic construct
  misc_feature 1..20: note = Synthetic Construct
  source 1..20: mol_type = other DNA
catttgcccagctggccttt

SEQ ID NO: 13544 - DNA, 20 bp, synthetic construct
  misc_feature 1..20: note = Synthetic Construct
  source 1..20: mol_type = other DNA
aggcccctgtctcctagtct

SEQ ID NO: 13545 - DNA, 21 bp, synthetic construct
  misc_feature 1..21: note = Synthetic Construct
  source 1..21: mol_type = other DNA
cagggtagggaggtggagaag

SEQ ID NO: 13546 - DNA, 26 bp, synthetic construct
  misc_feature 1..26: note = Synthetic Construct
  source 1..26: mol_type = other DNA
tgtagacaacctggaagaaacagatg

SEQ ID NO: 13547 - DNA, 24 bp, synthetic construct
  misc_feature 1..24: note = Synthetic Construct
  source 1..24: mol_type = other DNA
cagaaaaggctggtatcccagaaa

SEQ ID NO: 13548 - DNA, 22 bp, synthetic construct
  misc_feature 1..22: note = Synthetic Construct
  source 1..22: mol_type = other DNA
aaaccaagcaggtggaatcagt

SEQ ID NO: 13549 - DNA, 27 bp, synthetic construct
  misc_feature 1..27: note = Synthetic Construct
  source 1..27: mol_type = other DNA
ggtttaaagaccgtgaatgatcccaaa

SEQ ID NO: 13550 - DNA, 23 bp, synthetic construct
  misc_feature 1..23: note = Synthetic Construct
  source 1..23: mol_type = other DNA
gtgcctaaggctagtgtcattct

SEQ ID NO: 13551 - DNA, 24 bp, synthetic construct
  misc_feature 1..24: note = Synthetic Construct
  source 1..24: mol_type = other DNA
gacagagcatttcaggtggagagt

SEQ ID NO: 13552 - DNA, 24 bp, synthetic construct
  misc_feature 1..24: note = Synthetic Construct
  source 1..24: mol_type = other DNA
gagtctccccaggcctattaggtt

SEQ ID NO: 13553 - DNA, 21 bp, synthetic construct
  misc_feature 1..21: note = Synthetic Construct
  source 1..21: mol_type = other DNA
ccattcctcccggtacagtct

SEQ ID NO: 13554 - DNA, 20 bp, synthetic construct
  misc_feature 1..20: note = Synthetic Construct
  source 1..20: mol_type = other DNA
ttctggggctgctactcaca

SEQ ID NO: 13555 - DNA, 23 bp, synthetic construct
  misc_feature 1..23: note = Synthetic Construct
  source 1..23: mol_type = other DNA
gcacttctgccattcagtgtgta

SEQ ID NO: 13556 - DNA, 23 bp, synthetic construct
  misc_feature 1..23: note = Synthetic Construct
  source 1..23: mol_type = other DNA
gggtggttccaaagaagggatca

SEQ ID NO: 13557 - DNA, 21 bp, synthetic construct
  misc_feature 1..21: note = Synthetic Construct
  source 1..21: mol_type = other DNA
tccacccgcttctccacatga

SEQ ID NO: 13558 - DNA, 22 bp, synthetic construct
  misc_feature 1..22: note = Synthetic Construct
  source 1..22: mol_type = other DNA
gatgactggtgcctgagggaaa

SEQ ID NO: 13559 - DNA, 23 bp, synthetic construct
  misc_feature 1..23: note = Synthetic Construct
  source 1..23: mol_type = other DNA
ctgagactagagtgcctccttca

SEQ ID NO: 13560 - DNA, 23 bp, synthetic construct
  misc_feature 1..23: note = Synthetic Construct
  source 1..23: mol_type = other DNA
ggggttttgccagtcatctaagt

SEQ ID NO: 13561 - DNA, 23 bp, synthetic construct
  misc_feature 1..23: note = Synthetic Construct
  source 1..23: mol_type = other DNA
gcatggtggtctctgggtagttg

SEQ ID NO: 13562 - DNA, 22 bp, synthetic construct
  misc_feature 1..22: note = Synthetic Construct
  source 1..22: mol_type = other DNA
gggatggggacaagggaaatca

SEQ ID NO: 13563 - DNA, 24 bp, synthetic construct
  misc_feature 1..24: note = Synthetic Construct
  source 1..24: mol_type = other DNA
ctctctgggtttctgtctgcattc

SEQ ID NO: 13564 - DNA, 24 bp, synthetic construct
  misc_feature 1..24: note = Synthetic Construct
  source 1..24: mol_type = other DNA
caccttgtcttcaggtgagtgcta

SEQ ID NO: 13565 - DNA, 19 bp, synthetic construct
  misc_feature 1..19: note = Synthetic Construct
  source 1..19: mol_type = other DNA
ggcacgctgcacactcctt

SEQ ID NO: 13566 - DNA, 20 bp, synthetic construct
  misc_feature 1..20: note = Synthetic Construct
  source 1..20: mol_type = other DNA
gggaatgggccaagactcaa

SEQ ID NO: 13567 - DNA, 20 bp, synthetic construct
  misc_feature 1..20: note = Synthetic Construct
  source 1..20: mol_type = other DNA
gggcagcgtcctgacatagt

SEQ ID NO: 13568 - DNA, 24 bp, synthetic construct
  misc_feature 1..24: note = Synthetic Construct
  source 1..24: mol_type = other DNA
gggaatggagaccagcagagacta

SEQ ID NO: 13569 - DNA, 22 bp, synthetic construct
  misc_feature 1..22: note = Synthetic Construct
  source 1..22: mol_type = other DNA
ttgtaaagtggttgccgagtct

SEQ ID NO: 13570 - DNA, 20 bp, synthetic construct
  misc_feature 1..20: note = Synthetic Construct
  source 1..20: mol_type = other DNA
agaccccagggccaccatga

SEQ ID NO: 13571 - DNA, 22 bp, synthetic construct
  misc_feature 1..22: note = Synthetic Construct
  source 1..22: mol_type = other DNA
gccagtctgtcgatgctcttgt

SEQ ID NO: 13572 - DNA, 24 bp, synthetic construct
  misc_feature 1..24: note = Synthetic Construct
  source 1..24: mol_type = other DNA
gtgttacaccaaatgccactgaag

SEQ ID NO: 13573 - DNA, 21 bp, synthetic construct
  misc_feature 1..21: note = Synthetic Construct
  source 1..21: mol_type = other DNA
tgggctgtacaagctgctttc

SEQ ID NO: 13574 - DNA, 25 bp, synthetic construct
  misc_feature 1..25: note = Synthetic Construct
  source 1..25: mol_type = other DNA
ctgtaacacaagaatgcgtgcatca

SEQ ID NO: 13575 - DNA, 23 bp, synthetic construct
  misc_feature 1..23: note = Synthetic Construct
  source 1..23: mol_type = other DNA
ggcagatgggacactttttcttg

SEQ ID NO: 13576 - DNA, 21 bp, synthetic construct
  misc_feature 1..21: note = Synthetic Construct
  source 1..21: mol_type = other DNA
gggttgacaccaggtgagaga

SEQ ID NO: 13577 - DNA, 24 bp, synthetic construct
  misc_feature 1..24: note = Synthetic Construct
  source 1..24: mol_type = other DNA
cacttaatctccaccacagtgcta

SEQ ID NO: 13578 - DNA, 19 bp, synthetic construct
  misc_feature 1..19: note = Synthetic Construct
  source 1..19: mol_type = other DNA
aggccagctttgcctctgt

SEQ ID NO: 13579 - DNA, 21 bp, synthetic construct
  misc_feature 1..21: note = Synthetic Construct
  source 1..21: mol_type = other DNA
gatgcactggagtgggcattt

SEQ ID NO: 13580 - DNA, 25 bp, synthetic construct
  misc_feature 1..25: note = Synthetic Construct
  source 1..25: mol_type = other DNA
caggctcacttttggatcaggcaat

SEQ ID NO: 13581 - DNA, 24 bp, synthetic construct
  misc_feature 1..24: note = Synthetic Construct
  source 1..24: mol_type = other DNA
cagctggtatctggtggaatactt

SEQ ID NO: 13582 - DNA, 21 bp, synthetic construct
  misc_feature 1..21: note = Synthetic Construct
  source 1..21: mol_type = other DNA
acccctctcactcaggagaca

SEQ ID NO: 13583 - DNA, 22 bp, synthetic construct
  misc_feature 1..22: note = Synthetic Construct
  source 1..22: mol_type = other DNA
ccacaaaggggttgccttgaga

SEQ ID NO: 13584 - DNA, 21 bp, synthetic construct
  misc_feature 1..21: note = Synthetic Construct
  source 1..21: mol_type = other DNA
cagaactgtgtgctgcctgaa

SEQ ID NO: 13585 - DNA, 24 bp, synthetic construct
  misc_feature 1..24: note = Synthetic Construct
  source 1..24: mol_type = other DNA
gactcagaggagactcccttcata

SEQ ID NO: 13586 - DNA, 20 bp, synthetic construct
  misc_feature 1..20: note = Synthetic Construct
  source 1..20: mol_type = other DNA
aggtctgccccagaggaaat

SEQ ID NO: 13587 - DNA, 22 bp, synthetic construct
  misc_feature 1..22: note = Synthetic Construct
  source 1..22: mol_type = other DNA
cctctgtgccttggtagaggaa

SEQ ID NO: 13588 - DNA, 20 bp, synthetic construct
  misc_feature 1..20: note = Synthetic Construct
  source 1..20: mol_type = other DNA
agtaccagccctgccactga

SEQ ID NO: 13589 - DNA, 20 bp, synthetic construct
  misc_feature 1..20: note = Synthetic Construct
  source 1..20: mol_type = other DNA
gttggccctgcttggtactt

SEQ ID NO: 13590 - DNA, 22 bp, synthetic construct
  misc_feature 1..22: note = Synthetic Construct
  source 1..22: mol_type = other DNA
gcactacgctaccctgaactac

SEQ ID NO: 13591 - DNA, 25 bp, synthetic construct
  misc_feature 1..25: note = Synthetic Construct
  source 1..25: mol_type = other DNA
ctggcattgtgtaggaaaggagaga

SEQ ID NO: 13592 - DNA, 21 bp, synthetic construct
  misc_feature 1..21: note = Synthetic Construct
  source 1..21: mol_type = other DNA
ctcaggcttcgcacttgatct

SEQ ID NO: 13593 - DNA, 24 bp, synthetic construct
  misc_feature 1..24: note = Synthetic Construct
  source 1..24: mol_type = other DNA
cccaattcctaatgcggcaaatgt

SEQ ID NO: 13594 - DNA, 25 bp, synthetic construct
  misc_feature 1..25: note = Synthetic Construct
  source 1..25: mol_type = other DNA
gaagggagcaggaattcactcaatc

SEQ ID NO: 13595 - DNA, 22 bp, synthetic construct
  misc_feature 1..22: note = Synthetic Construct
  source 1..22: mol_type = other DNA
ggtggctatccagagtgtgtct

SEQ ID NO: 13596 - DNA, 24 bp, synthetic construct
  misc_feature 1..24: note = Synthetic Construct
  source 1..24: mol_type = other DNA
ggggcagagtggtgatggataaca

SEQ ID NO: 13597 - DNA, 24 bp, synthetic construct
  misc_feature 1..24: note = Synthetic Construct
  source 1..24: mol_type = other DNA
catcagaagacctgcatagctaca

SEQ ID NO: 13598 - DNA, 25 bp, synthetic construct
  misc_feature 1..25: note = Synthetic Construct
  source 1..25: mol_type = other DNA
gtgctggcactaaaaggatacaatg

SEQ ID NO: 13599 - DNA, 20 bp, synthetic construct
  misc_feature 1..20: note = Synthetic Construct
  source 1..20: mol_type = other DNA
gcaagcggtttccactctga

SEQ ID NO: 13600 - DNA, 25 bp, synthetic construct
  misc_feature 1..25: note = Synthetic Construct
  source 1..25: mol_type = other DNA
cttgctcactgctaaactctcagat

SEQ ID NO: 13601 - DNA, 20 bp, synthetic construct
  misc_feature 1..20: note = Synthetic Construct
  source 1..20: mol_type = other DNA
ggcatccaaggagcaacaga

SEQ ID NO: 13602 - DNA, 22 bp, synthetic construct
  misc_feature 1..22: note = Synthetic Construct
  source 1..22: mol_type = other DNA
ccgtccatgtgctgtcatctct

SEQ ID NO: 13603 - DNA, 21 bp, synthetic construct
  misc_feature 1..21: note = Synthetic Construct
  source 1..21: mol_type = other DNA
tccggtacctggctcttggat

SEQ ID NO: 13604 - DNA, 24 bp, synthetic construct
  misc_feature 1..24: note = Synthetic Construct
  source 1..24: mol_type = other DNA
gttaggtggcataacaagctgatg

SEQ ID NO: 13605 - DNA, 25 bp, synthetic construct
  misc_feature 1..25: note = Synthetic Construct
  source 1..25: mol_type = other DNA
cagccctttagggtatctgcacttg

SEQ ID NO: 13606 - DNA, 22 bp, synthetic construct
  misc_feature 1..22: note = Synthetic Construct
  source 1..22: mol_type = other DNA
aggtggtctgaccttcctcctt

SEQ ID NO: 13607 - DNA, 22 bp, synthetic construct
  misc_feature 1..22: note = Synthetic Construct
  source 1..22: mol_type = other DNA
gtccctactccagggcatattg

SEQ ID NO: 13608 - DNA, 21 bp, synthetic construct
  misc_feature 1..21: note = Synthetic Construct
  source 1..21: mol_type = other DNA
gggactgtgcagacaaaccaa

SEQ ID NO: 13609 - DNA, 26 bp, synthetic construct
  misc_feature 1..26: note = Synthetic Construct
  source 1..26: mol_type = other DNA
cagtgagaagagagtgcaaagtcatt

SEQ ID NO: 13610 - DNA, 23 bp, synthetic construct
  misc_feature 1..23: note = Synthetic Construct
  source 1..23: mol_type = other DNA
cacagtcacagacatggatggta

SEQ ID NO: 13611 - DNA, 24 bp, synthetic construct
  misc_feature 1..24: note = Synthetic Construct
  source 1..24: mol_type = other DNA
gaggataacctttgcttgggtaca

SEQ ID NO: 13612 - DNA, 22 bp, synthetic construct
  misc_feature 1..22: note = Synthetic Construct
  source 1..22: mol_type = other DNA
agtgtgatgtgctgttgtgttg

SEQ ID NO: 13613 - DNA, 25 bp, synthetic construct
  misc_feature 1..25: note = Synthetic Construct
  source 1..25: mol_type = other DNA
gggtttcagcagcatattccaggta

SEQ ID NO: 13614 - DNA, 22 bp, synthetic construct
  misc_feature 1..22: note = Synthetic Construct
  source 1..22: mol_type = other DNA
aggcctggttgtcatccctcaa

SEQ ID NO: 13615 - DNA, 20 bp, synthetic construct
  misc_feature 1..20: note = Synthetic Construct
  source 1..20: mol_type = other DNA
gcgtggattgtgggcagtca

SEQ ID NO: 13616 - DNA, 22 bp, synthetic construct
  misc_feature 1..22: note = Synthetic Construct
  source 1..22: mol_type = other DNA
gtgctggcctgttctccataag

SEQ ID NO: 13617 - DNA, 21 bp, synthetic construct
  misc_feature 1..21: note = Synthetic Construct
  source 1..21: mol_type = other DNA
aggctgctggcacagacctat

SEQ ID NO: 13618 - DNA, 22 bp, synthetic construct
  misc_feature 1..22: note = Synthetic Construct
  source 1..22: mol_type = other DNA
gacggcctcattggagcatagt

SEQ ID NO: 13619 - DNA, 22 bp, synthetic construct
  misc_feature 1..22: note = Synthetic Construct
  source 1..22: mol_type = other DNA
aggagcagatctggctgagttg

SEQ ID NO: 13620 - DNA, 22 bp, synthetic construct
  misc_feature 1..22: note = Synthetic Construct
  source 1..22: mol_type = other DNA
gcctcacccattcattccatca

SEQ ID NO: 13621 - DNA, 23 bp, synthetic construct
  misc_feature 1..23: note = Synthetic Construct
  source 1..23: mol_type = other DNA
actggagtcaggaagggtaatca

SEQ ID NO: 13622 - DNA, 22 bp, synthetic construct
  misc_feature 1..22: note = Synthetic Construct
  source 1..22: mol_type = other DNA
actgcaagtgggtgatttgcta

SEQ ID NO: 13623 - DNA, 22 bp, synthetic construct
  misc_feature 1..22: note = Synthetic Construct
  source 1..22: mol_type = other DNA
acagtgctcaccattggaaaca

SEQ ID NO: 13624 - DNA, 24 bp, synthetic construct
  misc_feature 1..24: note = Synthetic Construct
  source 1..24: mol_type = other DNA
gggcaatgtgttacataggtggaa

SEQ ID NO: 13625 - DNA, 20 bp, synthetic construct
  misc_feature 1..20: note = Synthetic Construct
  source 1..20: mol_type = other DNA
tgggcctttgaggacacaga

SEQ ID NO: 13626 - DNA, 22 bp, synthetic construct
  misc_feature 1..22: note = Synthetic Construct
  source 1..22: mol_type = other DNA
ctggcctcgcaataaacctttc

SEQ ID NO: 13627 - DNA, 24 bp, synthetic construct
  misc_feature 1..24: note = Synthetic Construct
  source 1..24: mol_type = other DNA
gggagcaggaaggcaagaacatta

SEQ ID NO: 13628 - DNA, 21 bp, synthetic construct
  misc_feature 1..21: note = Synthetic Construct
  source 1..21: mol_type = other DNA
tcccacccctgtcacagactt

SEQ ID NO: 13629 - DNA, 21 bp, synthetic construct
  misc_feature 1..21: note = Synthetic Construct
  source 1..21: mol_type = other DNA
tgctagacccggagtcacttg

SEQ ID NO: 13630 - DNA, 21 bp, synthetic construct
  misc_feature 1..21: note = Synthetic Construct
  source 1..21: mol_type = other DNA
ccactggcggcaggaatgaat

SEQ ID NO: 13631 - DNA, 26 bp, synthetic construct
  misc_feature 1..26: note = Synthetic Construct
  source 1..26: mol_type = other DNA
gcctggagatgtatcggtgtaacttg

SEQ ID NO: 13632 - DNA, 21 bp, synthetic construct
  misc_feature 1..21: note = Synthetic Construct
  source 1..21: mol_type = other DNA
ttcctggctttgctgcttttc

SEQ ID NO: 13633 - DNA, 23 bp, synthetic construct
  misc_feature 1..23: note = Synthetic Construct
  source 1..23: mol_type = other DNA
ggtgactgttttaatccgtgcaa

SEQ ID NO: 13634 - DNA, 22 bp, synthetic construct
  misc_feature 1..22: note = Synthetic Construct
  source 1..22: mol_type = other DNA
gaaccgggacttcccagctaat

SEQ ID NO: 13635 - DNA, 23 bp, synthetic construct
  misc_feature 1..23: note = Synthetic Construct
  source 1..23: mol_type = other DNA
caggtgctatggctgtgaacttg

SEQ ID NO: 13636 - DNA, 23 bp, synthetic construct
  misc_feature 1..23: note = Synthetic Construct
  source 1..23: mol_type = other DNA
ccaccacctcagttccacacaaa

SEQ ID NO: 13637 - DNA, 22 bp, synthetic construct
  misc_feature 1..22: note = Synthetic Construct
  source 1..22: mol_type = other DNA
tctccttgttgctgtgcttttg

SEQ ID NO: 13638 - DNA, 24 bp, synthetic construct
  misc_feature 1..24: note = Synthetic Construct
  source 1..24: mol_type = other DNA
ctgtcctggtcttcattgaccaaa

SEQ ID NO: 13639 - DNA, 21 bp, synthetic construct
  misc_feature 1..21: note = Synthetic Construct
  source 1..21: mol_type = other DNA
gctacctcattcgggcgcatt

SEQ ID NO: 13640 - DNA, 19 bp, synthetic construct
  misc_feature 1..19: note = Synthetic Construct
  source 1..19: mol_type = other DNA
gaggaagggcacgggtttg

SEQ ID NO: 13641 - DNA, 24 bp, synthetic construct
  misc_feature 1..24: note = Synthetic Construct
  source 1..24: mol_type = other DNA
cagaaggaagccttcaaagacact

SEQ ID NO: 13642 - DNA, 21 bp, synthetic construct
  misc_feature 1..21: note = Synthetic Construct
  source 1..21: mol_type = other DNA
tgcagtgaggtttggaacaca

SEQ ID NO: 13643 - DNA, 22 bp, synthetic construct
  misc_feature 1..22: note = Synthetic Construct
  source 1..22: mol_type = other DNA
gtgccttgccaaacagggaaga

SEQ ID NO: 13644 - DNA, 21 bp, synthetic construct
  misc_feature 1..21: note = Synthetic Construct
  source 1..21: mol_type = other DNA
ctcagagggctctccttccat

SEQ ID NO: 13645 - DNA, 22 bp, synthetic construct
  misc_feature 1..22: note = Synthetic Construct
  source 1..22: mol_type = other DNA
gtccaagcagggccttctgatt

SEQ ID NO: 13646 - DNA, 22 bp, synthetic construct
  misc_feature 1..22: note = Synthetic Construct
  source 1..22: mol_type = other DNA
gcgaagaggaatacgctcaaag

SEQ ID NO: 13647 - DNA, 25 bp, synthetic construct
  misc_feature 1..25: note = Synthetic Construct
  source 1..25: mol_type = other DNA
gtcttgggctctatttgccaggttt

SEQ ID NO: 13648 - DNA, 23 bp, synthetic construct
  misc_feature 1..23: note = Synthetic Construct
  source 1..23: mol_type = other DNA
cagtggaaatctgcccattttgt

SEQ ID NO: 13649 - DNA, 22 bp, synthetic construct
  misc_feature 1..22: note = Synthetic Construct
  source 1..22: mol_type = other DNA
gagcctgtggacagaaccacta

SEQ ID NO: 13650 - DNA, 25 bp, synthetic construct
  misc_feature 1..25: note = Synthetic Construct
  source 1..25: mol_type = other DNA
ggatgagtcctctagttttggtgtt

SEQ ID NO: 13651 - DNA, 25 bp, synthetic construct
  misc_feature 1..25: note = Synthetic Construct
  source 1..25: mol_type = other DNA
ccctcaaagcaacattggctacact

SEQ ID NO: 13652 - DNA, 24 bp, synthetic construct
  misc_feature 1..24: note = Synthetic Construct
  source 1..24: mol_type = other DNA
gagctggacttccttttctcactt

SEQ ID NO: 13653 - DNA, 22 bp, synthetic construct
  misc_feature 1..22: note = Synthetic Construct
  source 1..22: mol_type = other DNA
gccctcccaagggaaggtctta

SEQ ID NO: 13654 - DNA, 22 bp, synthetic construct
  misc_feature 1..22: note = Synthetic Construct
  source 1..22: mol_type = other DNA
agtccaagggtaggggagttag

SEQ ID NO: 13655 - DNA, 20 bp, synthetic construct
  misc_feature 1..20: note = Synthetic Construct
  source 1..20: mol_type = other DNA
ccgttcgcgctctgttcctt

SEQ ID NO: 13656 - DNA, 24 bp, synthetic construct
  misc_feature 1..24: note = Synthetic Construct
  source 1..24: mol_type = other DNA
ccaaaagcaggagaatggggttct

SEQ ID NO: 13657 - DNA, 22 bp, synthetic construct
  misc_feature 1..22: note = Synthetic Construct
  source 1..22: mol_type = other DNA
cggtttcctcgtagccctaaac

SEQ ID NO: 13658 - DNA, 22 bp, synthetic construct
  misc_feature 1..22: note = Synthetic Construct
  source 1..22: mol_type = other DNA
aggcagctcttacctccccatt

SEQ ID NO: 13659 - DNA, 22 bp, synthetic construct
  misc_feature 1..22: note = Synthetic Construct
  source 1..22: mol_type = other DNA
caggtcagagaacctgtgtgaa

SEQ ID NO: 13660 - DNA, 25 bp, synthetic construct
  misc_feature 1..25: note = Synthetic Construct
  source 1..25: mol_type = other DNA
ggcaatgacactggaaaagaatcaa

SEQ ID NO: 13661 - DNA, 20 bp, synthetic construct
  misc_feature 1..20: note = Synthetic Construct
  source 1..20: mol_type = other DNA
agctcctccatggcctgtct

SEQ ID NO: 13662 - DNA, 23 bp, synthetic construct
  misc_feature 1..23: note = Synthetic Construct
  source 1..23: mol_type = other DNA
gaatggtgagagaggaggtctga

SEQ ID NO: 13663 - DNA, 20 bp, synthetic construct
  misc_feature 1..20: note = Synthetic Construct
  source 1..20: mol_type = other DNA
agcatgggccttggtgacat

SEQ ID NO: 13664 - DNA, 27 bp, synthetic construct
  misc_feature 1..27: note = Synthetic Construct
  source 1..27: mol_type = other DNA
gagaagggtggcatctaaaacagagaa

SEQ ID NO: 13665 - DNA, 24 bp, synthetic construct
  misc_feature 1..24: note = Synthetic Construct
  source 1..24: mol_type = other DNA
ctctgctttgtgactgtgctcctt

SEQ ID NO: 13666 - DNA, 24 bp, synthetic construct
  misc_feature 1..24: note = Synthetic Construct
  source 1..24: mol_type = other DNA
atccgagagcttcctagaatcaac

SEQ ID NO: 13667 - DNA, 21 bp, synthetic construct
  misc_feature 1..21: note = Synthetic Construct
  source 1..21: mol_type = other DNA
ttggagtgcctcgccagcttt

SEQ ID NO: 13668 - DNA, 30 bp, synthetic construct
  misc_feature 1..30: note = Synthetic Construct
  source 1..30: mol_type = other DNA
ccgtgtctctagtctcttcccatcctaata

SEQ ID NO: 13669 - DNA, 22 bp, synthetic construct
  misc_feature 1..22: note = Synthetic Construct
  source 1..22: mol_type = other DNA
tcctcccttcctctgcctgaag

SEQ ID NO: 13670 - DNA, 23 bp, synthetic construct
  misc_feature 1..23: note = Synthetic Construct
  source 1..23: mol_type = other DNA
cacaccagcttctccttcattct

SEQ ID NO: 13671 - DNA, 24 bp, synthetic construct
  misc_feature 1..24: note = Synthetic Construct
  source 1..24: mol_type = other DNA
atcgtctctggattgcttctgatt

SEQ ID NO: 13672 - DNA, 22 bp, synthetic construct
  misc_feature 1..22: note = Synthetic Construct
  source 1..22: mol_type = other DNA
gctcggttggcttctgtccaat

SEQ ID NO: 13673 - DNA, 20 bp, synthetic construct
  misc_feature 1..20: note = Synthetic Construct
  source 1..20: mol_type = other DNA
ggtggttgcgtggcattgaa

SEQ ID NO: 13674 - DNA, 18 bp, synthetic construct
  misc_feature 1..18: note = Synthetic Construct
  source 1..18: mol_type = other DNA
cgggagtcacggatgcaa

SEQ ID NO: 13675 - DNA, 22 bp, synthetic construct
  misc_feature 1..22: note = Synthetic Construct
  source 1..22: mol_type = other DNA
ctcccatgcacagtgtctcaca

SEQ ID NO: 13676 - DNA, 22 bp, synthetic construct
  misc_feature 1..22: note = Synthetic Construct
  source 1..22: mol_type = other DNA
acggctcagcttttccattagt

SEQ ID NO: 13677 - DNA, 22 bp, synthetic construct
  misc_feature 1..22: note = Synthetic Construct
  source 1..22: mol_type = other DNA
gagaacctacaacgccgtctct

SEQ ID NO: 13678 - DNA, 22 bp, synthetic construct
  misc_feature 1..22: note = Synthetic Construct
  source 1..22: mol_type = other DNA
ggggcagactcttggaaagaca

SEQ ID NO: 13679 - DNA, 23 bp, synthetic construct
  misc_feature 1..23: note = Synthetic Construct
  source 1..23: mol_type = other DNA
cacccgcattggactgagagttt

SEQ ID NO: 13680 - DNA, 25 bp, synthetic construct
  misc_feature 1..25: note = Synthetic Construct
  source 1..25: mol_type = other DNA
gacatgcaatgttccatgctgtcaa

SEQ ID NO: 13681 - DNA, 22 bp, synthetic construct
  misc_feature 1..22: note = Synthetic Construct
  source 1..22: mol_type = other DNA
gcccaccaaccttctctcttct

SEQ ID NO: 13682 - DNA, 22 bp, synthetic construct
  misc_feature 1..22: note = Synthetic Construct
  source 1..22: mol_type = other DNA
ctggagcctgaactttctgctt

SEQ ID NO: 13683 - DNA, 20 bp, synthetic construct
  misc_feature 1..20: note = Synthetic Construct
  source 1..20: mol_type = other DNA
atgccggagctgtcctctaa

SEQ ID NO: 13684 - DNA, 23 bp, synthetic construct
  misc_feature 1..23: note = Synthetic Construct
  source 1..23: mol_type = other DNA
gggagttctctaaggctgcagaa

SEQ ID NO: 13685 - DNA, 22 bp, synthetic construct
  misc_feature 1..22: note = Synthetic Construct
  source 1..22: mol_type = other DNA
gactggtgttccagatgtcagt

SEQ ID NO: 13686 - DNA, 26 bp, synthetic construct
  misc_feature 1..26: note = Synthetic Construct
  source 1..26: mol_type = other DNA
cgatcagaactatccatgcctctttg

SEQ ID NO: 13687 - DNA, 25 bp, synthetic construct
  misc_feature 1..25: note = Synthetic Construct
  source 1..25: mol_type = other DNA
gcattgctgtttgtcatgcaatagt

SEQ ID NO: 13688 - DNA, 26 bp, synthetic construct
  misc_feature 1..26: note = Synthetic Construct
  source 1..26: mol_type = other DNA
cccactgctcctattttgggttattg

SEQ ID NO: 13689 - DNA, 23 bp, synthetic construct
  misc_feature 1..23: note = Synthetic Construct
  source 1..23: mol_type = other DNA
cctaacaggtctggaaggctcaa

SEQ ID NO: 13690 - DNA, 22 bp, synthetic construct
  misc_feature 1..22: note = Synthetic Construct
  source 1..22: mol_type = other DNA
gcaagcagctttttcacgttgt

SEQ ID NO: 13691 - DNA, 25 bp, synthetic construct
  misc_feature 1..25: note = Synthetic Construct
  source 1..25: mol_type = other DNA
caactcctttcacccctggagattc

SEQ ID NO: 13692 - DNA, 25 bp, synthetic construct
  misc_feature 1..25: note = Synthetic Construct
  source 1..25: mol_type = other DNA
gaactgtacggaaagtgagctgaac

SEQ ID NO: 13693 - DNA, 24 bp, synthetic construct
  misc_feature 1..24: note = Synthetic Construct
  source 1..24: mol_type = other DNA
aaagaaagactggaacgtgagact

SEQ ID NO: 13694 - DNA, 23 bp, synthetic construct
  misc_feature 1..23: note = Synthetic Construct
  source 1..23: mol_type = other DNA
ggctacctccacaaacacacatc

SEQ ID NO: 13695 - DNA, 20 bp, synthetic construct
  misc_feature 1..20: note = Synthetic Construct
  source 1..20: mol_type = other DNA
agggaccgctcaggtgatgt

SEQ ID NO: 13696 - DNA, 24 bp, synthetic construct
  misc_feature 1..24: note = Synthetic Construct
  source 1..24: mol_type = other DNA
gcgagaggtaggaactgtgtgctt

SEQ ID NO: 13697 - DNA, 21 bp, synthetic construct
  misc_feature 1..21: note = Synthetic Construct
  source 1..21: mol_type = other DNA
tcccctactggggactgtttt

SEQ ID NO: 13698 - DNA, 23 bp, synthetic construct
  misc_feature 1..23: note = Synthetic Construct
  source 1..23: mol_type = other DNA
gccatgcaactctatcactcaca

SEQ ID NO: 13699 - DNA, 24 bp, synthetic construct
  misc_feature 1..24: note = Synthetic Construct
  source 1..24: mol_type = other DNA
gctattggcagatgcagacattca

SEQ ID NO: 13700 - DNA, 25 bp, synthetic construct
  misc_feature 1..25: note = Synthetic Construct
  source 1..25: mol_type = other DNA
cacacaggtgtagacctaactgcta

SEQ ID NO: 13701 - DNA, 24 bp, synthetic construct
  misc_feature 1..24: note = Synthetic Construct
  source 1..24: mol_type = other DNA
tgctgggtgcagaaattaaacaag

SEQ ID NO: 13702 - DNA, 26 bp, synthetic construct
  misc_feature 1..26: note = Synthetic Construct
  source 1..26: mol_type = other DNA
ccagacagagtgggaggttatagaga

SEQ ID NO: 13703 - DNA, 24 bp, synthetic construct
  misc_feature 1..24: note = Synthetic Construct
  source 1..24: mol_type = other DNA
ggaatgcaaaacccttgagccaaa

SEQ ID NO: 13704 - DNA, 23 bp, synthetic construct
  misc_feature 1..23: note = Synthetic Construct
  source 1..23: mol_type = other DNA
aggggagtttcacacacagaaaa

SEQ ID NO: 13705 - DNA, 23 bp, synthetic construct
  misc_feature 1..23: note = Synthetic Construct
  source 1..23: mol_type = other DNA
ctctagacctcacgagcacaagt

SEQ ID NO: 13706 - DNA, 21 bp, synthetic construct
  misc_feature 1..21: note = Synthetic Construct
  source 1..21: mol_type = other DNA
aggacccagcatcttcctttg

SEQ ID NO: 13707 - DNA, 26 bp, synthetic construct
  misc_feature 1..26: note = Synthetic Construct
  source 1..26: mol_type = other DNA
ttctccctagaggaatacaacctcat

SEQ ID NO: 13708 - DNA, 22 bp, synthetic construct
  misc_feature 1..22: note = Synthetic Construct
  source 1..22: mol_type = other DNA
agtggctgacacttttgacaga

SEQ ID NO: 13709 - DNA, 26 bp, synthetic construct
  misc_feature 1..26: note = Synthetic Construct
  source 1..26: mol_type = other DNA
cttgctatgaactcccatcactttct

SEQ ID NO: 13710 - DNA, 20 bp, synthetic construct
  misc_feature 1..20: note = Synthetic Construct
  source 1..20: mol_type = other DNA
acagtgcccagagctcacaa

SEQ ID NO: 13711 - DNA, 22 bp, synthetic construct
  misc_feature 1..22: note = Synthetic Construct
  source 1..22: mol_type = other DNA
gctcaagggtgtggtgctttct

SEQ ID NO: 13712 - DNA, 21 bp, synthetic construct
  misc_feature 1..21: note = Synthetic Construct
  source 1..21: mol_type = other DNA
ggggtggtgggtactgtctgt

SEQ ID NO: 13713 - DNA, 23 bp, synthetic construct
  misc_feature 1..23: note = Synthetic Construct
  source 1..23: mol_type = other DNA
gcctggggctacaacttttatga

SEQ ID NO: 13714 - DNA, 22 bp, synthetic construct
  misc_feature 1..22: note = Synthetic Construct
  source 1..22: mol_type = other DNA
tgttagggcttccctcttgact

SEQ ID NO: 13715 - DNA, 24 bp, synthetic construct
  misc_feature 1..24: note = Synthetic Construct
  source 1..24: mol_type = other DNA
ggactactaaggggcatggttaga

SEQ ID NO: 13716 - DNA, 27 bp, synthetic construct
  misc_feature 1..27: note = Synthetic Construct
  source 1..27: mol_type = other DNA
gactggatgctgttcagtgaaatttgt

SEQ ID NO: 13717 - DNA, 24 bp, synthetic construct
  misc_feature 1..24: note = Synthetic Construct
  source 1..24: mol_type = other DNA
ggagatgcagctggtgagaacctt

SEQ ID NO: 13718 - DNA, 22 bp, synthetic construct
  misc_feature 1..22: note = Synthetic Construct
  source 1..22: mol_type = other DNA
ggcccctctcagttgaagaaag

SEQ ID NO: 13719 - DNA, 23 bp, synthetic construct
  misc_feature 1..23: note = Synthetic Construct
  source 1..23: mol_type = other DNA
gagaaagcccacttggagagact

SEQ ID NO: 13720 - DNA, 22 bp, synthetic construct
  misc_feature 1..22: note = Synthetic Construct
  source 1..22: mol_type = other DNA
ggtgcaggactgataagcagat

SEQ ID NO: 13721 - DNA, 22 bp, synthetic construct
  misc_feature 1..22: note = Synthetic Construct
  source 1..22: mol_type = other DNA
cttgccaccagatccactcaga

SEQ ID NO: 13722 - DNA, 22 bp, synthetic construct
  misc_feature 1..22: note = Synthetic Construct
  source 1..22: mol_type = other DNA
cgccgttctcaagcccaagttt

SEQ ID NO: 13723 - DNA, 21 bp, synthetic construct
  misc_feature 1..21: note = Synthetic Construct
  source 1..21: mol_type = other DNA
caagccaaagccacccattac

SEQ ID NO: 13724 - DNA, 23 bp, synthetic construct
  misc_feature 1..23: note = Synthetic Construct
  source 1..23: mol_type = other DNA
gtacacgggtagggttgttttgt

SEQ ID NO: 13725 - DNA, 22 bp, synthetic construct
  misc_feature 1..22: note = Synthetic Construct
  source 1..22: mol_type = other DNA
ctggggaaagggacaggttgaa

SEQ ID NO: 13726 - DNA, 22 bp, synthetic construct
  misc_feature 1..22: note = Synthetic Construct
  source 1..22: mol_type = other DNA
gagattggcagtccaggtgtgt

SEQ ID NO: 13727 - DNA, 22 bp, synthetic construct
  misc_feature 1..22: note = Synthetic Construct
  source 1..22: mol_type = other DNA
tggaagggtttgagtgggtttt

SEQ ID NO: 13728 - DNA, 23 bp, synthetic construct
  misc_feature 1..23: note = Synthetic Construct
  source 1..23: mol_type = other DNA
gctgaactgcttgcacttcttac

SEQ ID NO: 13729 - DNA, 24 bp, synthetic construct
  misc_feature 1..24: note = Synthetic Construct
  source 1..24: mol_type = other DNA
ggaacacataaggcctgagggaat

SEQ ID NO: 13730 - DNA, 24 bp, synthetic construct
  misc_feature 1..24: note = Synthetic Construct
  source 1..24: mol_type = other DNA
ggcactgtactgggagatgaagaa

SEQ ID NO: 13731 - DNA, 22 bp, synthetic construct
  misc_feature 1..22: note = Synthetic Construct
  source 1..22: mol_type = other DNA
gcaggacaaaagccaactctgt

SEQ ID NO: 13732 - DNA, 20 bp, synthetic construct
  misc_feature 1..20: note = Synthetic Construct
  source 1..20: mol_type = other DNA
ccccagtgatttcgggttga

SEQ ID NO: 13733 - DNA, 22 bp, synthetic construct
  misc_feature 1..22: note = Synthetic Construct
  source 1..22: mol_type = other DNA
ggaccacaccaatgaccagcaa

SEQ ID NO: 13734 - DNA, 20 bp, synthetic construct
  misc_feature 1..20: note = Synthetic Construct
  source 1..20: mol_type = other DNA
ggtggtccccttgccagttt

SEQ ID NO: 13735 - DNA, 21 bp, synthetic construct
  misc_feature 1..21: note = Synthetic Construct
  source 1..21: mol_type = other DNA
gcttctcatcgttgggcttga

SEQ ID NO: 13736 - DNA, 21 bp, synthetic construct
  misc_feature 1..21: note = Synthetic Construct
  source 1..21: mol_type = other DNA
ccctggagtaccagctcctat

SEQ ID NO: 13737 - DNA, 24 bp, synthetic construct
  misc_feature 1..24: note = Synthetic Construct
  source 1..24: mol_type = other DNA
gcagcacctggctcagagtagata

SEQ ID NO: 13738 - DNA, 20 bp, synthetic construct
  misc_feature 1..20: note = Synthetic Construct
  source 1..20: mol_type = other DNA
tgcctcggatcaccaagtgt

SEQ ID NO: 13739 - DNA, 22 bp, synthetic construct
  misc_feature 1..22: note = Synthetic Construct
  source 1..22: mol_type = other DNA
cgaggggcctgaagacttagaa

SEQ ID NO: 13740 - DNA, 26 bp, synthetic construct
  misc_feature 1..26: note = Synthetic Construct
  source 1..26: mol_type = other DNA
ggttttacacaggtgaggttgtgatg

SEQ ID NO: 13741 - DNA, 22 bp, synthetic construct
  misc_feature 1..22: note = Synthetic Construct
  source 1..22: mol_type = other DNA
aggaattgccctgcagcctatc

SEQ ID NO: 13742 - DNA, 25 bp, synthetic construct
  misc_feature 1..25: note = Synthetic Construct
  source 1..25: mol_type = other DNA
cacaagtcccagaagaaaaggtgtt

SEQ ID NO: 13743 - DNA, 26 bp, synthetic construct
  misc_feature 1..26: note = Synthetic Construct
  source 1..26: mol_type = other DNA
cacagacgcacacgtatacaccatag

SEQ ID NO: 13744 - DNA, 23 bp, synthetic construct
  misc_feature 1..23: note = Synthetic Construct
  source 1..23: mol_type = other DNA
ggcacatggttccaaaggtggta

SEQ ID NO: 13745 - DNA, 21 bp, synthetic construct
  misc_feature 1..21: note = Synthetic Construct
  source 1..21: mol_type = other DNA
ttcccaggtggtcacgctatg

SEQ ID NO: 13746 - DNA, 23 bp, synthetic construct
  misc_feature 1..23: note = Synthetic Construct
  source 1..23: mol_type = other DNA
ggactgtgccaccatctctgtag

SEQ ID NO: 13747 - DNA, 24 bp, synthetic construct
  misc_feature 1..24: note = Synthetic Construct
  source 1..24: mol_type = other DNA
ccagttgagaaggtcccagtctct

SEQ ID NO: 13748 - DNA, 21 bp, synthetic construct
  misc_feature 1..21: note = Synthetic Construct
  source 1..21: mol_type = other DNA
gggaggccaagaaagctgcat

SEQ ID NO: 13749 - DNA, 27 bp, synthetic construct
  misc_feature 1..27: note = Synthetic Construct
  source 1..27: mol_type = other DNA
cctagttatttccttgccacactttga

SEQ ID NO: 13750 - DNA, 20 bp, synthetic construct
  misc_feature 1..20: note = Synthetic Construct
  source 1..20: mol_type = other DNA
gtgaccctgcgaccctgaag

SEQ ID NO: 13751 - DNA, 20 bp, synthetic construct
  misc_feature 1..20: note = Synthetic Construct
  source 1..20: mol_type = other DNA
acccacagtacccacagctt

SEQ ID NO: 13752 - DNA, 20 bp, synthetic construct
  misc_feature 1..20: note = Synthetic Construct
  source 1..20: mol_type = other DNA
gccagtcctcctgtcgaagt

SEQ ID NO: 13753 - DNA, 24 bp, synthetic construct
  misc_feature 1..24: note = Synthetic Construct
  source 1..24: mol_type = other DNA
ccttccagaaaatcggccttgtgt

SEQ ID NO: 13754 - DNA, 21 bp, synthetic construct
  misc_feature 1..21: note = Synthetic Construct
  source 1..21: mol_type = other DNA
cagacccaaaggtcccacttg

SEQ ID NO: 13755 - DNA, 21 bp, synthetic construct
  misc_feature 1..21: note = Synthetic Construct
  source 1..21: mol_type = other DNA
ggcagacaagcaagacagcaa

SEQ ID NO: 13756 - DNA, 26 bp, synthetic construct
  misc_feature 1..26: note = Synthetic Construct
  source 1..26: mol_type = other DNA
gtctgaaccagagagctcctatccta

SEQ ID NO: 13757 - DNA, 21 bp, synthetic construct
  misc_feature 1..21: note = Synthetic Construct
  source 1..21: mol_type = other DNA
gccactgaggttctggtcgtt

SEQ ID NO: 13758 - DNA, 26 bp, synthetic construct
  misc_feature 1..26: note = Synthetic Construct
  source 1..26: mol_type = other DNA
caagtttactgcaatggtgagtcaag

SEQ ID NO: 13759 - DNA, 25 bp, synthetic construct
  misc_feature 1..25: note = Synthetic Construct
  source 1..25: mol_type = other DNA
cttgggaagcaatgaggcaaagaag

SEQ ID NO: 13760 - DNA, 23 bp, synthetic construct
  misc_feature 1..23: note = Synthetic Construct
  source 1..23: mol_type = other DNA
gctgcttgtcacactgtctctct

SEQ ID NO: 13761 - DNA, 21 bp, synthetic construct
  misc_feature 1..21: note = Synthetic Construct
  source 1..21: mol_type = other DNA
tgctacccttgtgaccaggaa

SEQ ID NO: 13762 - DNA, 22 bp, synthetic construct
  misc_feature 1..22: note = Synthetic Construct
  source 1..22: mol_type = other DNA
tgaggcccaggtgttgttctca

SEQ ID NO: 13763 - DNA, 22 bp, synthetic construct
  misc_feature 1..22: note = Synthetic Construct
  source 1..22: mol_type = other DNA
gccagttgctggctacagtgaa

SEQ ID NO: 13764 - DNA, 25 bp, synthetic construct
  misc_feature 1..25: note = Synthetic Construct
  source 1..25: mol_type = other DNA
ttccatctaaacatggcctcataca

SEQ ID NO: 13765 - DNA, 22 bp, synthetic construct
  misc_feature 1..22: note = Synthetic Construct
  source 1..22: mol_type = other DNA
gccctgctttctgcatctctgt

SEQ ID NO: 13766 - DNA, 20 bp, synthetic construct
  misc_feature 1..20: note = Synthetic Construct
  source 1..20: mol_type = other DNA
agcagcagcatccagcactt

SEQ ID NO: 13767 - DNA, 26 bp, synthetic construct
  misc_feature 1..26: note = Synthetic Construct
  source 1..26: mol_type = other DNA
cccttaagtagggacaggttggactt

SEQ ID NO: 13768 - DNA, 22 bp, synthetic construct
  misc_feature 1..22: note = Synthetic Construct
  source 1..22: mol_type = other DNA
caaaggctcaactttgcaccaa

SEQ ID NO: 13769 - DNA, 23 bp, synthetic construct
  misc_feature 1..23: note = Synthetic Construct
  source 1..23: mol_type = other DNA
cagagacaatgatggggctcttc

SEQ ID NO: 13770 - DNA, 18 bp, synthetic construct
  misc_feature 1..18: note = Synthetic Construct
  source 1..18: mol_type = other DNA
gccaggccactgtgtgat

SEQ ID NO: 13771 - DNA, 24 bp, synthetic construct
  misc_feature 1..24: note = Synthetic Construct
  source 1..24: mol_type = other DNA
ggtgtgagttttgttccctgacta

SEQ ID NO: 13772 - DNA, 21 bp, synthetic construct
  misc_feature 1..21: note = Synthetic Construct
  source 1..21: mol_type = other DNA
ggggcctttgggaaagacact

SEQ ID NO: 13773 - DNA, 27 bp, synthetic construct
  misc_feature 1..27: note = Synthetic Construct
  source 1..27: mol_type = other DNA
ccatgagttgagtgccttgtaaaatgt

SEQ ID NO: 13774 - DNA, 24 bp, synthetic construct
  misc_feature 1..24: note = Synthetic Construct
  source 1..24: mol_type = other DNA
gttggatgctggtactctcagcta

SEQ ID NO: 13775 - DNA, 27 bp, synthetic construct
  misc_feature 1..27: note = Synthetic Construct
  source 1..27: mol_type = other DNA
gacttacccaatagaagggtgagtaca

SEQ ID NO: 13776 - DNA, 22 bp, synthetic construct
  misc_feature 1..22: note = Synthetic Construct
  source 1..22: mol_type = other DNA
ctggcattgtggggacagtcaa

SEQ ID NO: 13777 - DNA, 24 bp, synthetic construct
  misc_feature 1..24: note = Synthetic Construct
  source 1..24: mol_type = other DNA
caccagtgggaagagactgagatg

SEQ ID NO: 13778 - DNA, 22 bp, synthetic construct
  misc_feature 1..22: note = Synthetic Construct
  source 1..22: mol_type = other DNA
ggtgtcgagatctctggccatt

SEQ ID NO: 13779 - DNA, 23 bp, synthetic construct
  misc_feature 1..23: note = Synthetic Construct
  source 1..23: mol_type = other DNA
gctggaggcaggttcacattttg

SEQ ID NO: 13780 - DNA, 22 bp, synthetic construct
  misc_feature 1..22: note = Synthetic Construct
  source 1..22: mol_type = other DNA
actccacccagcgtgtcctatt

SEQ ID NO: 13781 - DNA, 24 bp, synthetic construct
  misc_feature 1..24: note = Synthetic Construct
  source 1..24: mol_type = other DNA
gtataggaagtcactggtcagcaa

SEQ ID NO: 13782 - DNA, 26 bp, synthetic construct
  misc_feature 1..26: note = Synthetic Construct
  source 1..26: mol_type = other DNA
cagaccctaagtggcatttttgagaa

SEQ ID NO: 13783 - DNA, 26 bp, synthetic construct
  misc_feature 1..26: note = Synthetic Construct
  source 1..26: mol_type = other DNA
caacaggttccataggccagaattag

SEQ ID NO: 13784 - DNA, 23 bp, synthetic construct
  misc_feature 1..23: note = Synthetic Construct
  source 1..23: mol_type = other DNA
catccagctagcagacactgaag

SEQ ID NO: 13785 - DNA, 22 bp, synthetic construct
  misc_feature 1..22: note = Synthetic Construct
  source 1..22: mol_type = other DNA
tcagcttccatctcctgctttg

SEQ ID NO: 13786 - DNA, 23 bp, synthetic construct
  misc_feature 1..23: note = Synthetic Construct
  source 1..23: mol_type = other DNA
tccttttgctacctgagcttgtt

SEQ ID NO: 13787 - DNA, 24 bp, synthetic construct
  misc_feature 1..24: note = Synthetic Construct
  source 1..24: mol_type = other DNA
ggttgaagaaggggatgcgatgaa

SEQ ID NO: 13788 - DNA, 22 bp, synthetic construct
  misc_feature 1..22: note = Synthetic Construct
  source 1..22: mol_type = other DNA
gtgagccattacctgggtttga

SEQ ID NO: 13789 - DNA, 23 bp, synthetic construct
  misc_feature 1..23: note = Synthetic Construct
  source 1..23: mol_type = other DNA
tggattctggcaaatgcatgtct

SEQ ID NO: 13790 - DNA, 22 bp, synthetic construct
  misc_feature 1..22: note = Synthetic Construct
  source 1..22: mol_type = other DNA
ccagaaatagctcctgctccaa

SEQ ID NO: 13791 - DNA, 20 bp, synthetic construct
  misc_feature 1..20: note = Synthetic Construct
  source 1..20: mol_type = other DNA
aagtgagacgggtgccaact

SEQ ID NO: 13792 - DNA, 20 bp, synthetic construct
  misc_feature 1..20: note = Synthetic Construct
  source 1..20: mol_type = other DNA
tcctctctggccagtggttt

SEQ ID NO: 13793 - DNA, 20 bp, synthetic construct
  misc_feature 1..20: note = Synthetic Construct
  source 1..20: mol_type = other DNA
gccacagttcgggcttgact

SEQ ID NO: 13794 - DNA, 22 bp, synthetic construct
  misc_feature 1..22: note = Synthetic Construct
  source 1..22: mol_type = other DNA
ccttctggatcaccaggtcact

SEQ ID NO: 13795 - DNA, 20 bp, synthetic construct
  misc_feature 1..20: note = Synthetic Construct
  source 1..20: mol_type = other DNA
aagcatgccgagctgtggtt

SEQ ID NO: 13796 - DNA, 24 bp, synthetic construct
  misc_feature 1..24: note = Synthetic Construct
  source 1..24: mol_type = other DNA
cctggcagtgaaactatggggatt

SEQ ID NO: 13797 - DNA, 23 bp, synthetic construct
  misc_feature 1..23: note = Synthetic Construct
  source 1..23: mol_type = other DNA
cccgactaagtgtaagcactcaa

SEQ ID NO: 13798 - DNA, 24 bp, synthetic construct
  misc_feature 1..24: note = Synthetic Construct
  source 1..24: mol_type = other DNA
ccctgattatgccacaagtcatct

SEQ ID NO: 13799 - DNA, 22 bp, synthetic construct
  misc_feature 1..22: note = Synthetic Construct
  source 1..22: mol_type = other DNA
tggaagaaactgctgtgcaact

SEQ ID NO: 13800 - DNA, 24 bp, synthetic construct
  misc_feature 1..24: note = Synthetic Construct
  source 1..24: mol_type = other DNA
ctacagtttggatgtgaggcattg

SEQ ID NO: 13801 - DNA, 22 bp, synthetic construct
  misc_feature 1..22: note = Synthetic Construct
  source 1..22: mol_type = other DNA
ggaagcaaaggtctggttctga

SEQ ID NO: 13802 - DNA, 26 bp, synthetic construct
  misc_feature 1..26: note = Synthetic Construct
  source 1..26: mol_type = other DNA
gctttgcatatccctacttactgcat

SEQ ID NO: 13803 - DNA, 25 bp, synthetic construct
  misc_feature 1..25: note = Synthetic Construct
  source 1..25: mol_type = other DNA
cagcttgtaccctggtagggaaatg

SEQ ID NO: 13804 - DNA, 25 bp, synthetic construct
  misc_feature 1..25: note = Synthetic Construct
  source 1..25: mol_type = other DNA
ctctgactgccttgtctccatcttc

SEQ ID NO: 13805 - DNA, 21 bp, synthetic construct
  misc_feature 1..21: note = Synthetic Construct
  source 1..21: mol_type = other DNA
gggctgcaggaatacacaaca

SEQ ID NO: 13806 - DNA, 23 bp, synthetic construct
  misc_feature 1..23: note = Synthetic Construct
  source 1..23: mol_type = other DNA
cagggctttacaacacccctgaa

SEQ ID NO: 13807 - DNA, 21 bp, synthetic construct
  misc_feature 1..21: note = Synthetic Construct
  source 1..21: mol_type = other DNA
cctgcagcaagagcagtccta

SEQ ID NO: 13808 - DNA, 20 bp, synthetic construct
  misc_feature 1..20: note = Synthetic Construct
  source 1..20: mol_type = other DNA
ccattgggccctacggcttt

SEQ ID NO: 13809 - DNA, 23 bp, synthetic construct
  misc_feature 1..23: note = Synthetic Construct
  source 1..23: mol_type = other DNA
cctgcctccaagtgagaatcaga

SEQ ID NO: 13810 - DNA, 22 bp, synthetic construct
  misc_feature 1..22: note = Synthetic Construct
  source 1..22: mol_type = other DNA
gcccgccatggaattgatttct

SEQ ID NO: 13811 - DNA, 23 bp, synthetic construct
  misc_feature 1..23: note = Synthetic Construct
  source 1..23: mol_type = other DNA
gctggcgactctaaagccatctt

SEQ ID NO: 13812 - DNA, 20 bp, synthetic construct
  misc_feature 1..20: note = Synthetic Construct
  source 1..20: mol_type = other DNA
cccctgacatctgggagtga

SEQ ID NO: 13813 - DNA, 21 bp, synthetic construct
  misc_feature 1..21: note = Synthetic Construct
  source 1..21: mol_type = other DNA
gcactgtccccaaccctcaat

SEQ ID NO: 13814 - DNA, 23 bp, synthetic construct
  misc_feature 1..23: note = Synthetic Construct
  source 1..23: mol_type = other DNA
ggagccattgaatcacgttcaca

SEQ ID NO: 13815 - DNA, 22 bp, synthetic construct
  misc_feature 1..22: note = Synthetic Construct
  source 1..22: mol_type = other DNA
gagagacaggaaggaccactgt

SEQ ID NO: 13816 - DNA, 23 bp, synthetic construct
  misc_feature 1..23: note = Synthetic Construct
  source 1..23: mol_type = other DNA
agtaacttgccaagggtttctga

SEQ ID NO: 13817 - DNA, 21 bp, synthetic construct
  misc_feature 1..21: note = Synthetic Construct
  source 1..21: mol_type = other DNA
aggcaaacgtggatcccttac

SEQ ID NO: 13818 - DNA, 21 bp, synthetic construct
  misc_feature 1..21: note = Synthetic Construct
  source 1..21: mol_type = other DNA
gagtgtgagcccattgctgta

SEQ ID NO: 13819 - DNA, 22 bp, synthetic construct
  misc_feature 1..22: note = Synthetic Construct
  source 1..22: mol_type = other DNA
aagcaccagcatgcatgtgtaa

SEQ ID NO: 13820 - DNA, 24 bp, synthetic construct
  misc_feature 1..24: note = Synthetic Construct
  source 1..24: mol_type = other DNA
gacatcccaagaaggtctacaagt

SEQ ID NO: 13821 - DNA, 22 bp, synthetic construct
  misc_feature 1..22: note = Synthetic Construct
  source 1..22: mol_type = other DNA
cctgggtgagaccttcccttca

SEQ ID NO: 13822 - DNA, 21 bp, synthetic construct
  misc_feature 1..21: note = Synthetic Construct
  source 1..21: mol_type = other DNA
cccagcatggttccagagtca

SEQ ID NO: 13823 - DNA, 23 bp, synthetic construct
  misc_feature 1..23: note = Synthetic Construct
  source 1..23: mol_type = other DNA
aaccggaaaaggaagcatactca

SEQ ID NO: 13824 - DNA, 22 bp, synthetic construct
  misc_feature 1..22: note = Synthetic Construct
  source 1..22: mol_type = other DNA
gtgacactgccgtcatcattca

SEQ ID NO: 13825 - DNA, 22 bp, synthetic construct
  misc_feature 1..22: note = Synthetic Construct
  source 1..22: mol_type = other DNA
gacctttccaggaagagcttgt

SEQ ID NO: 13826 - DNA, 24 bp, synthetic construct
  misc_feature 1..24: note = Synthetic Construct
  source 1..24: mol_type = other DNA
agggccaggtagaggtaggagtta

SEQ ID NO: 13827 - DNA, 22 bp, synthetic construct
  misc_feature 1..22: note = Synthetic Construct
  source 1..22: mol_type = other DNA
cgtgcccagactgctgctttat

SEQ ID NO: 13828 - DNA, 24 bp, synthetic construct
  misc_feature 1..24: note = Synthetic Construct
  source 1..24: mol_type = other DNA
ccagctctttctctcgatctttgt

SEQ ID NO: 13829 - DNA, 25 bp, synthetic construct
  misc_feature 1..25: note = Synthetic Construct
  source 1..25: mol_type = other DNA
ctatcagattgcttgctgtttgctt

SEQ ID NO: 13830 - DNA, 24 bp, synthetic construct
  misc_feature 1..24: note = Synthetic Construct
  source 1..24: mol_type = other DNA
gtcagggccttacattctcgacat

SEQ ID NO: 13831 - DNA, 22 bp, synthetic construct
  misc_feature 1..22: note = Synthetic Construct
  source 1..22: mol_type = other DNA
cacctctaggcatccccacaaa

SEQ ID NO: 13832 - DNA, 24 bp, synthetic construct
  misc_feature 1..24: note = Synthetic Construct
  source 1..24: mol_type = other DNA
gagccacaagcgataactttgaac

SEQ ID NO: 13833 - DNA, 20 bp, synthetic construct
  misc_feature 1..20: note = Synthetic Construct
  source 1..20: mol_type = other DNA
cagccacactcctcatgctt

SEQ ID NO: 13834 - DNA, 24 bp, synthetic construct
  misc_feature 1..24: note = Synthetic Construct
  source 1..24: mol_type = other DNA
gtccaggcttgatttcctcagtct

SEQ ID NO: 13835 - DNA, 22 bp, synthetic construct
  misc_feature 1..22: note = Synthetic Construct
  source 1..22: mol_type = other DNA
ccctgtttcctgctgccttgat

SEQ ID NO: 13836 - DNA, 21 bp, synthetic construct
  misc_feature 1..21: note = Synthetic Construct
  source 1..21: mol_type = other DNA
aagccaactcaactcgctgta

SEQ ID NO: 13837 - DNA, 22 bp, synthetic construct
  misc_feature 1..22: note = Synthetic Construct
  source 1..22: mol_type = other DNA
cctgatggaagcatgggaatgt

SEQ ID NO: 13838 - DNA, 22 bp, synthetic construct
  misc_feature 1..22: note = Synthetic Construct
  source 1..22: mol_type = other DNA
tgtggctaagacgtctgtgttg

SEQ ID NO: 13839 - DNA, 21 bp, synthetic construct
  misc_feature 1..21: note = Synthetic Construct
  source 1..21: mol_type = other DNA
atggtcacctggaccgtgctt

SEQ ID NO: 13840 - DNA, 21 bp, synthetic construct
  misc_feature 1..21: note = Synthetic Construct
  source 1..21: mol_type = other DNA
aactgggttctttgcctgtca

SEQ ID NO: 13841 - DNA, 20 bp, synthetic construct
  misc_feature 1..20: note = Synthetic Construct
  source 1..20: mol_type = other DNA
ccaccatgcccagctagaaa

SEQ ID NO: 13842 - DNA, 22 bp, synthetic construct
  misc_feature 1..22: note = Synthetic Construct
  source 1..22: mol_type = other DNA
aggccaggccaattcttaccta

SEQ ID NO: 13843 - DNA, 23 bp, synthetic construct
  misc_feature 1..23: note = Synthetic Construct
  source 1..23: mol_type = other DNA
gcaccatggtaggtgttgaggat

SEQ ID NO: 13844 - DNA, 22 bp, synthetic construct
  misc_feature 1..22: note = Synthetic Construct
  source 1..22: mol_type = other DNA
aagtcaaggctgggtaggtaga

SEQ ID NO: 13845 - DNA, 22 bp, synthetic construct
  misc_feature 1..22: note = Synthetic Construct
  source 1..22: mol_type = other DNA
cagctactgggaggtggtttct

SEQ ID NO: 13846 - DNA, 23 bp, synthetic construct
  misc_feature 1..23: note = Synthetic Construct
  source 1..23: mol_type = other DNA
cacccactcaccaagcctagttc

SEQ ID NO: 13847 - DNA, 21 bp, synthetic construct
  misc_feature 1..21: note = Synthetic Construct
  source 1..21: mol_type = other DNA
tgtcctgcggcctcctaagtt

SEQ ID NO: 13848 - DNA, 19 bp, synthetic construct
  misc_feature 1..19: note = Synthetic Construct
  source 1..19: mol_type = other DNA
agccccagttgctcacagt

SEQ ID NO: 13849 - DNA, 24 bp, synthetic construct
  misc_feature 1..24: note = Synthetic Construct
  source 1..24: mol_type = other DNA
ctgtttactcagaggcacttgcta

SEQ ID NO: 13850 - DNA, 24 bp, synthetic construct
  misc_feature 1..24: note = Synthetic Construct
  source 1..24: mol_type = other DNA
gtttcaggggttaggtgacagtct

SEQ ID NO: 13851 - DNA, 23 bp, synthetic construct
  misc_feature 1..23: note = Synthetic Construct
  source 1..23: mol_type = other DNA
cccctgaacccaatttgcagaga

SEQ ID NO: 13852 - DNA, 21 bp, synthetic construct
  misc_feature 1..21: note = Synthetic Construct
  source 1..21: mol_type = other DNA
tgagaaaggggccacccatca

SEQ ID NO: 13853 - DNA, 21 bp, synthetic construct
  misc_feature 1..21: note = Synthetic Construct
  source 1..21: mol_type = other DNA
gtggagattccgccaggtgtt

SEQ ID NO: 13854 - DNA, 19 bp, synthetic construct
  misc_feature 1..19: note = Synthetic Construct
  source 1..19: mol_type = other DNA
acctccaacgccgaacact

SEQ ID NO: 13855 - DNA, 22 bp, synthetic construct
  misc_feature 1..22: note = Synthetic Construct
  source 1..22: mol_type = other DNA
gtcagctccacctgggtctttt

SEQ ID NO: 13856 - DNA, 22 bp, synthetic construct
  misc_feature 1..22: note = Synthetic Construct
  source 1..22: mol_type = other DNA
tgcttaggccatttgccatttc

SEQ ID NO: 13857 - DNA, 21 bp, synthetic construct
  misc_feature 1..21: note = Synthetic Construct
  source 1..21: mol_type = other DNA
cttgagagtggccttggaagt

SEQ ID NO: 13858 - DNA, 22 bp, synthetic construct
  misc_feature 1..22: note = Synthetic Construct
  source 1..22: mol_type = other DNA
ccctcgcacatggctgaagaat

SEQ ID NO: 13859 - DNA, 19 bp, synthetic construct
  misc_feature 1..19: note = Synthetic Construct
  source 1..19: mol_type = other DNA
tctgggcgatttggcagtt

SEQ ID NO: 13860 - DNA, 20 bp, synthetic construct
  misc_feature 1..20: note = Synthetic Construct
  source 1..20: mol_type = other DNA
gcatgcccatgctcctgtgt

SEQ ID NO: 13861 - DNA, 23 bp, synthetic construct
  misc_feature 1..23: note = Synthetic Construct
  source 1..23: mol_type = other DNA
ggataccatggctttaggcaagt

SEQ ID NO: 13862 - DNA, 24 bp, synthetic construct
  misc_feature 1..24: note = Synthetic Construct
  source 1..24: mol_type = other DNA
gctgtctgcttagggttggtctct

SEQ ID NO: 13863 - DNA, 24 bp, synthetic construct
  misc_feature 1..24: note = Synthetic Construct
  source 1..24: mol_type = other DNA
gacacagctaaagccccattaaac

SEQ ID NO: 13864 - DNA, 22 bp, synthetic construct
  misc_feature 1..22: note = Synthetic Construct
  source 1..22: mol_type = other DNA
ggtttcccgcctcacagattga

SEQ ID NO: 13865 - DNA, 20 bp, synthetic construct
  misc_feature 1..20: note = Synthetic Construct
  source 1..20: mol_type = other DNA
tgtgacgatggcctcagttc

SEQ ID NO: 13866 - DNA, 23 bp, synthetic construct
  misc_feature 1..23: note = Synthetic Construct
  source 1..23: mol_type = other DNA
gggctccactacttactgggtta

SEQ ID NO: 13867 - DNA, 23 bp, synthetic construct
  misc_feature 1..23: note = Synthetic Construct
  source 1..23: mol_type = other DNA
gggtcccggagttagtaatgttg

SEQ ID NO: 13868 - DNA, 23 bp, synthetic construct
  misc_feature 1..23: note = Synthetic Construct
  source 1..23: mol_type = other DNA
ttggacctcaccttctggttttt

SEQ ID NO: 13869 - DNA, 25 bp, synthetic construct
  misc_feature 1..25: note = Synthetic Construct
  source 1..25: mol_type = other DNA
cctctgctaaaatgcactcccttca

SEQ ID NO: 13870 - DNA, 21 bp, synthetic construct
  misc_feature 1..21: note = Synthetic Construct
  source 1..21: mol_type = other DNA
gcctgtgggagtcaggtgaga

SEQ ID NO: 13871 - DNA, 21 bp, synthetic construct
  misc_feature 1..21: note = Synthetic Construct
  source 1..21: mol_type = other DNA
ttcatccccacctccccatca

SEQ ID NO: 13872 - DNA, 21 bp, synthetic construct
  misc_feature 1..21: note = Synthetic Construct
  source 1..21: mol_type = other DNA
ggcctgttgttaggcatgcaa

SEQ ID NO: 13873 - DNA, 20 bp, synthetic construct
  misc_feature 1..20: note = Synthetic Construct
  source 1..20: mol_type = other DNA
ccaggggcctgaacatcttt

SEQ ID NO: 13874 - DNA, 25 bp, synthetic construct
  misc_feature 1..25: note = Synthetic Construct
  source 1..25: mol_type = other DNA
ggtgatagcaaggccagaggttctt

SEQ ID NO: 13875 - DNA, 26 bp, synthetic construct
  misc_feature 1..26: note = Synthetic Construct
  source 1..26: mol_type = other DNA
ccaaatgacttggaacaggagtttga

SEQ ID NO: 13876 - DNA, 22 bp, synthetic construct
  misc_feature 1..22: note = Synthetic Construct
  source 1..22: mol_type = other DNA
ccagccctgattctggcattga

SEQ ID NO: 13877 - DNA, 22 bp, synthetic construct
  misc_feature 1..22: note = Synthetic Construct
  source 1..22: mol_type = other DNA
gggcctcaaagctgcctttatc

SEQ ID NO: 13878 - DNA, 22 bp, synthetic construct
  misc_feature 1..22: note = Synthetic Construct
  source 1..22: mol_type = other DNA
gcttctggaagccttcgctaac

SEQ ID NO: 13879 - DNA, 23 bp, synthetic construct
  misc_feature 1..23: note = Synthetic Construct
  source 1..23: mol_type = other DNA
ggtctggtgcagtatcaccacta

SEQ ID NO: 13880 - DNA, 18 bp, synthetic construct
  misc_feature 1..18: note = Synthetic Construct
  source 1..18: mol_type = other DNA
tcagcagcccctggtgat

SEQ ID NO: 13881 - DNA, 21 bp, synthetic construct
  misc_feature 1..21: note = Synthetic Construct
  source 1..21: mol_type = other DNA
tgctggtggattggctctact

SEQ ID NO: 13882 - DNA, 22 bp, synthetic construct
  misc_feature 1..22: note = Synthetic Construct
  source 1..22: mol_type = other DNA
agcattagcactgtgaggcttt

SEQ ID NO: 13883 - DNA, 25 bp, synthetic construct
  misc_feature 1..25: note = Synthetic Construct
  source 1..25: mol_type = other DNA
cctggaatctcaggataacaaggaa

SEQ ID NO: 13884 - DNA, 22 bp, synthetic construct
  misc_feature 1..22: note = Synthetic Construct
  source 1..22: mol_type = other DNA
cacaagtcctgcccttgtccat

SEQ ID NO: 13885 - DNA, 22 bp, synthetic construct
  misc_feature 1..22: note = Synthetic Construct
  source 1..22: mol_type = other DNA
aacttcctggactgcaaagtca

SEQ ID NO: 13886 - DNA, 22 bp, synthetic construct
  misc_feature 1..22: note = Synthetic Construct
  source 1..22: mol_type = other DNA
tggtccaattcagggccactct

SEQ ID NO: 13887 - DNA, 22 bp, synthetic construct
  misc_feature 1..22: note = Synthetic Construct
  source 1..22: mol_type = other DNA
gcaaatactgccagaacagcaa

SEQ ID NO: 13888 - DNA, 19 bp, synthetic construct
  misc_feature 1..19: note = Synthetic Construct
  source 1..19: mol_type = other DNA
agctggccttggcacttgt

SEQ ID NO: 13889 - DNA, 21 bp, synthetic construct
  misc_feature 1..21: note = Synthetic Construct
  source 1..21: mol_type = other DNA
ggtgtcttgcaagcaggtgtt

SEQ ID NO: 13890 - DNA, 20 bp, synthetic construct
  misc_feature 1..20: note = Synthetic Construct
  source 1..20: mol_type = other DNA
cccagcaccggtgagtgttt

SEQ ID NO: 13891 - DNA, 24 bp, synthetic construct
  misc_feature 1..24: note = Synthetic Construct
  source 1..24: mol_type = other DNA
gctcttgcctactacaaggtcatc

SEQ ID NO: 13892 - DNA, 20 bp, synthetic construct
  misc_feature 1..20: note = Synthetic Construct
  source 1..20: mol_type = other DNA
acgcagcagtaagcgtgcat

SEQ ID NO: 13893 - DNA, 25 bp, synthetic construct
  misc_feature 1..25: note = Synthetic Construct
  source 1..25: mol_type = other DNA
ctccctacaccaaaacagaggatac

SEQ ID NO: 13894 - DNA, 24 bp, synthetic construct
  misc_feature 1..24: note = Synthetic Construct
  source 1..24: mol_type = other DNA
tgatgagaggtgttgagtgcatta

SEQ ID NO: 13895 - DNA, 23 bp, synthetic construct
  misc_feature 1..23: note = Synthetic Construct
  source 1..23: mol_type = other DNA
tgggtgcaaaatcactgagtagt

SEQ ID NO: 13896 - DNA, 20 bp, synthetic construct
  misc_feature 1..20: note = Synthetic Construct
  source 1..20: mol_type = other DNA
tgcgctggtgtcactgatgt

SEQ ID NO: 13897 - DNA, 23 bp, synthetic construct
  misc_feature 1..23: note = Synthetic Construct
  source 1..23: mol_type = other DNA
tgtctgacctgaaatcacagcat

SEQ ID NO: 13898 - DNA, 26 bp, synthetic construct
  misc_feature 1..26: note = Synthetic Construct
  source 1..26: mol_type = other DNA
gccatggatttaatggaaaggtgtgt

SEQ ID NO: 13899 - DNA, 21 bp, synthetic construct
  misc_feature 1..21: note = Synthetic Construct
  source 1..21: mol_type = other DNA
cgcacatagttgctgctgttg

SEQ ID NO: 13900 - DNA, 24 bp, synthetic construct
  misc_feature 1..24: note = Synthetic Construct
  source 1..24: mol_type = other DNA
ggctcctgggttgattaaatctga

SEQ ID NO: 13901 - DNA, 23 bp, synthetic construct
  misc_feature 1..23: note = Synthetic Construct
  source 1..23: mol_type = other DNA
cccagaaacaattcccgttggtt

SEQ ID NO: 13902 - DNA, 18 bp, synthetic construct
  misc_feature 1..18: note = Synthetic Construct
  source 1..18: mol_type = other DNA
tccagcatgcccgcttgt

SEQ ID NO: 13903 - DNA, 20 bp, synthetic construct
  misc_feature 1..20: note = Synthetic Construct
  source 1..20: mol_type = other DNA
tgccacgcaacccttcttgt

SEQ ID NO: 13904 - DNA, 22 bp, synthetic construct
  misc_feature 1..22: note = Synthetic Construct
  source 1..22: mol_type = other DNA
gtgccgggtgctttccctataa

SEQ ID NO: 13905 - DNA, 20 bp, synthetic construct
  misc_feature 1..20: note = Synthetic Construct
  source 1..20: mol_type = other DNA
tgtgtccgggcagagacttg

SEQ ID NO: 13906 - DNA, 26 bp, synthetic construct
  misc_feature 1..26: note = Synthetic Construct
  source 1..26: mol_type = other DNA
ggtagcaaagcctcaaagaatccaaa

SEQ ID NO: 13907 - DNA, 21 bp, synthetic construct
  misc_feature 1..21: note = Synthetic Construct
  source 1..21: mol_type = other DNA
tgtggacagattggcccaaag

SEQ ID NO: 13908 - DNA, 24 bp, synthetic construct
  misc_feature 1..24: note = Synthetic Construct
  source 1..24: mol_type = other DNA
ggctggatcaaccagtcctttttc

SEQ ID NO: 13909 - DNA, 24 bp, synthetic construct
  misc_feature 1..24: note = Synthetic Construct
  source 1..24: mol_type = other DNA
gagaagatccacggactctgttca

SEQ ID NO: 13910 - DNA, 22 bp, synthetic construct
  misc_feature 1..22: note = Synthetic Construct
  source 1..22: mol_type = other DNA
aggtgctgctgattgagttctt

SEQ ID NO: 13911 - DNA, 21 bp, synthetic construct
  misc_feature 1..21: note = Synthetic Construct
  source 1..21: mol_type = other DNA
tccaagacaagggagccagaa

SEQ ID NO: 13912 - DNA, 23 bp, synthetic construct
  misc_feature 1..23: note = Synthetic Construct
  source 1..23: mol_type = other DNA
acagccctaaatgaggacctgta

SEQ ID NO: 13913 - DNA, 24 bp, synthetic construct
  misc_feature 1..24: note = Synthetic Construct
  source 1..24: mol_type = other DNA
gggaacttctttctcactcacact

SEQ ID NO: 13914 - DNA, 25 bp, synthetic construct
  misc_feature 1..25: note = Synthetic Construct
  source 1..25: mol_type = other DNA
ctctcttggaagttcggtggatttg

SEQ ID NO: 13915 - DNA, 23 bp, synthetic construct
  misc_feature 1..23: note = Synthetic Construct
  source 1..23: mol_type = other DNA
ggtgcattccttctccccatttg

SEQ ID NO: 13916 - DNA, 20 bp, synthetic construct
  misc_feature 1..20: note = Synthetic Construct
  source 1..20: mol_type = other DNA
tgtcaacagcagcacacact

SEQ ID NO: 13917 - DNA, 22 bp, synthetic construct
  misc_feature 1..22: note = Synthetic Construct
  source 1..22: mol_type = other DNA
gagcgaggctgtcactaacgaa

SEQ ID NO: 13918 - DNA, 23 bp, synthetic construct
  misc_feature 1..23: note = Synthetic Construct
  source 1..23: mol_type = other DNA
ccagggctttcagtgcaaataac

SEQ ID NO: 13919 - DNA, 21 bp, synthetic construct
  misc_feature 1..21: note = Synthetic Construct
  source 1..21: mol_type = other DNA
ggccctgccaaattcctcaga

SEQ ID NO: 13920 - DNA, 21 bp, synthetic construct
  misc_feature 1..21: note = Synthetic Construct
  source 1..21: mol_type = other DNA
tggggccagcagaattacttg

SEQ ID NO: 13921 - DNA, 19 bp, synthetic construct
  misc_feature 1..19: note = Synthetic Construct
  source 1..19: mol_type = other DNA
atgacccgggagggcaaag

SEQ ID NO: 13922 - DNA, 24 bp, synthetic construct
  misc_feature 1..24: note = Synthetic Construct
  source 1..24: mol_type = other DNA
gcaaaagcaggactaacaccacat

SEQ ID NO: 13923 - DNA, 19 bp, synthetic construct
  misc_feature 1..19: note = Synthetic Construct
  source 1..19: mol_type = other DNA
tggcggatgggagggcatt

SEQ ID NO: 13924 - DNA, 24 bp, synthetic construct
  misc_feature 1..24: note = Synthetic Construct
  source 1..24: mol_type = other DNA
gtgacgcaaacatcagcactcttc

SEQ ID NO: 13925 - DNA, 22 bp, synthetic construct
  misc_feature 1..22: note = Synthetic Construct
  source 1..22: mol_type = other DNA
cctgtggggatttgagggttct

SEQ ID NO: 13926 - DNA, 25 bp, synthetic construct
  misc_feature 1..25: note = Synthetic Construct
  source 1..25: mol_type = other DNA
gggatcttgggttaaaatgcaaaca

SEQ ID NO: 13927 - DNA, 23 bp, synthetic construct
  misc_feature 1..23: note = Synthetic Construct
  source 1..23: mol_type = other DNA
gcctccagaaaaacttgccatca

SEQ ID NO: 13928 - DNA, 24 bp, synthetic construct
  misc_feature 1..24: note = Synthetic Construct
  source 1..24: mol_type = other DNA
ggccacctgggaatagtttagtct

SEQ ID NO: 13929 - DNA, 26 bp, synthetic construct
  misc_feature 1..26: note = Synthetic Construct
  source 1..26: mol_type = other DNA
gggccagagagttttgaataacaaag

SEQ ID NO: 13930 - DNA, 24 bp, synthetic construct
  misc_feature 1..24: note = Synthetic Construct
  source 1..24: mol_type = other DNA
ccccagattctcagcttcatctct

SEQ ID NO: 13931 - DNA, 22 bp, synthetic construct
  misc_feature 1..22: note = Synthetic Construct
  source 1..22: mol_type = other DNA
gctaaagaagctgggccgctaa

SEQ ID NO: 13932 - DNA, 23 bp, synthetic construct
  misc_feature 1..23: note = Synthetic Construct
  source 1..23: mol_type = other DNA
gccaagtggcagtgaaaagaaga

SEQ ID NO: 13933 - DNA, 23 bp, synthetic construct
  misc_feature 1..23: note = Synthetic Construct
  source 1..23: mol_type = other DNA
ttggagcttgcttcccatttttc

SEQ ID NO: 13934 - DNA, 23 bp, synthetic construct
  misc_feature 1..23: note = Synthetic Construct
  source 1..23: mol_type = other DNA
ctcggatccatccagcaatgagt

SEQ ID NO: 13935 - DNA, 24 bp, synthetic construct
  misc_feature 1..24: note = Synthetic Construct
  source 1..24: mol_type = other DNA
tgagaatcagggtcaaacttggaa

SEQ ID NO: 13936 - DNA, 23 bp, synthetic construct
  misc_feature 1..23: note = Synthetic Construct
  source 1..23: mol_type = other DNA
ctattaagatgggctggcagtca

SEQ ID NO: 13937 - DNA, 26 bp, synthetic construct
  misc_feature 1..26: note = Synthetic Construct
  source 1..26: mol_type = other DNA
cccctcttattatacaggagccttac

SEQ ID NO: 13938 - DNA, 22 bp, synthetic construct
  misc_feature 1..22: note = Synthetic Construct
  source 1..22: mol_type = other DNA
tctccaatgaccgggtgacaag

SEQ ID NO: 13939 - DNA, 24 bp, synthetic construct
  misc_feature 1..24: note = Synthetic Construct
  source 1..24: mol_type = other DNA
cttgactccctctggatcacattg

SEQ ID NO: 13940 - DNA, 20 bp, synthetic construct
  misc_feature 1..20: note = Synthetic Construct
  source 1..20: mol_type = other DNA
cgtgagatgcgccaatgcaa

SEQ ID NO: 13941 - DNA, 23 bp, synthetic construct
  misc_feature 1..23: note = Synthetic Construct
  source 1..23: mol_type = other DNA
ccacaaacacatgccacgaaaag

SEQ ID NO: 13942 - DNA, 21 bp, synthetic construct
  misc_feature 1..21: note = Synthetic Construct
  source 1..21: mol_type = other DNA
gcttcctttcacggcatcaga

SEQ ID NO: 13943 - DNA, 20 bp, synthetic construct
  misc_feature 1..20: note = Synthetic Construct
  source 1..20: mol_type = other DNA
cgtcccaggacaagttgaca

SEQ ID NO: 13944 - DNA, 23 bp, synthetic construct
  misc_feature 1..23: note = Synthetic Construct
  source 1..23: mol_type = other DNA
ccacgtttgtgtaggatggaatg

SEQ ID NO: 13945 - DNA, 20 bp, synthetic construct
  misc_feature 1..20: note = Synthetic Construct
  source 1..20: mol_type = other DNA
accgttcagcttccctcctt

SEQ ID NO: 13946 - DNA, 22 bp, synthetic construct
  misc_feature 1..22: note = Synthetic Construct
  source 1..22: mol_type = other DNA
actctcccttcagactgggaat

SEQ ID NO: 13947 - DNA, 20 bp, synthetic construct
  misc_feature 1..20: note = Synthetic Construct
  source 1..20: mol_type = other DNA
cagccaaccttgacctgtga

SEQ ID NO: 13948 - DNA, 19 bp, synthetic construct
  misc_feature 1..19: note = Synthetic Construct
  source 1..19: mol_type = other DNA
acagcgcacgtgccattca

SEQ ID NO: 13949 - DNA, 26 bp, synthetic construct
  misc_feature 1..26: note = Synthetic Construct
  source 1..26: mol_type = other DNA
gctacccaacacctaggagaaattca

SEQ ID NO: 13950 - DNA, 20 bp, synthetic construct
  misc_feature 1..20: note = Synthetic Construct
  source 1..20: mol_type = other DNA
gaccacaagggtgacagcaa

SEQ ID NO: 13951 - DNA, 19 bp, synthetic construct
  misc_feature 1..19: note = Synthetic Construct
  source 1..19: mol_type = other DNA
caatgccctcccgcagaca

SEQ ID NO: 13952 - DNA, 24 bp, synthetic construct
  misc_feature 1..24: note = Synthetic Construct
  source 1..24: mol_type = other DNA
ggagcacaaaatgtgtgacaaaga

SEQ ID NO: 13953 - DNA, 24 bp, synthetic construct
  misc_feature 1..24: note = Synthetic Construct
  source 1..24: mol_type = other DNA
gggcagcgatggtagttacctaaa

SEQ ID NO: 13954 - DNA, 24 bp, synthetic construct
  misc_feature 1..24: note = Synthetic Construct
  source 1..24: mol_type = other DNA
cagggcaacgaaagttaccttcta

SEQ ID NO: 13955 - DNA, 22 bp, synthetic construct
  misc_feature 1..22: note = Synthetic Construct
  source 1..22: mol_type = other DNA
tctctggcttccaaggtctcaa

SEQ ID NO: 13956 - DNA, 24 bp, synthetic construct
  misc_feature 1..24: note = Synthetic Construct
  source 1..24: mol_type = other DNA
gtgactgagccacaagtgatgaag

SEQ ID NO: 13957 - DNA, 20 bp, synthetic construct
  misc_feature 1..20: note = Synthetic Construct
  source 1..20: mol_type = other DNA
gcctcacttgccttgtcaga

SEQ ID NO: 13958 - DNA, 20 bp, synthetic construct
  misc_feature 1..20: note = Synthetic Construct
  source 1..20: mol_type = other DNA
gacctgctcactgcagaaca

SEQ ID NO: 13959 - DNA, 21 bp, synthetic construct
  misc_feature 1..21: note = Synthetic Construct
  source 1..21: mol_type = other DNA
cgtgaagcccctctactgact

SEQ ID NO: 13960 - DNA, 21 bp, synthetic construct
  misc_feature 1..21: note = Synthetic Construct
  source 1..21: mol_type = other DNA
cgaccttcaccttcaccactt

SEQ ID NO: 13961 - DNA, 25 bp, synthetic construct
  misc_feature 1..25: note = Synthetic Construct
  source 1..25: mol_type = other DNA
gtcatgaaactgaattccagccaat

SEQ ID NO: 13962 - DNA, 22 bp, synthetic construct
  misc_feature 1..22: note = Synthetic Construct
  source 1..22: mol_type = other DNA
ggctctctgtgaggtaggattg

SEQ ID NO: 13963 - DNA, 21 bp, synthetic construct
  misc_feature 1..21: note = Synthetic Construct
  source 1..21: mol_type = other DNA
ctagggcctggagaagtccat

SEQ ID NO: 13964 - DNA, 23 bp, synthetic construct
  misc_feature 1..23: note = Synthetic Construct
  source 1..23: mol_type = other DNA
gctgatctgtcagtgtgcgttag

SEQ ID NO: 13965 - DNA, 20 bp, synthetic construct
  misc_feature 1..20: note = Synthetic Construct
  source 1..20: mol_type = other DNA
aggccggggcatagcgagaa

SEQ ID NO: 13966 - DNA, 23 bp, synthetic construct
  misc_feature 1..23: note = Synthetic Construct
  source 1..23: mol_type = other DNA
agcagtaaaaggagcaggtttga

SEQ ID NO: 13967 - DNA, 21 bp, synthetic construct
  misc_feature 1..21: note = Synthetic Construct
  source 1..21: mol_type = other DNA
caggtgtgagtggagcgttag

SEQ ID NO: 13968 - DNA, 22 bp, synthetic construct
  misc_feature 1..22: note = Synthetic Construct
  source 1..22: mol_type = other DNA
cggcagttgctagggctaagat

SEQ ID NO: 13969 - DNA, 22 bp, synthetic construct
  misc_feature 1..22: note = Synthetic Construct
  source 1..22: mol_type = other DNA
ggcttggaaggcaggaggtttt

SEQ ID NO: 13970 - DNA, 22 bp, synthetic construct
  misc_feature 1..22: note = Synthetic Construct
  source 1..22: mol_type = other DNA
gagttgcttggtagggctggaa

SEQ ID NO: 13971 - DNA, 25 bp, synthetic construct
  misc_feature 1..25: note = Synthetic Construct
  source 1..25: mol_type = other DNA
ccagataggccatcttcctcctgtt

SEQ ID NO: 13972 - DNA, 25 bp, synthetic construct
  misc_feature 1..25: note = Synthetic Construct
  source 1..25: mol_type = other DNA
ccgtgtgttttcccaaatgctttct

SEQ ID NO: 13973 - DNA, 26 bp, synthetic construct
  misc_feature 1..26: note = Synthetic Construct
  source 1..26: mol_type = other DNA
gctctgaaggctacaaggatgagtag

SEQ ID NO: 13974 - DNA, 23 bp, synthetic construct
  misc_feature 1..23: note = Synthetic Construct
  source 1..23: mol_type = other DNA
ggtgaagggaagatcccatctga

SEQ ID NO: 13975 - DNA, 23 bp, synthetic construct
  misc_feature 1..23: note = Synthetic Construct
  source 1..23: mol_type = other DNA
ctgctcaaggcatttcacaagtt

SEQ ID NO: 13976 - DNA, 23 bp, synthetic construct
  misc_feature 1..23: note = Synthetic Construct
  source 1..23: mol_type = other DNA
gaaggcggtgtaagcatgttaag

SEQ ID NO: 13977 - DNA, 23 bp, synthetic construct
  misc_feature 1..23: note = Synthetic Construct
  source 1..23: mol_type = other DNA
tgagggatgtgtctgatgagcta

SEQ ID NO: 13978 - DNA, 23 bp, synthetic construct
  misc_feature 1..23: note = Synthetic Construct
  source 1..23: mol_type = other DNA
ggtggtaggatgtgctgtattga

SEQ ID NO: 13979 - DNA, 24 bp, synthetic construct
  misc_feature 1..24: note = Synthetic Construct
  source 1..24: mol_type = other DNA
gctcctgccaaacttgtaaaacat

SEQ ID NO: 13980 - DNA, 22 bp, synthetic construct
  misc_feature 1..22: note = Synthetic Construct
  source 1..22: mol_type = other DNA
cccagcatctttgtgaggagaa

SEQ ID NO: 13981 - DNA, 22 bp, synthetic construct
  misc_feature 1..22: note = Synthetic Construct
  source 1..22: mol_type = other DNA
ggcttgccgtttggaaaacaac

SEQ ID NO: 13982 - DNA, 18 bp, synthetic construct
  misc_feature 1..18: note = Synthetic Construct
  source 1..18: mol_type = other DNA
acctgcgggaggtgaaca

SEQ ID NO: 13983 - DNA, 23 bp, synthetic construct
  misc_feature 1..23: note = Synthetic Construct
  source 1..23: mol_type = other DNA
gtctgcatcccctacaattcaca

SEQ ID NO: 13984 - DNA, 19 bp, synthetic construct
  misc_feature 1..19: note = Synthetic Construct
  source 1..19: mol_type = other DNA
ctgcgggctgcagtaagaa

SEQ ID NO: 13985 - DNA, 22 bp, synthetic construct
  misc_feature 1..22: note = Synthetic Construct
  source 1..22: mol_type = other DNA
tcactactcctgggccactttt

SEQ ID NO: 13986 - DNA, 23 bp, synthetic construct
  misc_feature 1..23: note = Synthetic Construct
  source 1..23: mol_type = other DNA
ggctcccttgagttgtgggttag

SEQ ID NO: 13987 - DNA, 21 bp, synthetic construct
  misc_feature 1..21: note = Synthetic Construct
  source 1..21: mol_type = other DNA
tggccagtatgcgagtgattt

SEQ ID NO: 13988 - DNA, 23 bp, synthetic construct
  misc_feature 1..23: note = Synthetic Construct
  source 1..23: mol_type = other DNA
caggatagcagaatggctgagat

SEQ ID NO: 13989 - DNA, 24 bp, synthetic construct
  misc_feature 1..24: note = Synthetic Construct
  source 1..24: mol_type = other DNA
gccattggcgcgttaattatcagt

SEQ ID NO: 13990 - DNA, 24 bp, synthetic construct
  misc_feature 1..24: note = Synthetic Construct
  source 1..24: mol_type = other DNA
cacagcaagaaaggtgagttcaag

SEQ ID NO: 13991 - DNA, 22 bp, synthetic construct
  misc_feature 1..22: note = Synthetic Construct
  source 1..22: mol_type = other DNA
cagctacatctcaaccgcaaag

SEQ ID NO: 13992 - DNA, 20 bp, synthetic construct
  misc_feature 1..20: note = Synthetic Construct
  source 1..20: mol_type = other DNA
aacccgactgacacctggat

SEQ ID NO: 13993 - DNA, 25 bp, synthetic construct
  misc_feature 1..25: note = Synthetic Construct
  source 1..25: mol_type = other DNA
cccagggaaataggagtgaggagaa

SEQ ID NO: 13994 - DNA, 21 bp, synthetic construct
  misc_feature 1..21: note = Synthetic Construct
  source 1..21: mol_type = other DNA
gtggcgttgttacctctcctt

SEQ ID NO: 13995 - DNA, 23 bp, synthetic construct
  misc_feature 1..23: note = Synthetic Construct
  source 1..23: mol_type = other DNA
gggtccttcctgtagggagagtt

SEQ ID NO: 13996 - DNA, 23 bp, synthetic construct
  misc_feature 1..23: note = Synthetic Construct
  source 1..23: mol_type = other DNA
gcgcagttacacaggcttccatt

SEQ ID NO: 13997 - DNA, 18 bp, synthetic construct
  misc_feature 1..18: note = Synthetic Construct
  source 1..18: mol_type = other DNA
ttgacacaggccgtgctt

SEQ ID NO: 13998 - DNA, 22 bp, synthetic construct
  misc_feature 1..22: note = Synthetic Construct
  source 1..22: mol_type = other DNA
gggagtatgggtggagcacttc

SEQ ID NO: 13999 - DNA, 23 bp, synthetic construct
  misc_feature 1..23: note = Synthetic Construct
  source 1..23: mol_type = other DNA
agagccagcaaaatatggggaat

SEQ ID NO: 14000 - DNA, 22 bp, synthetic construct
  misc_feature 1..22: note = Synthetic Construct
  source 1..22: mol_type = other DNA
gccacagctgttctctccttct

SEQ ID NO: 14001 - DNA, 22 bp, synthetic construct
  misc_feature 1..22: note = Synthetic Construct
  source 1..22: mol_type = other DNA
ggctggaaactccactgccatt

SEQ ID NO: 14002 - DNA, 21 bp, synthetic construct
  misc_feature 1..21: note = Synthetic Construct
  source 1..21: mol_type = other DNA
caggccaagtcccaggtcaag

SEQ ID NO: 14003 - DNA, 21 bp, synthetic construct
  misc_feature 1..21: note = Synthetic Construct
  source 1..21: mol_type = other DNA
gcgcacagtgctttcacaatc

SEQ ID NO: 14004 - DNA, 21 bp, synthetic construct
  misc_feature 1..21: note = Synthetic Construct
  source 1..21: mol_type = other DNA
cggacccaaccttgtgtcaac

SEQ ID NO: 14005 - DNA, 24 bp, synthetic construct
  misc_feature 1..24: note = Synthetic Construct
  source 1..24: mol_type = other DNA
gggaactactccaaccagagtcaa

SEQ ID NO: 14006 - DNA, 23 bp, synthetic construct
  misc_feature 1..23: note = Synthetic Construct
  source 1..23: mol_type = other DNA
accaatggcaaacatctgtgaga

SEQ ID NO: 14007 - DNA, 21 bp, synthetic construct
  misc_feature 1..21: note = Synthetic Construct
  source 1..21: mol_type = other DNA
tgcgtggagcaaaaggtttga

SEQ ID NO: 14008 - DNA, 25 bp, synthetic construct
  misc_feature 1..25: note = Synthetic Construct
  source 1..25: mol_type = other DNA
accttcagcctttttagcaactact

SEQ ID NO: 14009 - DNA, 24 bp, synthetic construct
  misc_feature 1..24: note = Synthetic Construct
  source 1..24: mol_type = other DNA
gccttatcctctaccctgatccta

SEQ ID NO: 14010 - DNA, 24 bp, synthetic construct
  misc_feature 1..24: note = Synthetic Construct
  source 1..24: mol_type = other DNA
acggcatggattgttacaagtttc

SEQ ID NO: 14011 - DNA, 21 bp, synthetic construct
  misc_feature 1..21: note = Synthetic Construct
  source 1..21: mol_type = other DNA
tgccgtggatgaccgtgatga

SEQ ID NO: 14012 - DNA, 23 bp, synthetic construct
  misc_feature 1..23: note = Synthetic Construct
  source 1..23: mol_type = other DNA
gacacgctcagaggatgagatac

SEQ ID NO: 14013 - DNA, 22 bp, synthetic construct
  misc_feature 1..22: note = Synthetic Construct
  source 1..22: mol_type = other DNA
ccctgcctggttccacttacaa

SEQ ID NO: 14014 - DNA, 23 bp, synthetic construct
  misc_feature 1..23: note = Synthetic Construct
  source 1..23: mol_type = other DNA
cagggaggcaatcggtaaagaaa

SEQ ID NO: 14015 - DNA, 22 bp, synthetic construct
  misc_feature 1..22: note = Synthetic Construct
  source 1..22: mol_type = other DNA
gcatgtcagctgggtctttcta

SEQ ID NO: 14016 - DNA, 20 bp, synthetic construct
  misc_feature 1..20: note = Synthetic Construct
  source 1..20: mol_type = other DNA
ggaactggcaaccctagcaa

SEQ ID NO: 14017 - DNA, 23 bp, synthetic construct
  misc_feature 1..23: note = Synthetic Construct
  source 1..23: mol_type = other DNA
agtgcttgtttagctgctagagt

SEQ ID NO: 14018 - DNA, 23 bp, synthetic construct
  misc_feature 1..23: note = Synthetic Construct
  source 1..23: mol_type = other DNA
ggtttccctgaactctgcctcat

SEQ ID NO: 14019 - DNA, 21 bp, synthetic construct
  misc_feature 1..21: note = Synthetic Construct
  source 1..21: mol_type = other DNA
ggtggcctctgacacagcaaa

SEQ ID NO: 14020 - DNA, 22 bp, synthetic construct
  misc_feature 1..22: note = Synthetic Construct
  source 1..22: mol_type = other DNA
agcccgggcacagtctactaat

SEQ ID NO: 14021 - DNA, 23 bp, synthetic construct
  misc_feature 1..23: note = Synthetic Construct
  source 1..23: mol_type = other DNA
ggatgaaggcagatccctgaaac

SEQ ID NO: 14022 - DNA, 23 bp, synthetic construct
  misc_feature 1..23: note = Synthetic Construct
  source 1..23: mol_type = other DNA
ccttgtgtgcataaagggtcttg

SEQ ID NO: 14023 - DNA, 20 bp, synthetic construct
  misc_feature 1..20: note = Synthetic Construct
  source 1..20: mol_type = other DNA
ccatggcccttcccttcttg

SEQ ID NO: 14024 - DNA, 21 bp, synthetic construct
  misc_feature 1..21: note = Synthetic Construct
  source 1..21: mol_type = other DNA
agcccaactgggtggtgcata

SEQ ID NO: 14025 - DNA, 26 bp, synthetic construct
  misc_feature 1..26: note = Synthetic Construct
  source 1..26: mol_type = other DNA
gtatgactccccttaaggatgagaag

SEQ ID NO: 14026 - DNA, 24 bp, synthetic construct
  misc_feature 1..24: note = Synthetic Construct
  source 1..24: mol_type = other DNA
ggagaggctgtcagtatgggatgt

SEQ ID NO: 14027 - DNA, 20 bp, synthetic construct
  misc_feature 1..20: note = Synthetic Construct
  source 1..20: mol_type = other DNA
gacccaactgccaagacaga

SEQ ID NO: 14028 - DNA, 22 bp, synthetic construct
  misc_feature 1..22: note = Synthetic Construct
  source 1..22: mol_type = other DNA
gtttggccctgtacttctgtct

SEQ ID NO: 14029 - DNA, 22 bp, synthetic construct
  misc_feature 1..22: note = Synthetic Construct
  source 1..22: mol_type = other DNA
aactgccccaatgccaggatag

SEQ ID NO: 14030 - DNA, 21 bp, synthetic construct
  misc_feature 1..21: note = Synthetic Construct
  source 1..21: mol_type = other DNA
cagcacatctgggacctggta

SEQ ID NO: 14031 - DNA, 23 bp, synthetic construct
  misc_feature 1..23: note = Synthetic Construct
  source 1..23: mol_type = other DNA
ctgtctgaccaacttgctgtttg

SEQ ID NO: 14032 - DNA, 22 bp, synthetic construct
  misc_feature 1..22: note = Synthetic Construct
  source 1..22: mol_type = other DNA
ctgggagggtaaggactgatct

SEQ ID NO: 14033 - DNA, 22 bp, synthetic construct
  misc_feature 1..22: note = Synthetic Construct
  source 1..22: mol_type = other DNA
ccccgtctgaatgagaaagcat

SEQ ID NO: 14034 - DNA, 22 bp, synthetic construct
  misc_feature 1..22: note = Synthetic Construct
  source 1..22: mol_type = other DNA
cctgaagggaggttctgagtct

SEQ ID NO: 14035 - DNA, 22 bp, synthetic construct
  misc_feature 1..22: note = Synthetic Construct
  source 1..22: mol_type = other DNA
tcccagttcagggaggcattac

SEQ ID NO: 14036 - DNA, 22 bp, synthetic construct
  misc_feature 1..22: note = Synthetic Construct
  source 1..22: mol_type = other DNA
cccctcctcaaagggacaaaac

SEQ ID NO: 14037 - DNA, 21 bp, synthetic construct
  misc_feature 1..21: note = Synthetic Construct
  source 1..21: mol_type = other DNA
ccactccagggtccagagtca

SEQ ID NO: 14038 - DNA, 20 bp, synthetic construct
  misc_feature 1..20: note = Synthetic Construct
  source 1..20: mol_type = other DNA
tcgcctccttcctggtctac

SEQ ID NO: 14039 - DNA, 26 bp, synthetic construct
  misc_feature 1..26: note = Synthetic Construct
  source 1..26: mol_type = other DNA
gcagagatgcgacttcctttgtccta

SEQ ID NO: 14040 - DNA, 23 bp, synthetic construct
  misc_feature 1..23: note = Synthetic Construct
  source 1..23: mol_type = other DNA
ctgcattccagccatttcaaact

SEQ ID NO: 14041 - DNA, 21 bp, synthetic construct
  misc_feature 1..21: note = Synthetic Construct
  source 1..21: mol_type = other DNA
tgggtggtacaggcaagagat

SEQ ID NO: 14042 - DNA, 25 bp, synthetic construct
  misc_feature 1..25: note = Synthetic Construct
  source 1..25: mol_type = other DNA
cactggcagaaacaaggagagaaga

SEQ ID NO: 14043 - DNA, 21 bp, synthetic construct
  misc_feature 1..21: note = Synthetic Construct
  source 1..21: mol_type = other DNA
ggaagctctcactccccaaac

SEQ ID NO: 14044 - DNA, 21 bp, synthetic construct
  misc_feature 1..21: note = Synthetic Construct
  source 1..21: mol_type = other DNA
ccaggcctctgtgctgtttgt

SEQ ID NO: 14045 - DNA, 19 bp, synthetic construct
  misc_feature 1..19: note = Synthetic Construct
  source 1..19: mol_type = other DNA
cacgcagttggcagagcat

SEQ ID NO: 14046 - DNA, 22 bp, synthetic construct
  misc_feature 1..22: note = Synthetic Construct
  source 1..22: mol_type = other DNA
ggcctgaaggagtttcccatca

SEQ ID NO: 14047 - DNA, 24 bp, synthetic construct
  misc_feature 1..24: note = Synthetic Construct
  source 1..24: mol_type = other DNA
cccatgaattactgtgtggtgtga

SEQ ID NO: 14048 - DNA, 23 bp, synthetic construct
  misc_feature 1..23: note = Synthetic Construct
  source 1..23: mol_type = other DNA
ggtcactgtgggagttttcttgt

SEQ ID NO: 14049 - DNA, 21 bp, synthetic construct
  misc_feature 1..21: note = Synthetic Construct
  source 1..21: mol_type = other DNA
ctggaaagggaggagccaaaa

SEQ ID NO: 14050 - DNA, 23 bp, synthetic construct
  misc_feature 1..23: note = Synthetic Construct
  source 1..23: mol_type = other DNA
gagcttgcccaggcagatttcta

SEQ ID NO: 14051 - DNA, 20 bp, synthetic construct
  misc_feature 1..20: note = Synthetic Construct
  source 1..20: mol_type = other DNA
cacccactgtcgcagcattc

SEQ ID NO: 14052 - DNA, 23 bp, synthetic construct
  misc_feature 1..23: note = Synthetic Construct
  source 1..23: mol_type = other DNA
gccttaggaaagggacagtgtag

SEQ ID NO: 14053 - DNA, 19 bp, synthetic construct
  misc_feature 1..19: note = Synthetic Construct
  source 1..19: mol_type = other DNA
caggatggcgaggcagaca

SEQ ID NO: 14054 - DNA, 22 bp, synthetic construct
  misc_feature 1..22: note = Synthetic Construct
  source 1..22: mol_type = other DNA
ctgtgcccaagtggagtcatgt

SEQ ID NO: 14055 - DNA, 25 bp, synthetic construct
  misc_feature 1..25: note = Synthetic Construct
  source 1..25: mol_type = other DNA
ccagatgaactgagaaggtcagatt

SEQ ID NO: 14056 - DNA, 21 bp, synthetic construct
  misc_feature 1..21: note = Synthetic Construct
  source 1..21: mol_type = other DNA
acatccctgtttgccctcttg

SEQ ID NO: 14057 - DNA, 26 bp, synthetic construct
  misc_feature 1..26: note = Synthetic Construct
  source 1..26: mol_type = other DNA
cctacctgatgcattctgggaacatc

SEQ ID NO: 14058 - DNA, 24 bp, synthetic construct
  misc_feature 1..24: note = Synthetic Construct
  source 1..24: mol_type = other DNA
gtgagagagaggcagaggggataa

SEQ ID NO: 14059 - DNA, 23 bp, synthetic construct
  misc_feature 1..23: note = Synthetic Construct
  source 1..23: mol_type = other DNA
ctacagccaccttacacctttgt

SEQ ID NO: 14060 - DNA, 22 bp, synthetic construct
  misc_feature 1..22: note = Synthetic Construct
  source 1..22: mol_type = other DNA
cccatagcgagggctggattta

SEQ ID NO: 14061 - DNA, 20 bp, synthetic construct
  misc_feature 1..20: note = Synthetic Construct
  source 1..20: mol_type = other DNA
acgtgcagaagcctttgaga

SEQ ID NO: 14062 - DNA, 20 bp, synthetic construct
  misc_feature 1..20: note = Synthetic Construct
  source 1..20: mol_type = other DNA
gcacttgccccactcctaga

SEQ ID NO: 14063 - DNA, 23 bp, synthetic construct
  misc_feature 1..23: note = Synthetic Construct
  source 1..23: mol_type = other DNA
gcttctgagctatctcggtcctt

SEQ ID NO: 14064 - DNA, 24 bp, synthetic construct
  misc_feature 1..24: note = Synthetic Construct
  source 1..24: mol_type = other DNA
gctgaagcctgagggtctggttta

SEQ ID NO: 14065 - DNA, 22 bp, synthetic construct
  misc_feature 1..22: note = Synthetic Construct
  source 1..22: mol_type = other DNA
acaccattgcctgggctcttag

SEQ ID NO: 14066 - DNA, 25 bp, synthetic construct
  misc_feature 1..25: note = Synthetic Construct
  source 1..25: mol_type = other DNA
ccacgcagtgttgaggattaagtca

SEQ ID NO: 14067 - DNA, 21 bp, synthetic construct
  misc_feature 1..21: note = Synthetic Construct
  source 1..21: mol_type = other DNA
gctcttcaagcctcagtgcaa

SEQ ID NO: 14068 - DNA, 22 bp, synthetic construct
  misc_feature 1..22: note = Synthetic Construct
  source 1..22: mol_type = other DNA
tcagaaggggctttctgtgaag

SEQ ID NO: 14069 - DNA, 21 bp, synthetic construct
  misc_feature 1..21: note = Synthetic Construct
  source 1..21: mol_type = other DNA
cccattgctccgctgattttc

SEQ ID NO: 14070 - DNA, 21 bp, synthetic construct
  misc_feature 1..21: note = Synthetic Construct
  source 1..21: mol_type = other DNA
ccaccctcagggcctggtatt

SEQ ID NO: 14071 - DNA, 23 bp, synthetic construct
  misc_feature 1..23: note = Synthetic Construct
  source 1..23: mol_type = other DNA
gcccgttcctttcctgattcttt

SEQ ID NO: 14072 - DNA, 22 bp, synthetic construct
  misc_feature 1..22: note = Synthetic Construct
  source 1..22: mol_type = other DNA
ccccagtaagcgcaaagttaga

SEQ ID NO: 14073 - DNA, 22 bp, synthetic construct
  misc_feature 1..22: note = Synthetic Construct
  source 1..22: mol_type = other DNA
acaactcccacctcctgtctct

SEQ ID NO: 14074 - DNA, 22 bp, synthetic construct
  misc_feature 1..22: note = Synthetic Construct
  source 1..22: mol_type = other DNA
cgccacagtgggagataagcaa

SEQ ID NO: 14075 - DNA, 24 bp, synthetic construct
  misc_feature 1..24: note = Synthetic Construct
  source 1..24: mol_type = other DNA
ctagcccagcaaattttggagttt

SEQ ID NO: 14076 - DNA, 24 bp, synthetic construct
  misc_feature 1..24: note = Synthetic Construct
  source 1..24: mol_type = other DNA
gcttgtttaacccatgttgtgtga

SEQ ID NO: 14077 - DNA, 25 bp, synthetic construct
  misc_feature 1..25: note = Synthetic Construct
  source 1..25: mol_type = other DNA
ggacaagcttttgagactagccata

SEQ ID NO: 14078 - DNA, 20 bp, synthetic construct
  misc_feature 1..20: note = Synthetic Construct
  source 1..20: mol_type = other DNA
gatctgctccgtgggacaaa

SEQ ID NO: 14079 - DNA, 24 bp, synthetic construct
  misc_feature 1..24: note = Synthetic Construct
  source 1..24: mol_type = other DNA
aaatcctcttgctagctccagatg

SEQ ID NO: 14080 - DNA, 23 bp, synthetic construct
  misc_feature 1..23: note = Synthetic Construct
  source 1..23: mol_type = other DNA
gtgtggtctacactgggaaagaa

SEQ ID NO: 14081 - DNA, 23 bp, synthetic construct
  misc_feature 1..23: note = Synthetic Construct
  source 1..23: mol_type = other DNA
cctctcctcagatgcctgtttct

SEQ ID NO: 14082 - DNA, 24 bp, synthetic construct
  misc_feature 1..24: note = Synthetic Construct
  source 1..24: mol_type = other DNA
ctgtagagagccatgtccctgaat

SEQ ID NO: 14083 - DNA, 25 bp, synthetic construct
  misc_feature 1..25: note = Synthetic Construct
  source 1..25: mol_type = other DNA
caagacctactgtccactctgattc

SEQ ID NO: 14084 - DNA, 21 bp, synthetic construct
  misc_feature 1..21: note = Synthetic Construct
  source 1..21: mol_type = other DNA
agcgttgaggaccattctgtt

SEQ ID NO: 14085 - DNA, 23 bp, synthetic construct
  misc_feature 1..23: note = Synthetic Construct
  source 1..23: mol_type = other DNA
ggccctgtcaatcataccagctt

SEQ ID NO: 14086 - DNA, 21 bp, synthetic construct
  misc_feature 1..21: note = Synthetic Construct
  source 1..21: mol_type = other DNA
gtctctctcccacttgcaaca

SEQ ID NO: 14087 - DNA, 22 bp, synthetic construct
  misc_feature 1..22: note = Synthetic Construct
  source 1..22: mol_type = other DNA
cctcttgagcctttcccgtgtt

SEQ ID NO: 14088 - DNA, 26 bp, synthetic construct
  misc_feature 1..26: note = Synthetic Construct
  source 1..26: mol_type = other DNA
ggggaacctaacttactcttggaaag

SEQ ID NO: 14089 - DNA, 24 bp, synthetic construct
  misc_feature 1..24: note = Synthetic Construct
  source 1..24: mol_type = other DNA
gacatacaagggtagggagactga

SEQ ID NO: 14090 - DNA, 22 bp, synthetic construct
  misc_feature 1..22: note = Synthetic Construct
  source 1..22: mol_type = other DNA
cctggagcaacctggggattag

SEQ ID NO: 14091 - DNA, 26 bp, synthetic construct
  misc_feature 1..26: note = Synthetic Construct
  source 1..26: mol_type = other DNA
ccagcagcttttactctaggggattg

SEQ ID NO: 14092 - DNA, 20 bp, synthetic construct
  misc_feature 1..20: note = Synthetic Construct
  source 1..20: mol_type = other DNA
gagcaggacaatggcagaca

SEQ ID NO: 14093 - DNA, 25 bp, synthetic construct
  misc_feature 1..25: note = Synthetic Construct
  source 1..25: mol_type = other DNA
caccctgagccaatagggagaaaga

SEQ ID NO: 14094 - DNA, 22 bp, synthetic construct
  misc_feature 1..22: note = Synthetic Construct
  source 1..22: mol_type = other DNA
gcactttccctcccaacccttt

SEQ ID NO: 14095 - DNA, 21 bp, synthetic construct
  misc_feature 1..21: note = Synthetic Construct
  source 1..21: mol_type = other DNA
cctttgggaccaacgctgttt

SEQ ID NO: 14096 - DNA, 21 bp, synthetic construct
  misc_feature 1..21: note = Synthetic Construct
  source 1..21: mol_type = other DNA
cccgacctcttgctcaggttt

SEQ ID NO: 14097 - DNA, 22 bp, synthetic construct
  misc_feature 1..22: note = Synthetic Construct
  source 1..22: mol_type = other DNA
agctgtagaccggagtggttct

SEQ ID NO: 14098 - DNA, 25 bp, synthetic construct
  misc_feature 1..25: note = Synthetic Construct
  source 1..25: mol_type = other DNA
ggggaaacaaatgctaaagttctca

SEQ ID NO: 14099 - DNA, 19 bp, synthetic construct
  misc_feature 1..19: note = Synthetic Construct
  source 1..19: mol_type = other DNA
gccggggcggtaaagatgt

SEQ ID NO: 14100 - DNA, 25 bp, synthetic construct
  misc_feature 1..25: note = Synthetic Construct
  source 1..25: mol_type = other DNA
gggattgcatccatagcacagtttt

SEQ ID NO: 14101 - DNA, 19 bp, synthetic construct
  misc_feature 1..19: note = Synthetic Construct
  source 1..19: mol_type = other DNA
cctggcctaaggcaacgaa

SEQ ID NO: 14102 - DNA, 26 bp, synthetic construct
  misc_feature 1..26: note = Synthetic Construct
  source 1..26: mol_type = other DNA
cgttttctttttccctctcccacaaa

SEQ ID NO: 14103 - DNA, 24 bp, synthetic construct
  misc_feature 1..24: note = Synthetic Construct
  source 1..24: mol_type = other DNA
gagtcatcagaggctgacttttct

SEQ ID NO: 14104 - DNA, 24 bp, synthetic construct
  misc_feature 1..24: note = Synthetic Construct
  source 1..24: mol_type = other DNA
cgtactttggggaagaatctggaa

SEQ ID NO: 14105 - DNA, 20 bp, synthetic construct
  misc_feature 1..20: note = Synthetic Construct
  source 1..20: mol_type = other DNA
tgctcactggactcctggaa

SEQ ID NO: 14106 - DNA, 22 bp, synthetic construct
  misc_feature 1..22: note = Synthetic Construct
  source 1..22: mol_type = other DNA
gggtcagaagtgtcctttgctt

SEQ ID NO: 14107 - DNA, 22 bp, synthetic construct
  misc_feature 1..22: note = Synthetic Construct
  source 1..22: mol_type = other DNA
ccctccttccactgctctgtat

SEQ ID NO: 14108 - DNA, 22 bp, synthetic construct
  misc_feature 1..22: note = Synthetic Construct
  source 1..22: mol_type = other DNA
ggcaggccatcacagtcataga

SEQ ID NO: 14109 - DNA, 22 bp, synthetic construct
  misc_feature 1..22: note = Synthetic Construct
  source 1..22: mol_type = other DNA
gcaactgggctatcagggattg

SEQ ID NO: 14110 - DNA, 22 bp, synthetic construct
  misc_feature 1..22: note = Synthetic Construct
  source 1..22: mol_type = other DNA
gctgagggacacacttggatca

SEQ ID NO: 14111 - DNA, 18 bp, synthetic construct
  misc_feature 1..18: note = Synthetic Construct
  source 1..18: mol_type = other DNA
aagggccctgctggtagt

SEQ ID NO: 14112 - DNA, 21 bp, synthetic construct
  misc_feature 1..21: note = Synthetic Construct
  source 1..21: mol_type = other DNA
gcatgtcagctgcacagaaaa

SEQ ID NO: 14113 - DNA, 22 bp, synthetic construct
  misc_feature 1..22: note = Synthetic Construct
  source 1..22: mol_type = other DNA
gatgctgctccaaggataccaa

SEQ ID NO: 14114 - DNA, 25 bp, synthetic construct
  misc_feature 1..25: note = Synthetic Construct
  source 1..25: mol_type = other DNA
ccaggaaggtcaaaatgtggactga

SEQ ID NO: 14115 - DNA, 20 bp, synthetic construct
  misc_feature 1..20: note = Synthetic Construct
  source 1..20: mol_type = other DNA
tgtgcctgtgggtggagaag

SEQ ID NO: 14116 - DNA, 21 bp, synthetic construct
  misc_feature 1..21: note = Synthetic Construct
  source 1..21: mol_type = other DNA
gctgtgtgaagcaggcagaag

SEQ ID NO: 14117 - DNA, 23 bp, synthetic construct
  misc_feature 1..23: note = Synthetic Construct
  source 1..23: mol_type = other DNA
cagcagaagctaacaggggaagt

SEQ ID NO: 14118 - DNA, 25 bp, synthetic construct
  misc_feature 1..25: note = Synthetic Construct
  source 1..25: mol_type = other DNA
cacttcccaaaaaggttccattgat

SEQ ID NO: 14119 - DNA, 22 bp, synthetic construct
  misc_feature 1..22: note = Synthetic Construct
  source 1..22: mol_type = other DNA
actgctcctccagcttggtgat

SEQ ID NO: 14120 - DNA, 21 bp, synthetic construct
  misc_feature 1..21: note = Synthetic Construct
  source 1..21: mol_type = other DNA
ggggtggtctccccaaactca

SEQ ID NO: 14121 - DNA, 22 bp, synthetic construct
  misc_feature 1..22: note = Synthetic Construct
  source 1..22: mol_type = other DNA
ggccatggtgagtggtagcaaa

SEQ ID NO: 14122 - DNA, 24 bp, synthetic construct
  misc_feature 1..24: note = Synthetic Construct
  source 1..24: mol_type = other DNA
agctaggatttagcccagagtttc

SEQ ID NO: 14123 - DNA, 26 bp, synthetic construct
  misc_feature 1..26: note = Synthetic Construct
  source 1..26: mol_type = other DNA
gctgtttatcagtttgtgctgagtga

SEQ ID NO: 14124 - DNA, 20 bp, synthetic construct
  misc_feature 1..20: note = Synthetic Construct
  source 1..20: mol_type = other DNA
ctgggcctcagctcttccat

SEQ ID NO: 14125 - DNA, 24 bp, synthetic construct
  misc_feature 1..24: note = Synthetic Construct
  source 1..24: mol_type = other DNA
gactcctggagccactcttcattc

SEQ ID NO: 14126 - DNA, 20 bp, synthetic construct
  misc_feature 1..20: note = Synthetic Construct
  source 1..20: mol_type = other DNA
agccagttgccataggcttt

SEQ ID NO: 14127 - DNA, 21 bp, synthetic construct
  misc_feature 1..21: note = Synthetic Construct
  source 1..21: mol_type = other DNA
gggccacaccactcagagtaa

SEQ ID NO: 14128 - DNA, 23 bp, synthetic construct
  misc_feature 1..23: note = Synthetic Construct
  source 1..23: mol_type = other DNA
actgggctgacccttttgatttc

SEQ ID NO: 14129 - DNA, 19 bp, synthetic construct
  misc_feature 1..19: note = Synthetic Construct
  source 1..19: mol_type = other DNA
cgagggagatgcgggtcta

SEQ ID NO: 14130 - DNA, 19 bp, synthetic construct
  misc_feature 1..19: note = Synthetic Construct
  source 1..19: mol_type = other DNA
accacagtgctccgtgcat

SEQ ID NO: 14131 - DNA, 20 bp, synthetic construct
  misc_feature 1..20: note = Synthetic Construct
  source 1..20: mol_type = other DNA
ccagggagggaggtcacaca

SEQ ID NO: 14132 - DNA, 23 bp, synthetic construct
  misc_feature 1..23: note = Synthetic Construct
  source 1..23: mol_type = other DNA
gtcagcatagggcagttgcaaag

SEQ ID NO: 14133 - DNA, 24 bp, synthetic construct
  misc_feature 1..24: note = Synthetic Construct
  source 1..24: mol_type = other DNA
ggaaaccttagctggggtcttttc

SEQ ID NO: 14134 - DNA, 24 bp, synthetic construct
  misc_feature 1..24: note = Synthetic Construct
  source 1..24: mol_type = other DNA
agaggttcccactagagagtcatc

SEQ ID NO: 14135 - DNA, 23 bp, synthetic construct
  misc_feature 1..23: note = Synthetic Construct
  source 1..23: mol_type = other DNA
gttgagaccgaacactggcaaac

SEQ ID NO: 14136 - DNA, 24 bp, synthetic construct
  misc_feature 1..24: note = Synthetic Construct
  source 1..24: mol_type = other DNA
ccaaggacatgacttacccagttt

SEQ ID NO: 14137 - DNA, 26 bp, synthetic construct
  misc_feature 1..26: note = Synthetic Construct
  source 1..26: mol_type = other DNA
gcttaggacctatctggagtcacagt

SEQ ID NO: 14138 - DNA, 22 bp, synthetic construct
  misc_feature 1..22: note = Synthetic Construct
  source 1..22: mol_type = other DNA
ccaggaagtgagcaggttgtag

SEQ ID NO: 14139 - DNA, 20 bp, synthetic construct
  misc_feature 1..20: note = Synthetic Construct
  source 1..20: mol_type = other DNA
tgtctgcgtggcaaggtttc

SEQ ID NO: 14140 - DNA, 22 bp, synthetic construct
  misc_feature 1..22: note = Synthetic Construct
  source 1..22: mol_type = other DNA
ggccccaaagaggttgcatttc

SEQ ID NO: 14141 - DNA, 21 bp, synthetic construct
  misc_feature 1..21: note = Synthetic Construct
  source 1..21: mol_type = other DNA
tggcacagcattgcagttaga

SEQ ID NO: 14142 - DNA, 23 bp, synthetic construct
  misc_feature 1..23: note = Synthetic Construct
  source 1..23: mol_type = other DNA
cagagcgagacatcatcctttca

SEQ ID NO: 14143 - DNA, 22 bp, synthetic construct
  misc_feature 1..22: note = Synthetic Construct
  source 1..22: mol_type = other DNA
gctgcttctgaggcctttactt

SEQ ID NO: 14144 - DNA, 22 bp, synthetic construct
  misc_feature 1..22: note = Synthetic Construct
  source 1..22: mol_type = other DNA
gcaactgccagcaaaggcatga

SEQ ID NO: 14145 - DNA, 20 bp, synthetic construct
  misc_feature 1..20: note = Synthetic Construct
  source 1..20: mol_type = other DNA
cctgcccagttaccctgcat

SEQ ID NO: 14146 - DNA, 26 bp, synthetic construct
  misc_feature 1..26: note = Synthetic Construct
  source 1..26: mol_type = other DNA
ccatcctatagtctggggcttgtttg

SEQ ID NO: 14147 - DNA, 24 bp, synthetic construct
  misc_feature 1..24: note = Synthetic Construct
  source 1..24: mol_type = other DNA
caacagcaagacattccagcatag

SEQ ID NO: 14148 - DNA, 25 bp, synthetic construct
  misc_feature 1..25: note = Synthetic Construct
  source 1..25: mol_type = other DNA
cctccacctcatttgagttgtttct

SEQ ID NO: 14149 - DNA, 22 bp, synthetic construct
  misc_feature 1..22: note = Synthetic Construct
  source 1..22: mol_type = other DNA
aggtgcctctctcagcaggatt

SEQ ID NO: 14150 - DNA, 21 bp, synthetic construct
  misc_feature 1..21: note = Synthetic Construct
  source 1..21: mol_type = other DNA
ccctgtccttgacgcttaact

SEQ ID NO: 14151 - DNA, 22 bp, synthetic construct
  misc_feature 1..22: note = Synthetic Construct
  source 1..22: mol_type = other DNA
gtcagttcccatggacccagaa

SEQ ID NO: 14152 - DNA, 25 bp, synthetic construct
  misc_feature 1..25: note = Synthetic Construct
  source 1..25: mol_type = other DNA
ctgagattatgccaatgccctgcta

SEQ ID NO: 14153 - DNA, 20 bp, synthetic construct
  misc_feature 1..20: note = Synthetic Construct
  source 1..20: mol_type = other DNA
ctactggacgcagccctcta

SEQ ID NO: 14154 - DNA, 23 bp, synthetic construct
  misc_feature 1..23: note = Synthetic Construct
  source 1..23: mol_type = other DNA
tggccgtgtttttatcccattgt

SEQ ID NO: 14155 - DNA, 25 bp, synthetic construct
  misc_feature 1..25: note = Synthetic Construct
  source 1..25: mol_type = other DNA
ggtcatgcagagaggactggaatta

SEQ ID NO: 14156 - DNA, 19 bp, synthetic construct
  misc_feature 1..19: note = Synthetic Construct
  source 1..19: mol_type = other DNA
cccactgtggcgaccatgt

SEQ ID NO: 14157 - DNA, 20 bp, synthetic construct
  misc_feature 1..20: note = Synthetic Construct
  source 1..20: mol_type = other DNA
tctgcttgtcccgagctagt

SEQ ID NO: 14158 - DNA, 21 bp, synthetic construct
  misc_feature 1..21: note = Synthetic Construct
  source 1..21: mol_type = other DNA
acaaaagggcaggcttgctta

SEQ ID NO: 14159 - DNA, 20 bp, synthetic construct
  misc_feature 1..20: note = Synthetic Construct
  source 1..20: mol_type = other DNA
ttcggcacaggtgtgtcctt

SEQ ID NO: 14160 - DNA, 21 bp, synthetic construct
  misc_feature 1..21: note = Synthetic Construct
  source 1..21: mol_type = other DNA
acagaccctatcagccacgat

SEQ ID NO: 14161 - DNA, 24 bp, synthetic construct
  misc_feature 1..24: note = Synthetic Construct
  source 1..24: mol_type = other DNA
cctcacagcctccttgatctcctt

SEQ ID NO: 14162 - DNA, 26 bp, synthetic construct
  misc_feature 1..26: note = Synthetic Construct
  source 1..26: mol_type = other DNA
ccataagcaaaacatagtccctgttc

SEQ ID NO: 14163 - DNA, 20 bp, synthetic construct
  misc_feature 1..20: note = Synthetic Construct
  source 1..20: mol_type = other DNA
caggcagacacagagcaact

SEQ ID NO: 14164 - DNA, 20 bp, synthetic construct
  misc_feature 1..20: note = Synthetic Construct
  source 1..20: mol_type = other DNA
gggtggtgaaatggcagaga

SEQ ID NO: 14165 - DNA, 22 bp, synthetic construct
  misc_feature 1..22: note = Synthetic Construct
  source 1..22: mol_type = other DNA
gcttgcttgcttgcttgctttg

SEQ ID NO: 14166 - DNA, 21 bp, synthetic construct
  misc_feature 1..21: note = Synthetic Construct
  source 1..21: mol_type = other DNA
agcttgcagggagtccaggaa

SEQ ID NO: 14167 - DNA, 26 bp, synthetic construct
  misc_feature 1..26: note = Synthetic Construct
  source 1..26: mol_type = other DNA
gtggctccttacattactaccagtga

SEQ ID NO: 14168 - DNA, 25 bp, synthetic construct
  misc_feature 1..25: note = Synthetic Construct
  source 1..25: mol_type = other DNA
ccctgtctgtctcaggaggagaaaa

SEQ ID NO: 14169 - DNA, 21 bp, synthetic construct
  misc_feature 1..21: note = Synthetic Construct
  source 1..21: mol_type = other DNA
ggacatggtgcgtgcagtatc

SEQ ID NO: 14170 - DNA, 20 bp, synthetic construct
  misc_feature 1..20: note = Synthetic Construct
  source 1..20: mol_type = other DNA
cagggaaatccggcatccat

SEQ ID NO: 14171 - DNA, 21 bp, synthetic construct
  misc_feature 1..21: note = Synthetic Construct
  source 1..21: mol_type = other DNA
accgtgagtcccagaggttca

SEQ ID NO: 14172 - DNA, 25 bp, synthetic construct
  misc_feature 1..25: note = Synthetic Construct
  source 1..25: mol_type = other DNA
ggcagggagatttattccttgctaa

SEQ ID NO: 14173 - DNA, 26 bp, synthetic construct
  misc_feature 1..26: note = Synthetic Construct
  source 1..26: mol_type = other DNA
gcagtgctatagaagtagtggagtga

SEQ ID NO: 14174 - DNA, 20 bp, synthetic construct
  misc_feature 1..20: note = Synthetic Construct
  source 1..20: mol_type = other DNA
tgctccctgcagcattggaa

SEQ ID NO: 14175 - DNA, 20 bp, synthetic construct
  misc_feature 1..20: note = Synthetic Construct
  source 1..20: mol_type = other DNA
ttcaccctggggtctcttca

SEQ ID NO: 14176 - DNA, 21 bp, synthetic construct
  misc_feature 1..21: note = Synthetic Construct
  source 1..21: mol_type = other DNA
ttgtggggccctaccttccaa

SEQ ID NO: 14177 - DNA, 23 bp, synthetic construct
  misc_feature 1..23: note = Synthetic Construct
  source 1..23: mol_type = other DNA
ctcattaacactcagcccgtgaa

SEQ ID NO: 14178 - DNA, 22 bp, synthetic construct
  misc_feature 1..22: note = Synthetic Construct
  source 1..22: mol_type = other DNA
tccagtgtgaggtgcgtttatg

SEQ ID NO: 14179 - DNA, 22 bp, synthetic construct
  misc_feature 1..22: note = Synthetic Construct
  source 1..22: mol_type = other DNA
gcccaaatccagaccagtccta

SEQ ID NO: 14180 - DNA, 22 bp, synthetic construct
  misc_feature 1..22: note = Synthetic Construct
  source 1..22: mol_type = other DNA
catggtgctagcctcactctca

SEQ ID NO: 14181 - DNA, 20 bp, synthetic construct
  misc_feature 1..20: note = Synthetic Construct
  source 1..20: mol_type = other DNA
cccctggggaccttgtaaac

SEQ ID NO: 14182 - DNA, 27 bp, synthetic construct
  misc_feature 1..27: note = Synthetic Construct
  source 1..27: mol_type = other DNA
ctaccaaagctgtatggtctgtaaaac

SEQ ID NO: 14183 - DNA, 22 bp, synthetic construct
  misc_feature 1..22: note = Synthetic Construct
  source 1..22: mol_type = other DNA
gattggtgctcacccactgact

SEQ ID NO: 14184 - DNA, 20 bp, synthetic construct
  misc_feature 1..20: note = Synthetic Construct
  source 1..20: mol_type = other DNA
cgagcaagaacacgctggaa

SEQ ID NO: 14185 - DNA, 21 bp, synthetic construct
  misc_feature 1..21: note = Synthetic Construct
  source 1..21: mol_type = other DNA
ggatggtgcagcaacgaatga

SEQ ID NO: 14186 - DNA, 22 bp, synthetic construct
  misc_feature 1..22: note = Synthetic Construct
  source 1..22: mol_type = other DNA
aggggccaagaaaccaggaaga

SEQ ID NO: 14187 - DNA, 20 bp, synthetic construct
  misc_feature 1..20: note = Synthetic Construct
  source 1..20: mol_type = other DNA
aggctttggggtggtttgtt

SEQ ID NO: 14188 - DNA, 22 bp, synthetic construct
  misc_feature 1..22: note = Synthetic Construct
  source 1..22: mol_type = other DNA
tcattcctcggctcacccttct

SEQ ID NO: 14189 - DNA, 24 bp, synthetic construct
  misc_feature 1..24: note = Synthetic Construct
  source 1..24: mol_type = other DNA
ggtaactgatcagactgggagttc

SEQ ID NO: 14190 - DNA, 21 bp, synthetic construct
  misc_feature 1..21: note = Synthetic Construct
  source 1..21: mol_type = other DNA
cctgggctccttcatgtgtct

SEQ ID NO: 14191 - DNA, 22 bp, synthetic construct
  misc_feature 1..22: note = Synthetic Construct
  source 1..22: mol_type = other DNA
tcatggggctgacccaaagtct

SEQ ID NO: 14192 - DNA, 26 bp, synthetic construct
  misc_feature 1..26: note = Synthetic Construct
  source 1..26: mol_type = other DNA
agcaagagtttgcttcacactcatca

SEQ ID NO: 14193 - DNA, 22 bp, synthetic construct
  misc_feature 1..22: note = Synthetic Construct
  source 1..22: mol_type = other DNA
ggctcctttacggtcagcaact

SEQ ID NO: 14194 - DNA, 25 bp, synthetic construct
  misc_feature 1..25: note = Synthetic Construct
  source 1..25: mol_type = other DNA
ggattcttcctgtttgaccgtgttg

SEQ ID NO: 14195 - DNA, 23 bp, synthetic construct
  misc_feature 1..23: note = Synthetic Construct
  source 1..23: mol_type = other DNA
gtgtccacagctctctgttcgat

SEQ ID NO: 14196 - DNA, 19 bp, synthetic construct
  misc_feature 1..19: note = Synthetic Construct
  source 1..19: mol_type = other DNA
actgcctcccgagaagtga

SEQ ID NO: 14197 - DNA, 21 bp, synthetic construct
  misc_feature 1..21: note = Synthetic Construct
  source 1..21: mol_type = other DNA
gtggttgttacggggaaggtt

SEQ ID NO: 14198 - DNA, 25 bp, synthetic construct
  misc_feature 1..25: note = Synthetic Construct
  source 1..25: mol_type = other DNA
gcaagttggcaagttttgtttcaca

SEQ ID NO: 14199 - DNA, 23 bp, synthetic construct
  misc_feature 1..23: note = Synthetic Construct
  source 1..23: mol_type = other DNA
gggaaacaggcttatgcaagaca

SEQ ID NO: 14200 - DNA, 22 bp, synthetic construct
  misc_feature 1..22: note = Synthetic Construct
  source 1..22: mol_type = other DNA
ggtcttgaatcgttggctctgt

SEQ ID NO: 14201 - DNA, 21 bp, synthetic construct
  misc_feature 1..21: note = Synthetic Construct
  source 1..21: mol_type = other DNA
accaggtagccaggaaggtaa

SEQ ID NO: 14202 - DNA, 18 bp, synthetic construct
  misc_feature 1..18: note = Synthetic Construct
  source 1..18: mol_type = other DNA
gccttggtgctggtggat

SEQ ID NO: 14203 - DNA, 22 bp, synthetic construct
  misc_feature 1..22: note = Synthetic Construct
  source 1..22: mol_type = other DNA
aggtacagggagctgagagaag

SEQ ID NO: 14204 - DNA, 22 bp, synthetic construct
  misc_feature 1..22: note = Synthetic Construct
  source 1..22: mol_type = other DNA
gaagtcaaggtgcttccagtga

SEQ ID NO: 14205 - DNA, 22 bp, synthetic construct
  misc_feature 1..22: note = Synthetic Construct
  source 1..22: mol_type = other DNA
ctctcccacacttcccactact

SEQ ID NO: 14206 - DNA, 20 bp, synthetic construct
  misc_feature 1..20: note = Synthetic Construct
  source 1..20: mol_type = other DNA
tggtgctgaaggctggttgt

SEQ ID NO: 14207 - DNA, 22 bp, synthetic construct
  misc_feature 1..22: note = Synthetic Construct
  source 1..22: mol_type = other DNA
accagccaagggacccagttta

SEQ ID NO: 14208 - DNA, 26 bp, synthetic construct
  misc_feature 1..26: note = Synthetic Construct
  source 1..26: mol_type = other DNA
ctggtccttgaaaagggaatggtttg

SEQ ID NO: 14209 - DNA, 22 bp, synthetic construct
  misc_feature 1..22: note = Synthetic Construct
  source 1..22: mol_type = other DNA
ggccaagctccactcactcttc

SEQ ID NO: 14210 - DNA, 25 bp, synthetic construct
  misc_feature 1..25: note = Synthetic Construct
  source 1..25: mol_type = other DNA
aaggaaacaaacgtctgcagaatac

SEQ ID NO: 14211 - DNA, 20 bp, synthetic construct
  misc_feature 1..20: note = Synthetic Construct
  source 1..20: mol_type = other DNA
tatggactgccgctccttca

SEQ ID NO: 14212 - DNA, 24 bp, synthetic construct
  misc_feature 1..24: note = Synthetic Construct
  source 1..24: mol_type = other DNA
aggacttttgtgctggtttagaca

SEQ ID NO: 14213 - DNA, 22 bp, synthetic construct
  misc_feature 1..22: note = Synthetic Construct
  source 1..22: mol_type = other DNA
caaccgattcaggtccctttgt

SEQ ID NO: 14214 - DNA, 23 bp, synthetic construct
  misc_feature 1..23: note = Synthetic Construct
  source 1..23: mol_type = other DNA
ccactgcggggttaggtagtaca

SEQ ID NO: 14215 - DNA, 24 bp, synthetic construct
  misc_feature 1..24: note = Synthetic Construct
  source 1..24: mol_type = other DNA
caaaggcatgctggaacattctaa

SEQ ID NO: 14216 - DNA, 24 bp, synthetic construct
  misc_feature 1..24: note = Synthetic Construct
  source 1..24: mol_type = other DNA
ccaacttgtccctccatgccttct

SEQ ID NO: 14217 - DNA, 23 bp, synthetic construct
  misc_feature 1..23: note = Synthetic Construct
  source 1..23: mol_type = other DNA
ccatctccatctgctttggtgtt

SEQ ID NO: 14218 - DNA, 21 bp, synthetic construct
  misc_feature 1..21: note = Synthetic Construct
  source 1..21: mol_type = other DNA
agctcccctaactccctgaca

SEQ ID NO: 14219 - DNA, 20 bp, synthetic construct
  misc_feature 1..20: note = Synthetic Construct
  source 1..20: mol_type = other DNA
aggggtctgctggcaggtat

SEQ ID NO: 14220 - DNA, 24 bp, synthetic construct
  misc_feature 1..24: note = Synthetic Construct
  source 1..24: mol_type = other DNA
gcctcccctctcatttcctgatct

SEQ ID NO: 14221 - DNA, 22 bp, synthetic construct
  misc_feature 1..22: note = Synthetic Construct
  source 1..22: mol_type = other DNA
tgtcttccaaatggctcacgtt

SEQ ID NO: 14222 - DNA, 21 bp, synthetic construct
  misc_feature 1..21: note = Synthetic Construct
  source 1..21: mol_type = other DNA
ccagttctgcgctggagtagt

SEQ ID NO: 14223 - DNA, 26 bp, synthetic construct
  misc_feature 1..26: note = Synthetic Construct
  source 1..26: mol_type = other DNA
ctggctcaaagacattggaaacaagt

SEQ ID NO: 14224 - DNA, 22 bp, synthetic construct
  misc_feature 1..22: note = Synthetic Construct
  source 1..22: mol_type = other DNA
ctgaggtcttgcagcgaagaag

SEQ ID NO: 14225 - DNA, 24 bp, synthetic construct
  misc_feature 1..24: note = Synthetic Construct
  source 1..24: mol_type = other DNA
ggaaaacggtaggcatggtttaca

SEQ ID NO: 14226 - DNA, 22 bp, synthetic construct
  misc_feature 1..22: note = Synthetic Construct
  source 1..22: mol_type = other DNA
gggtggccataaaatccagaca

SEQ ID NO: 14227 - DNA, 20 bp, synthetic construct
  misc_feature 1..20: note = Synthetic Construct
  source 1..20: mol_type = other DNA
tccttgcccttgaggagctt

SEQ ID NO: 14228 - DNA, 22 bp, synthetic construct
  misc_feature 1..22: note = Synthetic Construct
  source 1..22: mol_type = other DNA
aagctgaattggtgcaggaaga

SEQ ID NO: 14229 - DNA, 21 bp, synthetic construct
  misc_feature 1..21: note = Synthetic Construct
  source 1..21: mol_type = other DNA
gtgtgtgagcgctggagattt

SEQ ID NO: 14230 - DNA, 23 bp, synthetic construct
  misc_feature 1..23: note = Synthetic Construct
  source 1..23: mol_type = other DNA
ccagactggactagccaggattc

SEQ ID NO: 14231 - DNA, 22 bp, synthetic construct
  misc_feature 1..22: note = Synthetic Construct
  source 1..22: mol_type = other DNA
ctgggcagtagtgactgtgagt

SEQ ID NO: 14232 - DNA, 23 bp, synthetic construct
  misc_feature 1..23: note = Synthetic Construct
  source 1..23: mol_type = other DNA
tctgaacctagccttgtgagttg

SEQ ID NO: 14233 - DNA, 22 bp, synthetic construct
  misc_feature 1..22: note = Synthetic Construct
  source 1..22: mol_type = other DNA
tcccagcctggtcttctagctt

SEQ ID NO: 14234 - DNA, 23 bp, synthetic construct
  misc_feature 1..23: note = Synthetic Construct
  source 1..23: mol_type = other DNA
agcagtctgacatcccagtctta

SEQ ID NO: 14235 - DNA, 20 bp, synthetic construct
  misc_feature 1..20: note = Synthetic Construct
  source 1..20: mol_type = other DNA
tgcggatgcgttccatgtca

SEQ ID NO: 14236 - DNA, 23 bp, synthetic construct
  misc_feature 1..23: note = Synthetic Construct
  source 1..23: mol_type = other DNA
tggaggaagaagcaaagcaagat

SEQ ID NO: 14237 - DNA, 22 bp, synthetic construct
  misc_feature 1..22: note = Synthetic Construct
  source 1..22: mol_type = other DNA
gcgggcagcctccttaacattt

SEQ ID NO: 14238 - DNA, 22 bp, synthetic construct
  misc_feature 1..22: note = Synthetic Construct
  source 1..22: mol_type = other DNA
tcatggctatccgccagtcatc

SEQ ID NO: 14239 - DNA, 23 bp, synthetic construct
  misc_feature 1..23: note = Synthetic Construct
  source 1..23: mol_type = other DNA
gccttgaaggatgtgcaggagtt

SEQ ID NO: 14240 - DNA, 23 bp, synthetic construct
  misc_feature 1..23: note = Synthetic Construct
  source 1..23: mol_type = other DNA
cctcagctcacaaagttgctaca

SEQ ID NO: 14241 - DNA, 23 bp, synthetic construct
  misc_feature 1..23: note = Synthetic Construct
  source 1..23: mol_type = other DNA
ccaggtggttgtgggaagagaag

SEQ ID NO: 14242 - DNA, 23 bp, synthetic construct
  misc_feature 1..23: note = Synthetic Construct
  source 1..23: mol_type = other DNA
cgcctgcatcattatggctcatt

SEQ ID NO: 14243 - DNA, 29 bp, synthetic construct
  misc_feature 1..29: note = Synthetic Construct
  source 1..29: mol_type = other DNA
cctgggttcatgttaatgacaagagtttg

SEQ ID NO: 14244 - DNA, 27 bp, synthetic construct
  misc_feature 1..27: note = Synthetic Construct
  source 1..27: mol_type = other DNA
agggagagatagccagaatacaaaatc

SEQ ID NO: 14245 - DNA, 19 bp, synthetic construct
  misc_feature 1..19: note = Synthetic Construct
  source 1..19: mol_type = other DNA
tggccagcacagttccaaa

SEQ ID NO: 14246 - DNA, 24 bp, synthetic construct
  misc_feature 1..24: note = Synthetic Construct
  source 1..24: mol_type = other DNA
ctggcagaaagcctgagaagcata

SEQ ID NO: 14247 - DNA, 24 bp, synthetic construct
  misc_feature 1..24: note = Synthetic Construct
  source 1..24: mol_type = other DNA
ggaaaagtgcttgatgaggcttga

SEQ ID NO: 14248 - DNA, 20 bp, synthetic construct
  misc_feature 1..20: note = Synthetic Construct
  source 1..20: mol_type = other DNA
ttccagcaaggcggatcaca

SEQ ID NO: 14249 - DNA, 24 bp, synthetic construct
  misc_feature 1..24: note = Synthetic Construct
  source 1..24: mol_type = other DNA
gatgggtattaccaggggagaaac

SEQ ID NO: 14250 - DNA, 21 bp, synthetic construct
  misc_feature 1..21: note = Synthetic Construct
  source 1..21: mol_type = other DNA
gtgggcagaatgtcaccatca

SEQ ID NO: 14251 - DNA, 21 bp, synthetic construct
  misc_feature 1..21: note = Synthetic Construct
  source 1..21: mol_type = other DNA
cacagcgggtttgtaccatgt

SEQ ID NO: 14252 - DNA, 28 bp, synthetic construct
  misc_feature 1..28: note = Synthetic Construct
  source 1..28: mol_type = other DNA
ggagagagaggctagctttgtctaaaac

SEQ ID NO: 14253 - DNA, 19 bp, synthetic construct
  misc_feature 1..19: note = Synthetic Construct
  source 1..19: mol_type = other DNA
gtctcgttgcccggagaga

SEQ ID NO: 14254 - DNA, 25 bp, synthetic construct
  misc_feature 1..25: note = Synthetic Construct
  source 1..25: mol_type = other DNA
atcctggcacttgctacttattaca

SEQ ID NO: 14255 - DNA, 25 bp, synthetic construct
  misc_feature 1..25: note = Synthetic Construct
  source 1..25: mol_type = other DNA
ctggtgtcttggttcccagaaatgt

SEQ ID NO: 14256 - DNA, 25 bp, synthetic construct
  misc_feature 1..25: note = Synthetic Construct
  source 1..25: mol_type = other DNA
gggattcctgcactaaagaccttac

SEQ ID NO: 14257 - DNA, 24 bp, synthetic construct
  misc_feature 1..24: note = Synthetic Construct
  source 1..24: mol_type = other DNA
ctcattccatccttccctgtccaa

SEQ ID NO: 14258 - DNA, 23 bp, synthetic construct
  misc_feature 1..23: note = Synthetic Construct
  source 1..23: mol_type = other DNA
cagaagccatggtggagatttga

SEQ ID NO: 14259 - DNA, 20 bp, synthetic construct
  misc_feature 1..20: note = Synthetic Construct
  source 1..20: mol_type = other DNA
agatggtggcaccccgtcat

SEQ ID NO: 14260 - DNA, 22 bp, synthetic construct
  misc_feature 1..22: note = Synthetic Construct
  source 1..22: mol_type = other DNA
ccagaacagcttccgaaacact

SEQ ID NO: 14261 - DNA, 22 bp, synthetic construct
  misc_feature 1..22: note = Synthetic Construct
  source 1..22: mol_type = other DNA
gctcagtggttgctgcagatgt

SEQ ID NO: 14262 - DNA, 23 bp, synthetic construct
  misc_feature 1..23: note = Synthetic Construct
  source 1..23: mol_type = other DNA
gctcaagccccatgaataaggtt

SEQ ID NO: 14263 - DNA, 22 bp, synthetic construct
  misc_feature 1..22: note = Synthetic Construct
  source 1..22: mol_type = other DNA
gagagacaactgcatgctcaga

SEQ ID NO: 14264 - DNA, 26 bp, synthetic construct
  misc_feature 1..26: note = Synthetic Construct
  source 1..26: mol_type = other DNA
gatggactggtagtctgtaacccaat

SEQ ID NO: 14265 - DNA, 23 bp, synthetic construct
  misc_feature 1..23: note = Synthetic Construct
  source 1..23: mol_type = other DNA
actgctcaaccaacatctgttca

SEQ ID NO: 14266 - DNA, 20 bp, synthetic construct
  misc_feature 1..20: note = Synthetic Construct
  source 1..20: mol_type = other DNA
gggccatggcactagggtaa

SEQ ID NO: 14267 - DNA, 23 bp, synthetic construct
  misc_feature 1..23: note = Synthetic Construct
  source 1..23: mol_type = other DNA
caagggaggctgaagaacgtcat

SEQ ID NO: 14268 - DNA, 22 bp, synthetic construct
  misc_feature 1..22: note = Synthetic Construct
  source 1..22: mol_type = other DNA
tcacccactccacagcatgttc

SEQ ID NO: 14269 - DNA, 24 bp, synthetic construct
  misc_feature 1..24: note = Synthetic Construct
  source 1..24: mol_type = other DNA
cttccccagttgacaaggacaaag

SEQ ID NO: 14270 - DNA, 21 bp, synthetic construct
  misc_feature 1..21: note = Synthetic Construct
  source 1..21: mol_type = other DNA
tggtgatggggagccactctt

SEQ ID NO: 14271 - DNA, 22 bp, synthetic construct
  misc_feature 1..22: note = Synthetic Construct
  source 1..22: mol_type = other DNA
ggtgcctgcttgtccctgaata

SEQ ID NO: 14272 - DNA, 24 bp, synthetic construct
  misc_feature 1..24: note = Synthetic Construct
  source 1..24: mol_type = other DNA
gatcctccccaagggttaagaatg

SEQ ID NO: 14273 - DNA, 21 bp, synthetic construct
  misc_feature 1..21: note = Synthetic Construct
  source 1..21: mol_type = other DNA
gccacagctgtctgagggtta

SEQ ID NO: 14274 - DNA, 22 bp, synthetic construct
  misc_feature 1..22: note = Synthetic Construct
  source 1..22: mol_type = other DNA
cctttccatggactgtgcaact

SEQ ID NO: 14275 - DNA, 24 bp, synthetic construct
  misc_feature 1..24: note = Synthetic Construct
  source 1..24: mol_type = other DNA
ggtgactcagatcaggggttccaa

SEQ ID NO: 14276 - DNA, 22 bp, synthetic construct
  misc_feature 1..22: note = Synthetic Construct
  source 1..22: mol_type = other DNA
ggtgtgtgtggaaggactgtga

SEQ ID NO: 14277 - DNA, 25 bp, synthetic construct
  misc_feature 1..25: note = Synthetic Construct
  source 1..25: mol_type = other DNA
gaggaaggagatattggaggtgtct

SEQ ID NO: 14278 - DNA, 20 bp, synthetic construct
  misc_feature 1..20: note = Synthetic Construct
  source 1..20: mol_type = other DNA
gccagccttgagtccagtga

SEQ ID NO: 14279 - DNA, 21 bp, synthetic construct
  misc_feature 1..21: note = Synthetic Construct
  source 1..21: mol_type = other DNA
aacctgtcagcttcagccaaa

SEQ ID NO: 14280 - DNA, 24 bp, synthetic construct
  misc_feature 1..24: note = Synthetic Construct
  source 1..24: mol_type = other DNA
tgcgctgattattagtgtcaggtt

SEQ ID NO: 14281 - DNA, 25 bp, synthetic construct
  misc_feature 1..25: note = Synthetic Construct
  source 1..25: mol_type = other DNA
gagttcacccttcagcaaatgaaca

SEQ ID NO: 14282 - DNA, 22 bp, synthetic construct
  misc_feature 1..22: note = Synthetic Construct
  source 1..22: mol_type = other DNA
acactgatctccactcccagat

SEQ ID NO: 14283 - DNA, 19 bp, synthetic construct
  misc_feature 1..19: note = Synthetic Construct
  source 1..19: mol_type = other DNA
agcctcgaacctccgcaaa

SEQ ID NO: 14284 - DNA, 22 bp, synthetic construct
  misc_feature 1..22: note = Synthetic Construct
  source 1..22: mol_type = other DNA
ggagaaaccaaaggcccacagt

SEQ ID NO: 14285 - DNA, 25 bp, synthetic construct
  misc_feature 1..25: note = Synthetic Construct
  source 1..25: mol_type = other DNA
gaagaagagaaggcaatgtgaccat

SEQ ID NO: 14286 - DNA, 20 bp, synthetic construct
  misc_feature 1..20: note = Synthetic Construct
  source 1..20: mol_type = other DNA
accccacccgctttctccat

SEQ ID NO: 14287 - DNA, 20 bp, synthetic construct
  misc_feature 1..20: note = Synthetic Construct
  source 1..20: mol_type = other DNA
ccagagaacacgggctgttt

SEQ ID NO: 14288 - DNA, 24 bp, synthetic construct
  misc_feature 1..24: note = Synthetic Construct
  source 1..24: mol_type = other DNA
cccagttcccctcctgagtttaga

SEQ ID NO: 14289 - DNA, 22 bp, synthetic construct
  misc_feature 1..22: note = Synthetic Construct
  source 1..22: mol_type = other DNA
caccctgaactccctgcgtaat

SEQ ID NO: 14290 - DNA, 21 bp, synthetic construct
  misc_feature 1..21: note = Synthetic Construct
  source 1..21: mol_type = other DNA
cctttcacagcccggtgcata

SEQ ID NO: 14291 - DNA, 24 bp, synthetic construct
  misc_feature 1..24: note = Synthetic Construct
  source 1..24: mol_type = other DNA
gtgacaatcagggtccttgtctct

SEQ ID NO: 14292 - DNA, 24 bp, synthetic construct
  misc_feature 1..24: note = Synthetic Construct
  source 1..24: mol_type = other DNA
tgaatgactgatgagatccgttgt

SEQ ID NO: 14293 - DNA, 21 bp, synthetic construct
  misc_feature 1..21: note = Synthetic Construct
  source 1..21: mol_type = other DNA
tggcaggaagatggcttgaga

SEQ ID NO: 14294 - DNA, 22 bp, synthetic construct
  misc_feature 1..22: note = Synthetic Construct
  source 1..22: mol_type = other DNA
agccagtaagggatgggctgat

SEQ ID NO: 14295 - DNA, 25 bp, synthetic construct
  misc_feature 1..25: note = Synthetic Construct
  source 1..25: mol_type = other DNA
tcttctccctcacagcaaatctttt

SEQ ID NO: 14296 - DNA, 23 bp, synthetic construct
  misc_feature 1..23: note = Synthetic Construct
  source 1..23: mol_type = other DNA
ccaggcatctgattcagtgtcaa

SEQ ID NO: 14297 - DNA, 22 bp, synthetic construct
  misc_feature 1..22: note = Synthetic Construct
  source 1..22: mol_type = other DNA
cctggaatgggcttaggcatca

SEQ ID NO: 14298 - DNA, 20 bp, synthetic construct
  misc_feature 1..20: note = Synthetic Construct
  source 1..20: mol_type = other DNA
acaggcccttttggctttgt

SEQ ID NO: 14299 - DNA, 23 bp, synthetic construct
  misc_feature 1..23: note = Synthetic Construct
  source 1..23: mol_type = other DNA
ggaggccatccaacagaagattg

SEQ ID NO: 14300 - DNA, 20 bp, synthetic construct
  misc_feature 1..20: note = Synthetic Construct
  source 1..20: mol_type = other DNA
agcaggcaaggccagagtag

SEQ ID NO: 14301 - DNA, 23 bp, synthetic construct
  misc_feature 1..23: note = Synthetic Construct
  source 1..23: mol_type = other DNA
gtgaaacccctgttcttggttga

SEQ ID NO: 14302 - DNA, 22 bp, synthetic construct
  misc_feature 1..22: note = Synthetic Construct
  source 1..22: mol_type = other DNA
aggaggggcaccaacttacaga

SEQ ID NO: 14303 - DNA, 26 bp, synthetic construct
  misc_feature 1..26: note = Synthetic Construct
  source 1..26: mol_type = other DNA
ggggctaaagtcatctcaccctaaag

SEQ ID NO: 14304 - DNA, 22 bp, synthetic construct
  misc_feature 1..22: note = Synthetic Construct
  source 1..22: mol_type = other DNA
ctgccccattgacagaggttct

SEQ ID NO: 14305 - DNA, 22 bp, synthetic construct
  misc_feature 1..22: note = Synthetic Construct
  source 1..22: mol_type = other DNA
cacctcctcacccgctattgta

SEQ ID NO: 14306 - DNA, 24 bp, synthetic construct
  misc_feature 1..24: note = Synthetic Construct
  source 1..24: mol_type = other DNA
gatgtaggagtcatggggatcttg

SEQ ID NO: 14307 - DNA, 23 bp, synthetic construct
  misc_feature 1..23: note = Synthetic Construct
  source 1..23: mol_type = other DNA
gagctagcagtatagcactggtt

SEQ ID NO: 14308 - DNA, 20 bp, synthetic construct
  misc_feature 1..20: note = Synthetic Construct
  source 1..20: mol_type = other DNA
caagcgggtgcaacagatga

SEQ ID NO: 14309 - DNA, 20 bp, synthetic construct
  misc_feature 1..20: note = Synthetic Construct
  source 1..20: mol_type = other DNA
cacgtggtccctgcagtcat

SEQ ID NO: 14310 - DNA, 25 bp, synthetic construct
  misc_feature 1..25: note = Synthetic Construct
  source 1..25: mol_type = other DNA
gcctgaggagagaatgaagggttct

SEQ ID NO: 14311 - DNA, 23 bp, synthetic construct
  misc_feature 1..23: note = Synthetic Construct
  source 1..23: mol_type = other DNA
gcagtggtgattgccttggagtt

SEQ ID NO: 14312 - DNA, 25 bp, synthetic construct
  misc_feature 1..25: note = Synthetic Construct
  source 1..25: mol_type = other DNA
cgggaacaagcttctttggtaaatg

SEQ ID NO: 14313 - DNA, 23 bp, synthetic construct
  misc_feature 1..23: note = Synthetic Construct
  source 1..23: mol_type = other DNA
ataccctgggacgagagggacat

SEQ ID NO: 14314 - DNA, 25 bp, synthetic construct
  misc_feature 1..25: note = Synthetic Construct
  source 1..25: mol_type = other DNA
gaaaccttgcaggtgtattgactct

SEQ ID NO: 14315 - DNA, 24 bp, synthetic construct
  misc_feature 1..24: note = Synthetic Construct
  source 1..24: mol_type = other DNA
ccactagcctgtagggtaaagttc

SEQ ID NO: 14316 - DNA, 25 bp, synthetic construct
  misc_feature 1..25: note = Synthetic Construct
  source 1..25: mol_type = other DNA
ccttgccctccaaatctatgtgact

SEQ ID NO: 14317 - DNA, 22 bp, synthetic construct
  misc_feature 1..22: note = Synthetic Construct
  source 1..22: mol_type = other DNA
gagcaaaaccaccagggaacaa

SEQ ID NO: 14318 - DNA, 26 bp, synthetic construct
  misc_feature 1..26: note = Synthetic Construct
  source 1..26: mol_type = other DNA
gtgtagacagaaaccttgacccagat

SEQ ID NO: 14319 - DNA, 23 bp, synthetic construct
  misc_feature 1..23: note = Synthetic Construct
  source 1..23: mol_type = other DNA
gcctgaggtggaactttggtctt

SEQ ID NO: 14320 - DNA, 20 bp, synthetic construct
  misc_feature 1..20: note = Synthetic Construct
  source 1..20: mol_type = other DNA
gcctggatttggccttctct

SEQ ID NO: 14321 - DNA, 21 bp, synthetic construct
  misc_feature 1..21: note = Synthetic Construct
  source 1..21: mol_type = other DNA
tcagggcctgctcttgcacta

SEQ ID NO: 14322 - DNA, 27 bp, synthetic construct
  misc_feature 1..27: note = Synthetic Construct
  source 1..27: mol_type = other DNA
ggagagaacgtggattatagaccgttt

SEQ ID NO: 14323 - DNA, 25 bp, synthetic construct
  misc_feature 1..25: note = Synthetic Construct
  source 1..25: mol_type = other DNA
cccatctagtcttctgctggcgata

SEQ ID NO: 14324 - DNA, 22 bp, synthetic construct
  misc_feature 1..22: note = Synthetic Construct
  source 1..22: mol_type = other DNA
tcttggctagggcgttagtaga

SEQ ID NO: 14325 - DNA, 25 bp, synthetic construct
  misc_feature 1..25: note = Synthetic Construct
  source 1..25: mol_type = other DNA
gtctgacccaaggaaaacgttctga

SEQ ID NO: 14326 - DNA, 24 bp, synthetic construct
  misc_feature 1..24: note = Synthetic Construct
  source 1..24: mol_type = other DNA
gagctcaggtctggactacttgaa

SEQ ID NO: 14327 - DNA, 24 bp, synthetic construct
  misc_feature 1..24: note = Synthetic Construct
  source 1..24: mol_type = other DNA
gggtctcccaaagattctccagat

SEQ ID NO: 14328 - DNA, 22 bp, synthetic construct
  misc_feature 1..22: note = Synthetic Construct
  source 1..22: mol_type = other DNA
gggtggatgatgcttgggtaac

SEQ ID NO: 14329 - DNA, 23 bp, synthetic construct
  misc_feature 1..23: note = Synthetic Construct
  source 1..23: mol_type = other DNA
gtgaggcaacccagagaatcata

SEQ ID NO: 14330 - DNA, 24 bp, synthetic construct
  misc_feature 1..24: note = Synthetic Construct
  source 1..24: mol_type = other DNA
cccacaatcaggaaaattgcttca

SEQ ID NO: 14331 - DNA, 23 bp, synthetic construct
  misc_feature 1..23: note = Synthetic Construct
  source 1..23: mol_type = other DNA
cagggaactgggcataagccttt

SEQ ID NO: 14332 - DNA, 22 bp, synthetic construct
  misc_feature 1..22: note = Synthetic Construct
  source 1..22: mol_type = other DNA
agccctggctaattctctctca

SEQ ID NO: 14333 - DNA, 21 bp, synthetic construct
  misc_feature 1..21: note = Synthetic Construct
  source 1..21: mol_type = other DNA
cttccggccgagaatatggaa

SEQ ID NO: 14334 - DNA, 23 bp, synthetic construct
  misc_feature 1..23: note = Synthetic Construct
  source 1..23: mol_type = other DNA
ccagagccccattttcctaccaa

SEQ ID NO: 14335 - DNA, 22 bp, synthetic construct
  misc_feature 1..22: note = Synthetic Construct
  source 1..22: mol_type = other DNA
ggtgcagacacaagtagtcaga

SEQ ID NO: 14336 - DNA, 21 bp, synthetic construct
  misc_feature 1..21: note = Synthetic Construct
  source 1..21: mol_type = other DNA
ggcataaggcaagagcgtcat

SEQ ID NO: 14337 - DNA, 21 bp, synthetic construct
  misc_feature 1..21: note = Synthetic Construct
  source 1..21: mol_type = other DNA
tgttgtgactgctgccttgta

SEQ ID NO: 14338 - DNA, 20 bp, synthetic construct
  misc_feature 1..20: note = Synthetic Construct
  source 1..20: mol_type = other DNA
ccgtcgctgaagttgcatca

SEQ ID NO: 14339 - DNA, 22 bp, synthetic construct
  misc_feature 1..22: note = Synthetic Construct
  source 1..22: mol_type = other DNA
gagcctccctcacctttcagat

SEQ ID NO: 14340 - DNA, 25 bp, synthetic construct
  misc_feature 1..25: note = Synthetic Construct
  source 1..25: mol_type = other DNA
ctcaggggtggatctttaagccttt

SEQ ID NO: 14341 - DNA, 23 bp, synthetic construct
  misc_feature 1..23: note = Synthetic Construct
  source 1..23: mol_type = other DNA
gccagcacacagtcatagtgaac

SEQ ID NO: 14342 - DNA, 21 bp, synthetic construct
  misc_feature 1..21: note = Synthetic Construct
  source 1..21: mol_type = other DNA
aaccgcaggtttctgagtcaa

SEQ ID NO: 14343 - DNA, 22 bp, synthetic construct
  misc_feature 1..22: note = Synthetic Construct
  source 1..22: mol_type = other DNA
ggtttgtgcagctggttgacat

SEQ ID NO: 14344 - DNA, 21 bp, synthetic construct
  misc_feature 1..21: note = Synthetic Construct
  source 1..21: mol_type = other DNA
ccctcctgcaaacaagcaact

SEQ ID NO: 14345 - DNA, 23 bp, synthetic construct
  misc_feature 1..23: note = Synthetic Construct
  source 1..23: mol_type = other DNA
gtgaggcagtatccagcttctca

SEQ ID NO: 14346 - DNA, 24 bp, synthetic construct
  misc_feature 1..24: note = Synthetic Construct
  source 1..24: mol_type = other DNA
ccaaacctcccagctctgtcattc

SEQ ID NO: 14347 - DNA, 21 bp, synthetic construct
  misc_feature 1..21: note = Synthetic Construct
  source 1..21: mol_type = other DNA
actcagcccctgccaaagaag

SEQ ID NO: 14348 - DNA, 21 bp, synthetic construct
  misc_feature 1..21: note = Synthetic Construct
  source 1..21: mol_type = other DNA
cgcccagccctgtgatgtaaa

SEQ ID NO: 14349 - DNA, 19 bp, synthetic construct
  misc_feature 1..19: note = Synthetic Construct
  source 1..19: mol_type = other DNA
ttgtgcccaggcccttttc

SEQ ID NO: 14350 - DNA, 23 bp, synthetic construct
  misc_feature 1..23: note = Synthetic Construct
  source 1..23: mol_type = other DNA
tgttgttgaggtgttaccactgt

SEQ ID NO: 14351 - DNA, 21 bp, synthetic construct
  misc_feature 1..21: note = Synthetic Construct
  source 1..21: mol_type = other DNA
tctgcccttggcactgtgaga

SEQ ID NO: 14352 - DNA, 19 bp, synthetic construct
  misc_feature 1..19: note = Synthetic Construct
  source 1..19: mol_type = other DNA
gcatgtggggcagcacgta

SEQ ID NO: 14353 - DNA, 25 bp, synthetic construct
  misc_feature 1..25: note = Synthetic Construct
  source 1..25: mol_type = other DNA
ggctattccgtcagttactgcacat

SEQ ID NO: 14354 - DNA, 20 bp, synthetic construct
  misc_feature 1..20: note = Synthetic Construct
  source 1..20: mol_type = other DNA
gccaagccagagggagcatt

SEQ ID NO: 14355 - DNA, 22 bp, synthetic construct
  misc_feature 1..22: note = Synthetic Construct
  source 1..22: mol_type = other DNA
ccacccagaggccaatgctaag

SEQ ID NO: 14356 - DNA, 20 bp, synthetic construct
  misc_feature 1..20: note = Synthetic Construct
  source 1..20: mol_type = other DNA
tccaagcttcgctgctcttg

SEQ ID NO: 14357 - DNA, 23 bp, synthetic construct
  misc_feature 1..23: note = Synthetic Construct
  source 1..23: mol_type = other DNA
agacatggccagacaagacatag

SEQ ID NO: 14358 - DNA, 22 bp, synthetic construct
  misc_feature 1..22: note = Synthetic Construct
  source 1..22: mol_type = other DNA
cagtcttgctcttccccagagt

SEQ ID NO: 14359 - DNA, 20 bp, synthetic construct
  misc_feature 1..20: note = Synthetic Construct
  source 1..20: mol_type = other DNA
agccaggtgcgtagcataag

SEQ ID NO: 14360 - DNA, 20 bp, synthetic construct
  misc_feature 1..20: note = Synthetic Construct
  source 1..20: mol_type = other DNA
tgggcccttgttgacccaat

SEQ ID NO: 14361 - DNA, 26 bp, synthetic construct
  misc_feature 1..26: note = Synthetic Construct
  source 1..26: mol_type = other DNA
gtagggtcgatttcatcttcccacta

SEQ ID NO: 14362 - DNA, 22 bp, synthetic construct
  misc_feature 1..22: note = Synthetic Construct
  source 1..22: mol_type = other DNA
gcatctacacggcacatccata

SEQ ID NO: 14363 - DNA, 23 bp, synthetic construct
  misc_feature 1..23: note = Synthetic Construct
  source 1..23: mol_type = other DNA
gagggtaagccagagaaccaatg

SEQ ID NO: 14364 - DNA, 22 bp, synthetic construct
  misc_feature 1..22: note = Synthetic Construct
  source 1..22: mol_type = other DNA
aggagctccgagaaacaagact

SEQ ID NO: 14365 - DNA, 21 bp, synthetic construct
  misc_feature 1..21: note = Synthetic Construct
  source 1..21: mol_type = other DNA
caggtggcgggaacttaatga

SEQ ID NO: 14366 - DNA, 22 bp, synthetic construct
  misc_feature 1..22: note = Synthetic Construct
  source 1..22: mol_type = other DNA
gagctgcaggaggaagaagatg

SEQ ID NO: 14367 - DNA, 24 bp, synthetic construct
  misc_feature 1..24: note = Synthetic Construct
  source 1..24: mol_type = other DNA
gtgcctattggaagcctgaattgt

SEQ ID NO: 14368 - DNA, 22 bp, synthetic construct
  misc_feature 1..22: note = Synthetic Construct
  source 1..22: mol_type = other DNA
agcccttgtagacctgggattc

SEQ ID NO: 14369 - DNA, 21 bp, synthetic construct
  misc_feature 1..21: note = Synthetic Construct
  source 1..21: mol_type = other DNA
ttcaggggcctttgcctcttc

SEQ ID NO: 14370 - DNA, 24 bp, synthetic construct
  misc_feature 1..24: note = Synthetic Construct
  source 1..24: mol_type = other DNA
cctggacctaagccggaagtcata

SEQ ID NO: 14371 - DNA, 22 bp, synthetic construct
  misc_feature 1..22: note = Synthetic Construct
  source 1..22: mol_type = other DNA
gggcatgatgaagaggcactaa

SEQ ID NO: 14372 - DNA, 21 bp, synthetic construct
  misc_feature 1..21: note = Synthetic Construct
  source 1..21: mol_type = other DNA
gctctccccagcctgttctct

SEQ ID NO: 14373 - DNA, 22 bp, synthetic construct
  misc_feature 1..22: note = Synthetic Construct
  source 1..22: mol_type = other DNA
cgacagccatctctgactggtt

SEQ ID NO: 14374 - DNA, 22 bp, synthetic construct
  misc_feature 1..22: note = Synthetic Construct
  source 1..22: mol_type = other DNA
gatggccaggtaacggtcatag

SEQ ID NO: 14375 - DNA, 21 bp, synthetic construct
  misc_feature 1..21: note = Synthetic Construct
  source 1..21: mol_type = other DNA
tcgggtttggaggggtagaga

SEQ ID NO: 14376 - DNA, 22 bp, synthetic construct
  misc_feature 1..22: note = Synthetic Construct
  source 1..22: mol_type = other DNA
ggaaacaccctgaggctaggta

SEQ ID NO: 14377 - DNA, 24 bp, synthetic construct
  misc_feature 1..24: note = Synthetic Construct
  source 1..24: mol_type = other DNA
ggagtggggttacagaggatgtag

SEQ ID NO: 14378 - DNA, 24 bp, synthetic construct
  misc_feature 1..24: note = Synthetic Construct
  source 1..24: mol_type = other DNA
gtatgccaggtgctatgctaaaag

SEQ ID NO: 14379 - DNA, 24 bp, synthetic construct
  misc_feature 1..24: note = Synthetic Construct
  source 1..24: mol_type = other DNA
gtttgccactttctctcacctctt

SEQ ID NO: 14380 - DNA, 26 bp, synthetic construct
  misc_feature 1..26: note = Synthetic Construct
  source 1..26: mol_type = other DNA
gacttaatcccaggaccctctgtttt

SEQ ID NO: 14381 - DNA, 22 bp, synthetic construct
  misc_feature 1..22: note = Synthetic Construct
  source 1..22: mol_type = other DNA
ggcccttgtcaagtttcagaca

SEQ ID NO: 14382 - DNA, 22 bp, synthetic construct
  misc_feature 1..22: note = Synthetic Construct
  source 1..22: mol_type = other DNA
cccctcacaaaagcttctgcat

SEQ ID NO: 14383 - DNA, 22 bp, synthetic construct
  misc_feature 1..22: note = Synthetic Construct
  source 1..22: mol_type = other DNA
tcccttagagaccgacctttgt

SEQ ID NO: 14384 - DNA, 21 bp, synthetic construct
  misc_feature 1..21: note = Synthetic Construct
  source 1..21: mol_type = other DNA
ggcacgtgggatacaccacta

SEQ ID NO: 14385 - DNA, 19 bp, synthetic construct
  misc_feature 1..19: note = Synthetic Construct
  source 1..19: mol_type = other DNA
aaacggggccttgctgctt

SEQ ID NO: 14386 - DNA, 22 bp, synthetic construct
  misc_feature 1..22: note = Synthetic Construct
  source 1..22: mol_type = other DNA
ggacatctcctcaaggcttgtt

SEQ ID NO: 14387 - DNA, 25 bp, synthetic construct
  misc_feature 1..25: note = Synthetic Construct
  source 1..25: mol_type = other DNA
cacccttcttgaagccttccttgat

SEQ ID NO: 14388 - DNA, 20 bp, synthetic construct
  misc_feature 1..20: note = Synthetic Construct
  source 1..20: mol_type = other DNA
tgccaccatgcccatctaag

SEQ ID NO: 14389 - DNA, 20 bp, synthetic construct
  misc_feature 1..20: note = Synthetic Construct
  source 1..20: mol_type = other DNA
tggcaggaagccactggaaa

SEQ ID NO: 14390 - DNA, 24 bp, synthetic construct
  misc_feature 1..24: note = Synthetic Construct
  source 1..24: mol_type = other DNA
agcctccactctttctcataggat

SEQ ID NO: 14391 - DNA, 20 bp, synthetic construct
  misc_feature 1..20: note = Synthetic Construct
  source 1..20: mol_type = other DNA
agcacctttgcaacctcctt

SEQ ID NO: 14392 - DNA, 27 bp, synthetic construct
  misc_feature 1..27: note = Synthetic Construct
  source 1..27: mol_type = other DNA
gtccatgggaaattcacagagaaggaa

SEQ ID NO: 14393 - DNA, 22 bp, synthetic construct
  misc_feature 1..22: note = Synthetic Construct
  source 1..22: mol_type = other DNA
caaggctggagcttaccaggtt

SEQ ID NO: 14394 - DNA, 23 bp, synthetic construct
  misc_feature 1..23: note = Synthetic Construct
  source 1..23: mol_type = other DNA
cgccagctaaaacacccaaatca

SEQ ID NO: 14395 - DNA, 22 bp, synthetic construct
  misc_feature 1..22: note = Synthetic Construct
  source 1..22: mol_type = other DNA
ccagcagacacagcagtctagt

SEQ ID NO: 14396 - DNA, 22 bp, synthetic construct
  misc_feature 1..22: note = Synthetic Construct
  source 1..22: mol_type = other DNA
tgtaggcccagttgagctcttg

SEQ ID NO: 14397 - DNA, 21 bp, synthetic construct
  misc_feature 1..21: note = Synthetic Construct
  source 1..21: mol_type = other DNA
accatggcccagggcttctat

SEQ ID NO: 14398 - DNA, 20 bp, synthetic construct
  misc_feature 1..20: note = Synthetic Construct
  source 1..20: mol_type = other DNA
tggcagggctcattctgatg

SEQ ID NO: 14399 - DNA, 26 bp, synthetic construct
  misc_feature 1..26: note = Synthetic Construct
  source 1..26: mol_type = other DNA
gccaaactggaaattgtttcggtact

SEQ ID NO: 14400 - DNA, 22 bp, synthetic construct
  misc_feature 1..22: note = Synthetic Construct
  source 1..22: mol_type = other DNA
tggatggaatgctctcccttct

SEQ ID NO: 14401 - DNA, 24 bp, synthetic construct
  misc_feature 1..24: note = Synthetic Construct
  source 1..24: mol_type = other DNA
tgagctgtgctaaaatggactctt

SEQ ID NO: 14402 - DNA, 22 bp, synthetic construct
  misc_feature 1..22: note = Synthetic Construct
  source 1..22: mol_type = other DNA
ctccccgactcaccatttggat

SEQ ID NO: 14403 - DNA, 21 bp, synthetic construct
  misc_feature 1..21: note = Synthetic Construct
  source 1..21: mol_type = other DNA
gcttgctggaaaatggcaagt

SEQ ID NO: 14404 - DNA, 20 bp, synthetic construct
  misc_feature 1..20: note = Synthetic Construct
  source 1..20: mol_type = other DNA
tgttgacaggccccaacctt

SEQ ID NO: 14405 - DNA, 22 bp, synthetic construct
  misc_feature 1..22: note = Synthetic Construct
  source 1..22: mol_type = other DNA
gcttggcctatggttggttact

SEQ ID NO: 14406 - DNA, 23 bp, synthetic construct
  misc_feature 1..23: note = Synthetic Construct
  source 1..23: mol_type = other DNA
gatggaagcaggtgacagtgttc

SEQ ID NO: 14407 - DNA, 23 bp, synthetic construct
  misc_feature 1..23: note = Synthetic Construct
  source 1..23: mol_type = other DNA
agcacccagttgtaacaaacagt

SEQ ID NO: 14408 - DNA, 21 bp, synthetic construct
  misc_feature 1..21: note = Synthetic Construct
  source 1..21: mol_type = other DNA
atgtgggttctggggctctgt

SEQ ID NO: 14409 - DNA, 22 bp, synthetic construct
  misc_feature 1..22: note = Synthetic Construct
  source 1..22: mol_type = other DNA
cttgcttgtgcaagaactggaa

SEQ ID NO: 14410 - DNA, 20 bp, synthetic construct
  misc_feature 1..20: note = Synthetic Construct
  source 1..20: mol_type = other DNA
acccgccttcactgcaaatg

SEQ ID NO: 14411 - DNA, 23 bp, synthetic construct
  misc_feature 1..23: note = Synthetic Construct
  source 1..23: mol_type = other DNA
aggtctacacctggcactatgta

SEQ ID NO: 14412 - DNA, 22 bp, synthetic construct
  misc_feature 1..22: note = Synthetic Construct
  source 1..22: mol_type = other DNA
ggctgaaaggggcttgtaatga

SEQ ID NO: 14413 - DNA, 23 bp, synthetic construct
  misc_feature 1..23: note = Synthetic Construct
  source 1..23: mol_type = other DNA
cttggcactgcagattcaaagtt

SEQ ID NO: 14414 - DNA, 21 bp, synthetic construct
  misc_feature 1..21: note = Synthetic Construct
  source 1..21: mol_type = other DNA
acgcagaaaactggtggatgt

SEQ ID NO: 14415 - DNA, 19 bp, synthetic construct
  misc_feature 1..19: note = Synthetic Construct
  source 1..19: mol_type = other DNA
tcctgcctcacgccctttc

SEQ ID NO: 14416 - DNA, 22 bp, synthetic construct
  misc_feature 1..22: note = Synthetic Construct
  source 1..22: mol_type = other DNA
gcggggccactttcttacagtt

SEQ ID NO: 14417 - DNA, 21 bp, synthetic construct
  misc_feature 1..21: note = Synthetic Construct
  source 1..21: mol_type = other DNA
gacctggggagcaaatagcaa

SEQ ID NO: 14418 - DNA, 23 bp, synthetic construct
  misc_feature 1..23: note = Synthetic Construct
  source 1..23: mol_type = other DNA
gttttgcaaagttgctgggtaga

SEQ ID NO: 14419 - DNA, 22 bp, synthetic construct
  misc_feature 1..22: note = Synthetic Construct
  source 1..22: mol_type = other DNA
tggaggcaccactcaggtttga

SEQ ID NO: 14420 - DNA, 23 bp, synthetic construct
  misc_feature 1..23: note = Synthetic Construct
  source 1..23: mol_type = other DNA
gagtgcagtgtcgtatggtggaa

SEQ ID NO: 14421 - DNA, 20 bp, synthetic construct
  misc_feature 1..20: note = Synthetic Construct
  source 1..20: mol_type = other DNA
ccctgcctgctgtgtttttc

SEQ ID NO: 14422 - DNA, 21 bp, synthetic construct
  misc_feature 1..21: note = Synthetic Construct
  source 1..21: mol_type = other DNA
tgcacctccagctgtgtgact

SEQ ID NO: 14423 - DNA, 22 bp, synthetic construct
  misc_feature 1..22: note = Synthetic Construct
  source 1..22: mol_type = other DNA
tcccttcactcaccatccagaa

SEQ ID NO: 14424 - DNA, 20 bp, synthetic construct
  misc_feature 1..20: note = Synthetic Construct
  source 1..20: mol_type = other DNA
ggagccaccttggggatctt

SEQ ID NO: 14425 - DNA, 21 bp, synthetic construct
  misc_feature 1..21: note = Synthetic Construct
  source 1..21: mol_type = other DNA
gggccagtcttcatggacctt

SEQ ID NO: 14426 - DNA, 21 bp, synthetic construct
  misc_feature 1..21: note = Synthetic Construct
  source 1..21: mol_type = other DNA
ccagattggctcccactgaaa

SEQ ID NO: 14427 - DNA, 23 bp, synthetic construct
  misc_feature 1..23: note = Synthetic Construct
  source 1..23: mol_type = other DNA
gcctctgttccatccccttcttc

SEQ ID NO: 14428 - DNA, 24 bp, synthetic construct
  misc_feature 1..24: note = Synthetic Construct
  source 1..24: mol_type = other DNA
cagtaacgctcaccacaagttaca

SEQ ID NO: 14429 - DNA, 21 bp, synthetic construct
  misc_feature 1..21: note = Synthetic Construct
  source 1..21: mol_type = other DNA
gctgctggacaccaagtgcat

SEQ ID NO: 14430 - DNA, 18 bp, synthetic construct
  misc_feature 1..18: note = Synthetic Construct
  source 1..18: mol_type = other DNA
tcccctcacgtggctgaa

SEQ ID NO: 14431 - DNA, 25 bp, synthetic construct
  misc_feature 1..25: note = Synthetic Construct
  source 1..25: mol_type = other DNA
tggtcacgaatcaaaatccttccta

SEQ ID NO: 14432 - DNA, 25 bp, synthetic construct
  misc_feature 1..25: note = Synthetic Construct
  source 1..25: mol_type = other DNA
gaaggtagcagaaggaggtttgaga

SEQ ID NO: 14433 - DNA, 20 bp, synthetic construct
  misc_feature 1..20: note = Synthetic Construct
  source 1..20: mol_type = other DNA
aacgggaagcctccaaccaa

SEQ ID NO: 14434 - DNA, 22 bp, synthetic construct
  misc_feature 1..22: note = Synthetic Construct
  source 1..22: mol_type = other DNA
cccaactccattgccccagatt

SEQ ID NO: 14435 - DNA, 22 bp, synthetic construct
  misc_feature 1..22: note = Synthetic Construct
  source 1..22: mol_type = other DNA
tttcaccacaatccagcagtct

SEQ ID NO: 14436 - DNA, 23 bp, synthetic construct
  misc_feature 1..23: note = Synthetic Construct
  source 1..23: mol_type = other DNA
tcttttgtatccccacagtgctt

SEQ ID NO: 14437 - DNA, 27 bp, synthetic construct
  misc_feature 1..27: note = Synthetic Construct
  source 1..27: mol_type = other DNA
gcaccacgtatgtacttgtaagggttt

SEQ ID NO: 14438 - DNA, 21 bp, synthetic construct
  misc_feature 1..21: note = Synthetic Construct
  source 1..21: mol_type = other DNA
tgtcaagctggttgtgtcctt

SEQ ID NO: 14439 - DNA, 20 bp, synthetic construct
  misc_feature 1..20: note = Synthetic Construct
  source 1..20: mol_type = other DNA
tggcagaacatcccgtgtct

SEQ ID NO: 14440 - DNA, 25 bp, synthetic construct
  misc_feature 1..25: note = Synthetic Construct
  source 1..25: mol_type = other DNA
ggggaggcttaaaggaacagcttag

SEQ ID NO: 14441 - DNA, 23 bp, synthetic construct
  misc_feature 1..23: note = Synthetic Construct
  source 1..23: mol_type = other DNA
gcatccgctgagaattggtgttg

SEQ ID NO: 14442 - DNA, 26 bp, synthetic construct
  misc_feature 1..26: note = Synthetic Construct
  source 1..26: mol_type = other DNA
agagtctaaggggctctttatcctta

SEQ ID NO: 14443 - DNA, 24 bp, synthetic construct
  misc_feature 1..24: note = Synthetic Construct
  source 1..24: mol_type = other DNA
tgtggtctcaagcagatgatacaa

SEQ ID NO: 14444 - DNA, 23 bp, synthetic construct
  misc_feature 1..23: note = Synthetic Construct
  source 1..23: mol_type = other DNA
tgttctagggagttctcggcttt

SEQ ID NO: 14445 - DNA, 23 bp, synthetic construct
  misc_feature 1..23: note = Synthetic Construct
  source 1..23: mol_type = other DNA
gggctgtattcacacagggaaca

SEQ ID NO: 14446 - DNA, 22 bp, synthetic construct
  misc_feature 1..22: note = Synthetic Construct
  source 1..22: mol_type = other DNA
ggggccagtaagcaaagactca

SEQ ID NO: 14447 - DNA, 24 bp, synthetic construct
  misc_feature 1..24: note = Synthetic Construct
  source 1..24: mol_type = other DNA
ccaatctgggcatctgagtaactt

SEQ ID NO: 14448 - DNA, 20 bp, synthetic construct
  misc_feature 1..20: note = Synthetic Construct
  source 1..20: mol_type = other DNA
ccaggtgcccacatttctct

SEQ ID NO: 14449 - DNA, 20 bp, synthetic construct
  misc_feature 1..20: note = Synthetic Construct
  source 1..20: mol_type = other DNA
aagacctgccagggtcatca

SEQ ID NO: 14450 - DNA, 25 bp, synthetic construct
  misc_feature 1..25: note = Synthetic Construct
  source 1..25: mol_type = other DNA
ggtggggctaaaaatcaggtagatg

SEQ ID NO: 14451 - DNA, 28 bp, synthetic construct
  misc_feature 1..28: note = Synthetic Construct
  source 1..28: mol_type = other DNA
cctctgatctcttgtatcagtgggaatc

SEQ ID NO: 14452 - DNA, 23 bp, synthetic construct
  misc_feature 1..23: note = Synthetic Construct
  source 1..23: mol_type = other DNA
cgaacaacactggggtacagcta

SEQ ID NO: 14453 - DNA, 25 bp, synthetic construct
  misc_feature 1..25: note = Synthetic Construct
  source 1..25: mol_type = other DNA
gggtctacgtttttatgcagtcaag

SEQ ID NO: 14454 - DNA, 23 bp, synthetic construct
  misc_feature 1..23: note = Synthetic Construct
  source 1..23: mol_type = other DNA
gcctctgtgtcactcttggcttt

SEQ ID NO: 14455 - DNA, 24 bp, synthetic construct
  misc_feature 1..24: note = Synthetic Construct
  source 1..24: mol_type = other DNA
ggctcttggtaattgttgccatgt

SEQ ID NO: 14456 - DNA, 24 bp, synthetic construct
  misc_feature 1..24: note = Synthetic Construct
  source 1..24: mol_type = other DNA
cagagtgtctcagctgtcctaagt

SEQ ID NO: 14457 - DNA, 21 bp, synthetic construct
  misc_feature 1..21: note = Synthetic Construct
  source 1..21: mol_type = other DNA
gcacaggtttggtgcctgaca

SEQ ID NO: 14458 - DNA, 22 bp, synthetic construct
  misc_feature 1..22: note = Synthetic Construct
  source 1..22: mol_type = other DNA
ctcactgcttgctgtgttgttg

SEQ ID NO: 14459 - DNA, 25 bp, synthetic construct
  misc_feature 1..25: note = Synthetic Construct
  source 1..25: mol_type = other DNA
ggtgtgcctaagaatgtagtcctaa

SEQ ID NO: 14460 - DNA, 24 bp, synthetic construct
  misc_feature 1..24: note = Synthetic Construct
  source 1..24: mol_type = other DNA
gtcactacaactgcaccttgtcta

SEQ ID NO: 14461 - DNA, 20 bp, synthetic construct
  misc_feature 1..20: note = Synthetic Construct
  source 1..20: mol_type = other DNA
tgtgctctaccccactgtgt

SEQ ID NO: 14462 - DNA, 21 bp, synthetic construct
  misc_feature 1..21: note = Synthetic Construct
  source 1..21: mol_type = other DNA
gcagaagcttcctcctagcaa

SEQ ID NO: 14463 - DNA, 20 bp, synthetic construct
  misc_feature 1..20: note = Synthetic Construct
  source 1..20: mol_type = other DNA
tccccatcgcttgttgttga

SEQ ID NO: 14464 - DNA, 21 bp, synthetic construct
  misc_feature 1..21: note = Synthetic Construct
  source 1..21: mol_type = other DNA
aggatggccttagctgctttg

SEQ ID NO: 14465 - DNA, 23 bp, synthetic construct
  misc_feature 1..23: note = Synthetic Construct
  source 1..23: mol_type = other DNA
gggagaggaaaccagtagccatt

SEQ ID NO: 14466 - DNA, 24 bp, synthetic construct
  misc_feature 1..24: note = Synthetic Construct
  source 1..24: mol_type = other DNA
ctggaaggctgtctttcactggtt

SEQ ID NO: 14467 - DNA, 21 bp, synthetic construct
  misc_feature 1..21: note = Synthetic Construct
  source 1..21: mol_type = other DNA
aagaggctccgatggtgtttc

SEQ ID NO: 14468 - DNA, 22 bp, synthetic construct
  misc_feature 1..22: note = Synthetic Construct
  source 1..22: mol_type = other DNA
ccgcatggtacctgaggacatc

SEQ ID NO: 14469 - DNA, 20 bp, synthetic construct
  misc_feature 1..20: note = Synthetic Construct
  source 1..20: mol_type = other DNA
gctgaccacatcggctttca

SEQ ID NO: 14470 - DNA, 22 bp, synthetic construct
  misc_feature 1..22: note = Synthetic Construct
  source 1..22: mol_type = other DNA
acagggctatttcaggctcctt

SEQ ID NO: 14471 - DNA, 18 bp, synthetic construct
  misc_feature 1..18: note = Synthetic Construct
  source 1..18: mol_type = other DNA
ttgcaggcgccggtagtt

SEQ ID NO: 14472 - DNA, 21 bp, synthetic construct
  misc_feature 1..21: note = Synthetic Construct
  source 1..21: mol_type = other DNA
cggggaaatggcaaacaggat

SEQ ID NO: 14473 - DNA, 20 bp, synthetic construct
  misc_feature 1..20: note = Synthetic Construct
  source 1..20: mol_type = other DNA
tgggccgaattcaccacagt

SEQ ID NO: 14474 - DNA, 20 bp, synthetic construct
  misc_feature 1..20: note = Synthetic Construct
  source 1..20: mol_type = other DNA
ccaagccgatgcccactcta

SEQ ID NO: 14475 - DNA, 24 bp, synthetic construct
  misc_feature 1..24: note = Synthetic Construct
  source 1..24: mol_type = other DNA
cgtctttttcccagggttcgtact

SEQ ID NO: 14476 - DNA, 25 bp, synthetic construct
  misc_feature 1..25: note = Synthetic Construct
  source 1..25: mol_type = other DNA
ctcagacagatcactgctttgaaga

SEQ ID NO: 14477 - DNA, 22 bp, synthetic construct
  misc_feature 1..22: note = Synthetic Construct
  source 1..22: mol_type = other DNA
ctcatccctttctccccagcat

SEQ ID NO: 14478 - DNA, 22 bp, synthetic construct
  misc_feature 1..22: note = Synthetic Construct
  source 1..22: mol_type = other DNA
cccgaggcttgtcgttttagtt

SEQ ID NO: 14479 - DNA, 26 bp, synthetic construct
  misc_feature 1..26: note = Synthetic Construct
  source 1..26: mol_type = other DNA
caaagctctttgcattactggcttac

SEQ ID NO: 14480 - DNA, 22 bp, synthetic construct
  misc_feature 1..22: note = Synthetic Construct
  source 1..22: mol_type = other DNA
atggcagtagtgccttctcttc

SEQ ID NO: 14481 - DNA, 25 bp, synthetic construct
  misc_feature 1..25: note = Synthetic Construct
  source 1..25: mol_type = other DNA
gtggaaatgaagagagggttgacat

SEQ ID NO: 14482 - DNA, 26 bp, synthetic construct
  misc_feature 1..26: note = Synthetic Construct
  source 1..26: mol_type = other DNA
ggggagtgacagaagggaataggatt

SEQ ID NO: 14483 - DNA, 19 bp, synthetic construct
  misc_feature 1..19: note = Synthetic Construct
  source 1..19: mol_type = other DNA
cgtgacctcggccttcact

SEQ ID NO: 14484 - DNA, 22 bp, synthetic construct
  misc_feature 1..22: note = Synthetic Construct
  source 1..22: mol_type = other DNA
gacaaagacagcttggcagtga

SEQ ID NO: 14485 - DNA, 26 bp, synthetic construct
  misc_feature 1..26: note = Synthetic Construct
  source 1..26: mol_type = other DNA
cagtgctgggtctacaaaacactttc

SEQ ID NO: 14486 - DNA, 24 bp, synthetic construct
  misc_feature 1..24: note = Synthetic Construct
  source 1..24: mol_type = other DNA
tgaggaattcaaggctgaagatgt

SEQ ID NO: 14487 - DNA, 22 bp, synthetic construct
  misc_feature 1..22: note = Synthetic Construct
  source 1..22: mol_type = other DNA
ggcttgtcaccccaccaatgaa

SEQ ID NO: 14488 - DNA, 23 bp, synthetic construct
  misc_feature 1..23: note = Synthetic Construct
  source 1..23: mol_type = other DNA
ggcaatggtgaagcaggtaaaac

SEQ ID NO: 14489 - DNA, 24 bp, synthetic construct
  misc_feature 1..24: note = Synthetic Construct
  source 1..24: mol_type = other DNA
cctatcctgagacgcaggtgtgta

SEQ ID NO: 14490 - DNA, 21 bp, synthetic construct
  misc_feature 1..21: note = Synthetic Construct
  source 1..21: mol_type = other DNA
caccccacactgtccatttca

SEQ ID NO: 14491 - DNA, 22 bp, synthetic construct
  misc_feature 1..22: note = Synthetic Construct
  source 1..22: mol_type = other DNA
aaccttcctgcaaggagacaaa

SEQ ID NO: 14492 - DNA, 22 bp, synthetic construct
  misc_feature 1..22: note = Synthetic Construct
  source 1..22: mol_type = other DNA
gggtgggaagtctcctcctaga

SEQ ID NO: 14493 - DNA, 20 bp, synthetic construct
  misc_feature 1..20: note = Synthetic Construct
  source 1..20: mol_type = other DNA
acgttgagagccaacaccat

SEQ ID NO: 14494 - DNA, 23 bp, synthetic construct
  misc_feature 1..23: note = Synthetic Construct
  source 1..23: mol_type = other DNA
aattgtaccagtgcctgaagtga

SEQ ID NO: 14495 - DNA, 21 bp, synthetic construct
  misc_feature 1..21: note = Synthetic Construct
  source 1..21: mol_type = other DNA
tggcacagccagggaacagat

SEQ ID NO: 14496 - DNA, 22 bp, synthetic construct
  misc_feature 1..22: note = Synthetic Construct
  source 1..22: mol_type = other DNA
tggctacgactgtcctccttct

SEQ ID NO: 14497 - DNA, 23 bp, synthetic construct
  misc_feature 1..23: note = Synthetic Construct
  source 1..23: mol_type = other DNA
ggcagacccatctttcacaatga

SEQ ID NO: 14498 - DNA, 19 bp, synthetic construct
  misc_feature 1..19: note = Synthetic Construct
  source 1..19: mol_type = other DNA
ctggggacaagcgctcctt

SEQ ID NO: 14499 - DNA, 24 bp, synthetic construct
  misc_feature 1..24: note = Synthetic Construct
  source 1..24: mol_type = other DNA
ctggggtctttgtactctgctatt

SEQ ID NO: 14500 - DNA, 21 bp, synthetic construct
  misc_feature 1..21: note = Synthetic Construct
  source 1..21: mol_type = other DNA
gcctgctgtgtcagaggacat

SEQ ID NO: 14501 - DNA, 23 bp, synthetic construct
  misc_feature 1..23: note = Synthetic Construct
  source 1..23: mol_type = other DNA
caccaggtactcgatccatctct

SEQ ID NO: 14502 - DNA, 21 bp, synthetic construct
  misc_feature 1..21: note = Synthetic Construct
  source 1..21: mol_type = other DNA
agttccgagatgaccccatga

SEQ ID NO: 14503 - DNA, 20 bp, synthetic construct
  misc_feature 1..20: note = Synthetic Construct
  source 1..20: mol_type = other DNA
tcttggggaccagtgcatca

SEQ ID NO: 14504 - DNA, 21 bp, synthetic construct
  misc_feature 1..21: note = Synthetic Construct
  source 1..21: mol_type = other DNA
aggggacagggagagtgatct

SEQ ID NO: 14505 - DNA, 22 bp, synthetic construct
  misc_feature 1..22: note = Synthetic Construct
  source 1..22: mol_type = other DNA
cagaacaggtggtagggagaga

SEQ ID NO: 14506 - DNA, 22 bp, synthetic construct
  misc_feature 1..22: note = Synthetic Construct
  source 1..22: mol_type = other DNA
gcttccctcattcttgggaact

SEQ ID NO: 14507 - DNA, 24 bp, synthetic construct
  misc_feature 1..24: note = Synthetic Construct
  source 1..24: mol_type = other DNA
cttccgtggtctatgggtttatga

SEQ ID NO: 14508 - DNA, 25 bp, synthetic construct
  misc_feature 1..25: note = Synthetic Construct
  source 1..25: mol_type = other DNA
cctggactctttcaggttctgaagt

SEQ ID NO: 14509 - DNA, 20 bp, synthetic construct
  misc_feature 1..20: note = Synthetic Construct
  source 1..20: mol_type = other DNA
gcaggccttaggctttgcta

SEQ ID NO: 14510 - DNA, 22 bp, synthetic construct
  misc_feature 1..22: note = Synthetic Construct
  source 1..22: mol_type = other DNA
gagagatgctgcactggactca

SEQ ID NO: 14511 - DNA, 22 bp, synthetic construct
  misc_feature 1..22: note = Synthetic Construct
  source 1..22: mol_type = other DNA
cagcctcgtggaagcagaagta

SEQ ID NO: 14512 - DNA, 25 bp, synthetic construct
  misc_feature 1..25: note = Synthetic Construct
  source 1..25: mol_type = other DNA
ggcaatgtttaggaggactttctca

SEQ ID NO: 14513 - DNA, 22 bp, synthetic construct
  misc_feature 1..22: note = Synthetic Construct
  source 1..22: mol_type = other DNA
aaggacatctgcgaggaaagtt

SEQ ID NO: 14514 - DNA, 23 bp, synthetic construct
  misc_feature 1..23: note = Synthetic Construct
  source 1..23: mol_type = other DNA
cctcaatcaaacggggcaaccaa

SEQ ID NO: 14515 - DNA, 20 bp, synthetic construct
  misc_feature 1..20: note = Synthetic Construct
  source 1..20: mol_type = other DNA
tctcccgctgacccggtgta

SEQ ID NO: 14516 - DNA, 21 bp, synthetic construct
  misc_feature 1..21: note = Synthetic Construct
  source 1..21: mol_type = other DNA
tgaccagttcccaccctctgt

SEQ ID NO: 14517 - DNA, 20 bp, synthetic construct
  misc_feature 1..20: note = Synthetic Construct
  source 1..20: mol_type = other DNA
ggccacgtgaagatgacaga

SEQ ID NO: 14518 - DNA, 23 bp, synthetic construct
  misc_feature 1..23: note = Synthetic Construct
  source 1..23: mol_type = other DNA
ggtttgtgggatcaagaccttct

SEQ ID NO: 14519 - DNA, 21 bp, synthetic construct
  misc_feature 1..21: note = Synthetic Construct
  source 1..21: mol_type = other DNA
tgtctgtccccaagccagact

SEQ ID NO: 14520 - DNA, 25 bp, synthetic construct
  misc_feature 1..25: note = Synthetic Construct
  source 1..25: mol_type = other DNA
gcccatctagcctgtgttaggaaga

SEQ ID NO: 14521 - DNA, 25 bp, synthetic construct
  misc_feature 1..25: note = Synthetic Construct
  source 1..25: mol_type = other DNA
gcctggatttggatcgtaactctac

SEQ ID NO: 14522 - DNA, 21 bp, synthetic construct
  misc_feature 1..21: note = Synthetic Construct
  source 1..21: mol_type = other DNA
aaggctgttggacagacacaa

SEQ ID NO: 14523 - DNA, 21 bp, synthetic construct
  misc_feature 1..21: note = Synthetic Construct
  source 1..21: mol_type = other DNA
tggcgccatgacagagggata

SEQ ID NO: 14524 - DNA, 20 bp, synthetic construct
  misc_feature 1..20: note = Synthetic Construct
  source 1..20: mol_type = other DNA
gcctgccacccacagaactt

SEQ ID NO: 14525 - DNA, 21 bp, synthetic construct
  misc_feature 1..21: note = Synthetic Construct
  source 1..21: mol_type = other DNA
ggagcctgtactctgcactga

SEQ ID NO: 14526 - DNA, 21 bp, synthetic construct
  misc_feature 1..21: note = Synthetic Construct
  source 1..21: mol_type = other DNA
gtggcgggaacagcaatatga

SEQ ID NO: 14527 - DNA, 23 bp, synthetic construct
  misc_feature 1..23: note = Synthetic Construct
  source 1..23: mol_type = other DNA
ggccctagactggagccaaaaag

SEQ ID NO: 14528 - DNA, 22 bp, synthetic construct
  misc_feature 1..22: note = Synthetic Construct
  source 1..22: mol_type = other DNA
aggactccatctgccttgtttc

SEQ ID NO: 14529 - DNA, 22 bp, synthetic construct
  misc_feature 1..22: note = Synthetic Construct
  source 1..22: mol_type = other DNA
caccagcctcaccctttggatt

SEQ ID NO: 14530 - DNA, 21 bp, synthetic construct
  misc_feature 1..21: note = Synthetic Construct
  source 1..21: mol_type = other DNA
ctcctgctgtcctttctgcaa

SEQ ID NO: 14531 - DNA, 20 bp, synthetic construct
  misc_feature 1..20: note = Synthetic Construct
  source 1..20: mol_type = other DNA
gttgccagacctcccgttac

SEQ ID NO: 14532 - DNA, 20 bp, synthetic construct
  misc_feature 1..20: note = Synthetic Construct
  source 1..20: mol_type = other DNA
ggaagtggtgggagggagaa

SEQ ID NO: 14533 - DNA, 23 bp, synthetic construct
  misc_feature 1..23: note = Synthetic Construct
  source 1..23: mol_type = other DNA
accaggaagttggatgggactta

SEQ ID NO: 14534 - DNA, 26 bp, synthetic construct
  misc_feature 1..26: note = Synthetic Construct
  source 1..26: mol_type = other DNA
cgcaggcaattatctcctatacttga

SEQ ID NO: 14535 - DNA, 24 bp, synthetic construct
  misc_feature 1..24: note = Synthetic Construct
  source 1..24: mol_type = other DNA
tcacctcctattcactcctcaaca

SEQ ID NO: 14536 - DNA, 22 bp, synthetic construct
  misc_feature 1..22: note = Synthetic Construct
  source 1..22: mol_type = other DNA
cagagcctccatttccttgcat

SEQ ID NO: 14537 - DNA, 22 bp, synthetic construct
  misc_feature 1..22: note = Synthetic Construct
  source 1..22: mol_type = other DNA
tcacccatgtcacatcctgtct

SEQ ID NO: 14538 - DNA, 24 bp, synthetic construct
  misc_feature 1..24: note = Synthetic Construct
  source 1..24: mol_type = other DNA
catcaacaaggtggtgacctgaga

SEQ ID NO: 14539 - DNA, 20 bp, synthetic construct
  misc_feature 1..20: note = Synthetic Construct
  source 1..20: mol_type = other DNA
cgtgcggaaggcagttcaat

SEQ ID NO: 14540 - DNA, 19 bp, synthetic construct
  misc_feature 1..19: note = Synthetic Construct
  source 1..19: mol_type = other DNA
tgtctccggcacaggtttg

SEQ ID NO: 14541 - DNA, 21 bp, synthetic construct
  misc_feature 1..21: note = Synthetic Construct
  source 1..21: mol_type = other DNA
aggtcccagccttggttcatc

SEQ ID NO: 14542 - DNA, 24 bp, synthetic construct
  misc_feature 1..24: note = Synthetic Construct
  source 1..24: mol_type = other DNA
tgagtggtgtttcagatcatcaca

SEQ ID NO: 14543 - DNA, 23 bp, synthetic construct
  misc_feature 1..23: note = Synthetic Construct
  source 1..23: mol_type = other DNA
caccttccccactccaagttttg

SEQ ID NO: 14544 - DNA, 21 bp, synthetic construct
  misc_feature 1..21: note = Synthetic Construct
  source 1..21: mol_type = other DNA
ggagccctgaatgaaccatga

SEQ ID NO: 14545 - DNA, 22 bp, synthetic construct
  misc_feature 1..22: note = Synthetic Construct
  source 1..22: mol_type = other DNA
gaagccctgcagagtcaagaga

SEQ ID NO: 14546 - DNA, 22 bp, synthetic construct
  misc_feature 1..22: note = Synthetic Construct
  source 1..22: mol_type = other DNA
ggaagggcctcaaccatccaaa

SEQ ID NO: 14547 - DNA, 21 bp, synthetic construct
  misc_feature 1..21: note = Synthetic Construct
  source 1..21: mol_type = other DNA
tggccaccatctctgctgtca

SEQ ID NO: 14548 - DNA, 21 bp, synthetic construct
  misc_feature 1..21: note = Synthetic Construct
  source 1..21: mol_type = other DNA
tcctggcaccatgacgtatct

SEQ ID NO: 14549 - DNA, 21 bp, synthetic construct
  misc_feature 1..21: note = Synthetic Construct
  source 1..21: mol_type = other DNA
acagagccagcaagccccata

SEQ ID NO: 14550 - DNA, 20 bp, synthetic construct
  misc_feature 1..20: note = Synthetic Construct
  source 1..20: mol_type = other DNA
ccagtgccacctgggtatgt

SEQ ID NO: 14551 - DNA, 21 bp, synthetic construct
  misc_feature 1..21: note = Synthetic Construct
  source 1..21: mol_type = other DNA
gcttaccaaggaacgcgtaga

SEQ ID NO: 14552 - DNA, 21 bp, synthetic construct
  misc_feature 1..21: note = Synthetic Construct
  source 1..21: mol_type = other DNA
cgtgtctctggctttgtgact

SEQ ID NO: 14553 - DNA, 22 bp, synthetic construct
  misc_feature 1..22: note = Synthetic Construct
  source 1..22: mol_type = other DNA
cagccagtcacttcgtttgtca

SEQ ID NO: 14554 - DNA, 23 bp, synthetic construct
  misc_feature 1..23: note = Synthetic Construct
  source 1..23: mol_type = other DNA
tcctttgcacttaacgctctagt

SEQ ID NO: 14555 - DNA, 19 bp, synthetic construct
  misc_feature 1..19: note = Synthetic Construct
  source 1..19: mol_type = other DNA
ccaccaaggggccttgaca

SEQ ID NO: 14556 - DNA, 22 bp, synthetic construct
  misc_feature 1..22: note = Synthetic Construct
  source 1..22: mol_type = other DNA
gttgggcgggaaaagcaaattc

SEQ ID NO: 14557 - DNA, 24 bp, synthetic construct
  misc_feature 1..24: note = Synthetic Construct
  source 1..24: mol_type = other DNA
caaaaagacccctgaccactcaag

SEQ ID NO: 14558 - DNA, 19 bp, synthetic construct
  misc_feature 1..19: note = Synthetic Construct
  source 1..19: mol_type = other DNA
gtggtgcttgtgcgtgtgt

SEQ ID NO: 14559 - DNA, 24 bp, synthetic construct
  misc_feature 1..24: note = Synthetic Construct
  source 1..24: mol_type = other DNA
cagaggccagatgtagggaactgt

SEQ ID NO: 14560 - DNA, 20 bp, synthetic construct
  misc_feature 1..20: note = Synthetic Construct
  source 1..20: mol_type = other DNA
tgcccagctggttggagact

SEQ ID NO: 14561 - DNA, 21 bp, synthetic construct
  misc_feature 1..21: note = Synthetic Construct
  source 1..21: mol_type = other DNA
gtgccctgtgcagacatcact

SEQ ID NO: 14562 - DNA, 23 bp, synthetic construct
  misc_feature 1..23: note = Synthetic Construct
  source 1..23: mol_type = other DNA
ccagagagtgggtccacaaggta

SEQ ID NO: 14563 - DNA, 22 bp, synthetic construct
  misc_feature 1..22: note = Synthetic Construct
  source 1..22: mol_type = other DNA
aaaccccaagaggaccttgaac

SEQ ID NO: 14564 - DNA, 22 bp, synthetic construct
  misc_feature 1..22: note = Synthetic Construct
  source 1..22: mol_type = other DNA
ccaaagaaccgagcccttcact

SEQ ID NO: 14565 - DNA, 22 bp, synthetic construct
  misc_feature 1..22: note = Synthetic Construct
  source 1..22: mol_type = other DNA
tgcgccaggaaagaagtatgtt

SEQ ID NO: 14566 - DNA, 24 bp, synthetic construct
  misc_feature 1..24: note = Synthetic Construct
  source 1..24: mol_type = other DNA
cctcagtggggagaatatgccttt

SEQ ID NO: 14567 - DNA, 21 bp, synthetic construct
  misc_feature 1..21: note = Synthetic Construct
  source 1..21: mol_type = other DNA
agcggaacgctcacggagata

SEQ ID NO: 14568 - DNA, 22 bp, synthetic construct
  misc_feature 1..22: note = Synthetic Construct
  source 1..22: mol_type = other DNA
gccagctgttctcggtttggaa

SEQ ID NO: 14569 - DNA, 18 bp, synthetic construct
  misc_feature 1..18: note = Synthetic Construct
  source 1..18: mol_type = other DNA
tgcggcgttgggtggttt

SEQ ID NO: 14570 - DNA, 25 bp, synthetic construct
  misc_feature 1..25: note = Synthetic Construct
  source 1..25: mol_type = other DNA
cagtcactgagaatcaggcagtgta

SEQ ID NO: 14571 - DNA, 20 bp, synthetic construct
  misc_feature 1..20: note = Synthetic Construct
  source 1..20: mol_type = other DNA
agtgtgcagtgcccgagagt

SEQ ID NO: 14572 - DNA, 21 bp, synthetic construct
  misc_feature 1..21: note = Synthetic Construct
  source 1..21: mol_type = other DNA
ggagacaacggccctcaaaca

SEQ ID NO: 14573 - DNA, 20 bp, synthetic construct
  misc_feature 1..20: note = Synthetic Construct
  source 1..20: mol_type = other DNA
ccaggcaggctggagtttca

SEQ ID NO: 14574 - DNA, 20 bp, synthetic construct
  misc_feature 1..20: note = Synthetic Construct
  source 1..20: mol_type = other DNA
tgaagcccacagccatccaa

SEQ ID NO: 14575 - DNA, 21 bp, synthetic construct
  misc_feature 1..21: note = Synthetic Construct
  source 1..21: mol_type = other DNA
caggtgatggcgctgagattc

SEQ ID NO: 14576 - DNA, 19 bp, synthetic construct
  misc_feature 1..19: note = Synthetic Construct
  source 1..19: mol_type = other DNA
ctggcctctggggacagaa

SEQ ID NO: 14577 - DNA, 22 bp, synthetic construct
  misc_feature 1..22: note = Synthetic Construct
  source 1..22: mol_type = other DNA
tcttgcctcatctgccctctgt

SEQ ID NO: 14578 - DNA, 23 bp, synthetic construct
  misc_feature 1..23: note = Synthetic Construct
  source 1..23: mol_type = other DNA
cccgcaagtactcatggctcttc

SEQ ID NO: 14579 - DNA, 22 bp, synthetic construct
  misc_feature 1..22: note = Synthetic Construct
  source 1..22: mol_type = other DNA
cacacacactgaggacgctttc

SEQ ID NO: 14580 - DNA, 20 bp, synthetic construct
  misc_feature 1..20: note = Synthetic Construct
  source 1..20: mol_type = other DNA
tgtcttggccgatgacacaa

SEQ ID NO: 14581 - DNA, 22 bp, synthetic construct
  misc_feature 1..22: note = Synthetic Construct
  source 1..22: mol_type = other DNA
ccctgaccgctgatacaagcaa

SEQ ID NO: 14582 - DNA, 23 bp, synthetic construct
  misc_feature 1..23: note = Synthetic Construct
  source 1..23: mol_type = other DNA
tcgggatggacaattccaagaac

SEQ ID NO: 14583 - DNA, 22 bp, synthetic construct
  misc_feature 1..22: note = Synthetic Construct
  source 1..22: mol_type = other DNA
ccctcacacaagccacctgttt

SEQ ID NO: 14584 - DNA, 21 bp, synthetic construct
  misc_feature 1..21: note = Synthetic Construct
  source 1..21: mol_type = other DNA
aacccaggactgtgagagtga

SEQ ID NO: 14585 - DNA, 22 bp, synthetic construct
  misc_feature 1..22: note = Synthetic Construct
  source 1..22: mol_type = other DNA
tccacccctctgcgtaactttg

SEQ ID NO: 14586 - DNA, 20 bp, synthetic construct
  misc_feature 1..20: note = Synthetic Construct
  source 1..20: mol_type = other DNA
acgcaccagctcccctttca

SEQ ID NO: 14587 - DNA, 20 bp, synthetic construct
  misc_feature 1..20: note = Synthetic Construct
  source 1..20: mol_type = other DNA
ggggcatagcccaggaatga

SEQ ID NO: 14588 - DNA, 21 bp, synthetic construct
  misc_feature 1..21: note = Synthetic Construct
  source 1..21: mol_type = other DNA
ggagacgggatggtggagaat

SEQ ID NO: 14589 - DNA, 19 bp, synthetic construct
  misc_feature 1..19: note = Synthetic Construct
  source 1..19: mol_type = other DNA
tcgctgccaagcagtggat

SEQ ID NO: 14590 - DNA, 21 bp, synthetic construct
  misc_feature 1..21: note = Synthetic Construct
  source 1..21: mol_type = other DNA
tggctcccagaagtgctgact

SEQ ID NO: 14591 - DNA, 23 bp, synthetic construct
  misc_feature 1..23: note = Synthetic Construct
  source 1..23: mol_type = other DNA
ctgtcacgctttgtcacgctttg

SEQ ID NO: 14592 - DNA, 19 bp, synthetic construct
  misc_feature 1..19: note = Synthetic Construct
  source 1..19: mol_type = other DNA
tgcccgcccattccatcat

SEQ ID NO: 14593 - DNA, 22 bp, synthetic construct
  misc_feature 1..22: note = Synthetic Construct
  source 1..22: mol_type = other DNA
cgaaagccacaggacgtgctta

SEQ ID NO: 14594 - DNA, 25 bp, synthetic construct
  misc_feature 1..25: note = Synthetic Construct
  source 1..25: mol_type = other DNA
gcaagatcagcacttctaggacgtt

SEQ ID NO: 14595 - DNA, 19 bp, synthetic construct
  misc_feature 1..19: note = Synthetic Construct
  source 1..19: mol_type = other DNA
ccccgaggggaatcagcat

SEQ ID NO: 14596 - DNA, 22 bp, synthetic construct
  misc_feature 1..22: note = Synthetic Construct
  source 1..22: mol_type = other DNA
cgtccagcttcatgctcagaga

SEQ ID NO: 14597 - DNA, 20 bp, synthetic construct
  misc_feature 1..20: note = Synthetic Construct
  source 1..20: mol_type = other DNA
atcctccctccagcccatga

SEQ ID NO: 14598 - DNA, 20 bp, synthetic construct
  misc_feature 1..20: note = Synthetic Construct
  source 1..20: mol_type = other DNA
tacctccaccgcagacagaa

SEQ ID NO: 14599 - DNA, 22 bp, synthetic construct
  misc_feature 1..22: note = Synthetic Construct
  source 1..22: mol_type = other DNA
ggtttggcatggcctggaaagt

SEQ ID NO: 14600 - DNA, 23 bp, synthetic construct
  misc_feature 1..23: note = Synthetic Construct
  source 1..23: mol_type = other DNA
gcccatttccaccctaactgtgt

SEQ ID NO: 14601 - DNA, 20 bp, synthetic construct
  misc_feature 1..20: note = Synthetic Construct
  source 1..20: mol_type = other DNA
ttgtctggggaggggaagtt

SEQ ID NO: 14602 - DNA, 21 bp, synthetic construct
  misc_feature 1..21: note = Synthetic Construct
  source 1..21: mol_type = other DNA
gcctggttcccctgacattct

SEQ ID NO: 14603 - DNA, 21 bp, synthetic construct
  misc_feature 1..21: note = Synthetic Construct
  source 1..21: mol_type = other DNA
ccactagcgtggggtactgaa

SEQ ID NO: 14604 - DNA, 22 bp, synthetic construct
  misc_feature 1..22: note = Synthetic Construct
  source 1..22: mol_type = other DNA
ccatgaccagagtccacctttc

SEQ ID NO: 14605 - DNA, 24 bp, synthetic construct
  misc_feature 1..24: note = Synthetic Construct
  source 1..24: mol_type = other DNA
cactgacatccgtgttcccaaact

SEQ ID NO: 14606 - DNA, 20 bp, synthetic construct
  misc_feature 1..20: note = Synthetic Construct
  source 1..20: mol_type = other DNA
tgccgtgcatgagtgcagat

SEQ ID NO: 14607 - DNA, 20 bp, synthetic construct
  misc_feature 1..20: note = Synthetic Construct
  source 1..20: mol_type = other DNA
aaagggtgggacgtctcgaa

SEQ ID NO: 14608 - DNA, 21 bp, synthetic construct
  misc_feature 1..21: note = Synthetic Construct
  source 1..21: mol_type = other DNA
aaagggccgtgtgggacacat

SEQ ID NO: 14609 - DNA, 22 bp, synthetic construct
  misc_feature 1..22: note = Synthetic Construct
  source 1..22: mol_type = other DNA
catcagtgctccgtgcttgttc

SEQ ID NO: 14610 - DNA, 23 bp, synthetic construct
  misc_feature 1..23: note = Synthetic Construct
  source 1..23: mol_type = other DNA
ccagccattctatcctcctccaa

SEQ ID NO: 14611 - DNA, 20 bp, synthetic construct
  misc_feature 1..20: note = Synthetic Construct
  source 1..20: mol_type = other DNA
tttggacggtggaggtgagt

SEQ ID NO: 14612 - DNA, 22 bp, synthetic construct
  misc_feature 1..22: note = Synthetic Construct
  source 1..22: mol_type = other DNA
cacactcagtttcgggcacagt

SEQ ID NO: 14613 - DNA, 22 bp, synthetic construct
  misc_feature 1..22: note = Synthetic Construct
  source 1..22: mol_type = other DNA
gcttcccagcacctcctctaag

SEQ ID NO: 14614 - DNA, 24 bp, synthetic construct
  misc_feature 1..24: note = Synthetic Construct
  source 1..24: mol_type = other DNA
accatggtggaaactccattcatt

SEQ ID NO: 14615 - DNA, 22 bp, synthetic construct
  misc_feature 1..22: note = Synthetic Construct
  source 1..22: mol_type = other DNA
tggatctgcccacacccttaga

SEQ ID NO: 14616 - DNA, 20 bp, synthetic construct
  misc_feature 1..20: note = Synthetic Construct
  source 1..20: mol_type = other DNA
gccgaaggacaggcacactt

SEQ ID NO: 14617 - DNA, 24 bp, synthetic construct
  misc_feature 1..24: note = Synthetic Construct
  source 1..24: mol_type = other DNA
gagacaaccaaacccttcccaagt

SEQ ID NO: 14618 - DNA, 21 bp, synthetic construct
  misc_feature 1..21: note = Synthetic Construct
  source 1..21: mol_type = other DNA
tacctccggcctgaccaatca

SEQ ID NO: 14619 - DNA, 23 bp, synthetic construct
  misc_feature 1..23: note = Synthetic Construct
  source 1..23: mol_type = other DNA
gcagctcaagggtgttcggaaat

SEQ ID NO: 14620 - DNA, 20 bp, synthetic construct
  misc_feature 1..20: note = Synthetic Construct
  source 1..20: mol_type = other DNA
tgccctgcccttgtcagtct

SEQ ID NO: 14621 - DNA, 22 bp, synthetic construct
  misc_feature 1..22: note = Synthetic Construct
  source 1..22: mol_type = other DNA
tcccatgtcccgatccgacttc

SEQ ID NO: 14622 - DNA, 22 bp, synthetic construct
  misc_feature 1..22: note = Synthetic Construct
  source 1..22: mol_type = other DNA
ctgttaccatccactggaccaa

SEQ ID NO: 14623 - DNA, 23 bp, synthetic construct
  misc_feature 1..23: note = Synthetic Construct
  source 1..23: mol_type = other DNA
gcctgtgaggaggacttttccat

SEQ ID NO: 14624 - DNA, 24 bp, synthetic construct
  misc_feature 1..24: note = Synthetic Construct
  source 1..24: mol_type = other DNA
gactctgtgtgagaacagcactat

SEQ ID NO: 14625 - DNA, 26 bp, synthetic construct
  misc_feature 1..26: note = Synthetic Construct
  source 1..26: mol_type = other DNA
gtcatggtgagtcaaagactacgtta

SEQ ID NO: 14626 - DNA, 22 bp, synthetic construct
  misc_feature 1..22: note = Synthetic Construct
  source 1..22: mol_type = other DNA
cgctgtgagcctccactgattt

SEQ ID NO: 14627 - DNA, 27 bp, synthetic construct
  misc_feature 1..27: note = Synthetic Construct
  source 1..27: mol_type = other DNA
cacaccaggttgtctctatttacactt

SEQ ID NO: 14628 - DNA, 22 bp, synthetic construct
  misc_feature 1..22: note = Synthetic Construct
  source 1..22: mol_type = other DNA
agcctggtggtagagggagaag

SEQ ID NO: 14629 - DNA, 23 bp, synthetic construct
  misc_feature 1..23: note = Synthetic Construct
  source 1..23: mol_type = other DNA
ggcagtatccaaggcaggtgtag

SEQ ID NO: 14630 - DNA, 21 bp, synthetic construct
  misc_feature 1..21: note = Synthetic Construct
  source 1..21: mol_type = other DNA
cagccactaccctgcaaccat

SEQ ID NO: 14631 - DNA, 23 bp, synthetic construct
  misc_feature 1..23: note = Synthetic Construct
  source 1..23: mol_type = other DNA
cctcatgtactcctggtctcaca

SEQ ID NO: 14632 - DNA, 25 bp, synthetic construct
  misc_feature 1..25: note = Synthetic Construct
  source 1..25: mol_type = other DNA
cagccccaacctcattagtcagtta

SEQ ID NO: 14633 - DNA, 24 bp, synthetic construct
  misc_feature 1..24: note = Synthetic Construct
  source 1..24: mol_type = other DNA
cacaggcaggttagagacgctttc

SEQ ID NO: 14634 - DNA, 20 bp, synthetic construct
  misc_feature 1..20: note = Synthetic Construct
  source 1..20: mol_type = other DNA
tcaggcctctctcagtcgaa

SEQ ID NO: 14635 - DNA, 24 bp, synthetic construct
  misc_feature 1..24: note = Synthetic Construct
  source 1..24: mol_type = other DNA
gatcctcaaagcctgtaggagaag

SEQ ID NO: 14636 - DNA, 26 bp, synthetic construct
  misc_feature 1..26: note = Synthetic Construct
  source 1..26: mol_type = other DNA
gtatcctggtttcagacactgaactt

SEQ ID NO: 14637 - DNA, 20 bp, synthetic construct
  misc_feature 1..20: note = Synthetic Construct
  source 1..20: mol_type = other DNA
gccctcagagagccacaaga

SEQ ID NO: 14638 - DNA, 21 bp, synthetic construct
  misc_feature 1..21: note = Synthetic Construct
  source 1..21: mol_type = other DNA
tcgggacctatccgctgcatt

SEQ ID NO: 14639 - DNA, 24 bp, synthetic construct
  misc_feature 1..24: note = Synthetic Construct
  source 1..24: mol_type = other DNA
gcctggacttttgattacccctta

SEQ ID NO: 14640 - DNA, 23 bp, synthetic construct
  misc_feature 1..23: note = Synthetic Construct
  source 1..23: mol_type = other DNA
gttccctctctcggctgacaatg

SEQ ID NO: 14641 - DNA, 24 bp, synthetic construct
  misc_feature 1..24: note = Synthetic Construct
  source 1..24: mol_type = other DNA
gagcttcacattccatgtggcttt

SEQ ID NO: 14642 - DNA, 22 bp, synthetic construct
  misc_feature 1..22: note = Synthetic Construct
  source 1..22: mol_type = other DNA
ttgagtctccccatctcccttt

SEQ ID NO: 14643 - DNA, 22 bp, synthetic construct
  misc_feature 1..22: note = Synthetic Construct
  source 1..22: mol_type = other DNA
gagcaaggctgatgtcttcaca

SEQ ID NO: 14644 - DNA, 23 bp, synthetic construct
  misc_feature 1..23: note = Synthetic Construct
  source 1..23: mol_type = other DNA
cgcaatgctgacacacatccttt

SEQ ID NO: 14645 - DNA, 24 bp, synthetic construct
  misc_feature 1..24: note = Synthetic Construct
  source 1..24: mol_type = other DNA
ggaaattctgcaaggagggagaca

SEQ ID NO: 14646 - DNA, 26 bp, synthetic construct
  misc_feature 1..26: note = Synthetic Construct
  source 1..26: mol_type = other DNA
ctcgcaagataacacacagagtaaca

SEQ ID NO: 14647 - DNA, 23 bp, synthetic construct
  misc_feature 1..23: note = Synthetic Construct
  source 1..23: mol_type = other DNA
ctggaaccaaagggcaaagaaag

SEQ ID NO: 14648 - DNA, 21 bp, synthetic construct
  misc_feature 1..21: note = Synthetic Construct
  source 1..21: mol_type = other DNA
gctgtccacgaagagccacat

SEQ ID NO: 14649 - DNA, 21 bp, synthetic construct
  misc_feature 1..21: note = Synthetic Construct
  source 1..21: mol_type = other DNA
caccgctagccacagaggttt

SEQ ID NO: 14650 - DNA, 20 bp, synthetic construct
  misc_feature 1..20: note = Synthetic Construct
  source 1..20: mol_type = other DNA
cccaccctgcacatgggttt

SEQ ID NO: 14651 - DNA, 21 bp, synthetic construct
  misc_feature 1..21: note = Synthetic Construct
  source 1..21: mol_type = other DNA
aaggagcccagtgaccctgat

SEQ ID NO: 14652 - DNA, 23 bp, synthetic construct
  misc_feature 1..23: note = Synthetic Construct
  source 1..23: mol_type = other DNA
actggactgtgatggttgctaag

SEQ ID NO: 14653 - DNA, 24 bp, synthetic construct
  misc_feature 1..24: note = Synthetic Construct
  source 1..24: mol_type = other DNA
tgcttgggtataaagggagagaga

SEQ ID NO: 14654 - DNA, 26 bp, synthetic construct
  misc_feature 1..26: note = Synthetic Construct
  source 1..26: mol_type = other DNA
gataatgtcaaagccggtagtgattg

SEQ ID NO: 14655 - DNA, 21 bp, synthetic construct
  misc_feature 1..21: note = Synthetic Construct
  source 1..21: mol_type = other DNA
tgagggagccagggactaaga

SEQ ID NO: 14656 - DNA, 21 bp, synthetic construct
  misc_feature 1..21: note = Synthetic Construct
  source 1..21: mol_type = other DNA
tcacagcaggccttggaccat

SEQ ID NO: 14657 - DNA, 21 bp, synthetic construct
  misc_feature 1..21: note = Synthetic Construct
  source 1..21: mol_type = other DNA
gccacctacttgcaggttgaa

SEQ ID NO: 14658 - DNA, 22 bp, synthetic construct
  misc_feature 1..22: note = Synthetic Construct
  source 1..22: mol_type = other DNA
tggtcacatacacgactgtgtt

SEQ ID NO: 14659 - DNA, 22 bp, synthetic construct
  misc_feature 1..22: note = Synthetic Construct
  source 1..22: mol_type = other DNA
acccaccaagccatgtcctctt

SEQ ID NO: 14660 - DNA, 21 bp, synthetic construct
  misc_feature 1..21: note = Synthetic Construct
  source 1..21: mol_type = other DNA
ggattgaggccaggcagacta

SEQ ID NO: 14661 - DNA, 21 bp, synthetic construct
  misc_feature 1..21: note = Synthetic Construct
  source 1..21: mol_type = other DNA
cccagggctacctcggatttc

SEQ ID NO: 14662 - DNA, 24 bp, synthetic construct
  misc_feature 1..24: note = Synthetic Construct
  source 1..24: mol_type = other DNA
gcgtgttagaaggtaacgcatact

SEQ ID NO: 14663 - DNA, 23 bp, synthetic construct
  misc_feature 1..23: note = Synthetic Construct
  source 1..23: mol_type = other DNA
gagccgggaaagttttgtccaat

SEQ ID NO: 14664 - DNA, 23 bp, synthetic construct
  misc_feature 1..23: note = Synthetic Construct
  source 1..23: mol_type = other DNA
gtgatgttctggctccctctttg

SEQ ID NO: 14665 - DNA, 22 bp, synthetic construct
  misc_feature 1..22: note = Synthetic Construct
  source 1..22: mol_type = other DNA
ggcgtagaatgcagcagacact

SEQ ID NO: 14666 - DNA, 22 bp, synthetic construct
  misc_feature 1..22: note = Synthetic Construct
  source 1..22: mol_type = other DNA
ctcagtgcccttccacatcagt

SEQ ID NO: 14667 - DNA, 24 bp, synthetic construct
  misc_feature 1..24: note = Synthetic Construct
  source 1..24: mol_type = other DNA
gtggatggcttcctaattccaagt

SEQ ID NO: 14668 - DNA, 21 bp, synthetic construct
  misc_feature 1..21: note = Synthetic Construct
  source 1..21: mol_type = other DNA
gagttcagagggcatgggttt

SEQ ID NO: 14669 - DNA, 20 bp, synthetic construct
  misc_feature 1..20: note = Synthetic Construct
  source 1..20: mol_type = other DNA
tctggctccagcactcacta

SEQ ID NO: 14670 - DNA, 26 bp, synthetic construct
  misc_feature 1..26: note = Synthetic Construct
  source 1..26: mol_type = other DNA
ccagattgtaccctcaattcctctca

SEQ ID NO: 14671 - DNA, 24 bp, synthetic construct
  misc_feature 1..24: note = Synthetic Construct
  source 1..24: mol_type = other DNA
tcacctctctctcctccaccattc

SEQ ID NO: 14672 - DNA, 19 bp, synthetic construct
  misc_feature 1..19: note = Synthetic Construct
  source 1..19: mol_type = other DNA
caggccacgtcgtcacact

SEQ ID NO: 14673 - DNA, 22 bp, synthetic construct
  misc_feature 1..22: note = Synthetic Construct
  source 1..22: mol_type = other DNA
ctcacacatcgccgggaaaaag

SEQ ID NO: 14674 - DNA, 20 bp, synthetic construct
  misc_feature 1..20: note = Synthetic Construct
  source 1..20: mol_type = other DNA
gccagccataacacctcaca

SEQ ID NO: 14675 - DNA, 20 bp, synthetic construct
  misc_feature 1..20: note = Synthetic Construct
  source 1..20: mol_type = other DNA
aaaggccctggggtgaggaa

SEQ ID NO: 14676 - DNA, 19 bp, synthetic construct
  misc_feature 1..19: note = Synthetic Construct
  source 1..19: mol_type = other DNA
tgtccccatgggaccttga

SEQ ID NO: 14677 - DNA, 25 bp, synthetic construct
  misc_feature 1..25: note = Synthetic Construct
  source 1..25: mol_type = other DNA
gtcctacccaatgactgactgatac

SEQ ID NO: 14678 - DNA, 22 bp, synthetic construct
  misc_feature 1..22: note = Synthetic Construct
  source 1..22: mol_type = other DNA
gaggctcaagcgtagagagaga

SEQ ID NO: 14679 - DNA, 20 bp, synthetic construct
  misc_feature 1..20: note = Synthetic Construct
  source 1..20: mol_type = other DNA
agagaggagcactggacaca

SEQ ID NO: 14680 - DNA, 19 bp, synthetic construct
  misc_feature 1..19: note = Synthetic Construct
  source 1..19: mol_type = other DNA
gctgctggcagtgctctct

SEQ ID NO: 14681 - DNA, 20 bp, synthetic construct
  misc_feature 1..20: note = Synthetic Construct
  source 1..20: mol_type = other DNA
agccgtcactggttgtgtca

SEQ ID NO: 14682 - DNA, 22 bp, synthetic construct
  misc_feature 1..22: note = Synthetic Construct
  source 1..22: mol_type = other DNA
cccgccaccacatcttgctaaa

SEQ ID NO: 14683 - DNA, 25 bp, synthetic construct
  misc_feature 1..25: note = Synthetic Construct
  source 1..25: mol_type = other DNA
gacagagtgagtacgacatggaaac

SEQ ID NO: 14684 - DNA, 22 bp, synthetic construct
  misc_feature 1..22: note = Synthetic Construct
  source 1..22: mol_type = other DNA
gtgcagcaaggctgtgatgagt

SEQ ID NO: 14685 - DNA, 21 bp, synthetic construct
  misc_feature 1..21: note = Synthetic Construct
  source 1..21: mol_type = other DNA
ggccagatgctgtgtaacctt

SEQ ID NO: 14686 - DNA, 24 bp, synthetic construct
  misc_feature 1..24: note = Synthetic Construct
  source 1..24: mol_type = other DNA
gtgtctctgtaaatcagcccttca

SEQ ID NO: 14687 - DNA, 22 bp, synthetic construct
  misc_feature 1..22: note = Synthetic Construct
  source 1..22: mol_type = other DNA
ctgctccccagcttaccttttg

SEQ ID NO: 14688 - DNA, 22 bp, synthetic construct
  misc_feature 1..22: note = Synthetic Construct
  source 1..22: mol_type = other DNA
tggcccctcctacaaccaaaac

SEQ ID NO: 14689 - DNA, 20 bp, synthetic construct
  misc_feature 1..20: note = Synthetic Construct
  source 1..20: mol_type = other DNA
gctttgggctggtgacttct

SEQ ID NO: 14690 - DNA, 24 bp, synthetic construct
  misc_feature 1..24: note = Synthetic Construct
  source 1..24: mol_type = other DNA
gaacttgaaggcacctctagctta

SEQ ID NO: 14691 - DNA, 22 bp, synthetic construct
  misc_feature 1..22: note = Synthetic Construct
  source 1..22: mol_type = other DNA
tgggaaagcccttcaccagtca

SEQ ID NO: 14692 - DNA, 21 bp, synthetic construct
  misc_feature 1..21: note = Synthetic Construct
  source 1..21: mol_type = other DNA
gccactttccagcaacgtatc

SEQ ID NO: 14693 - DNA, 26 bp, synthetic construct
  misc_feature 1..26: note = Synthetic Construct
  source 1..26: mol_type = other DNA
cacttgcttttgcatccaacgattac

SEQ ID NO: 14694 - DNA, 26 bp, synthetic construct
  misc_feature 1..26: note = Synthetic Construct
  source 1..26: mol_type = other DNA
ggattccaagactcagcttcaggaaa

SEQ ID NO: 14695 - DNA, 21 bp, synthetic construct
  misc_feature 1..21: note = Synthetic Construct
  source 1..21: mol_type = other DNA
gcaggcaccaacacctcacat

SEQ ID NO: 14696 - DNA, 25 bp, synthetic construct
  misc_feature 1..25: note = Synthetic Construct
  source 1..25: mol_type = other DNA
gctgacatttagtgagcccctgttc

SEQ ID NO: 14697 - DNA, 25 bp, synthetic construct
  misc_feature 1..25: note = Synthetic Construct
  source 1..25: mol_type = other DNA
cacaagacagatagttgggctggat

SEQ ID NO: 14698 - DNA, 24 bp, synthetic construct
  misc_feature 1..24: note = Synthetic Construct
  source 1..24: mol_type = other DNA
ctccccaaatgaagctgactgtag

SEQ ID NO: 14699 - DNA, 21 bp, synthetic construct
  misc_feature 1..21: note = Synthetic Construct
  source 1..21: mol_type = other DNA
acatctccaaggcgtttctgt

SEQ ID NO: 14700 - DNA, 21 bp, synthetic construct
  misc_feature 1..21: note = Synthetic Construct
  source 1..21: mol_type = other DNA
ggaaggggcaatggcacttag

SEQ ID NO: 14701 - DNA, 20 bp, synthetic construct
  misc_feature 1..20: note = Synthetic Construct
  source 1..20: mol_type = other DNA
aggggttacggtgtggttca

SEQ ID NO: 14702 - DNA, 21 bp, synthetic construct
  misc_feature 1..21: note = Synthetic Construct
  source 1..21: mol_type = other DNA
acctcctgctcacctgtcagt

SEQ ID NO: 14703 - DNA, 25 bp, synthetic construct
  misc_feature 1..25: note = Synthetic Construct
  source 1..25: mol_type = other DNA
gtctagaagggcaaagtacttgaga

SEQ ID NO: 14704 - DNA, 19 bp, synthetic construct
  misc_feature 1..19: note = Synthetic Construct
  source 1..19: mol_type = other DNA
agacctgctgggctgtagt

SEQ ID NO: 14705 - DNA, 22 bp, synthetic construct
  misc_feature 1..22: note = Synthetic Construct
  source 1..22: mol_type = other DNA
gcttgtccaggtggagctatgt

SEQ ID NO: 14706 - DNA, 19 bp, synthetic construct
  misc_feature 1..19: note = Synthetic Construct
  source 1..19: mol_type = other DNA
gcggggaggatgcaagact

SEQ ID NO: 14707 - DNA, 25 bp, synthetic construct
  misc_feature 1..25: note = Synthetic Construct
  source 1..25: mol_type = other DNA
gaagactcacattgactcaggaact

SEQ ID NO: 14708 - DNA, 20 bp, synthetic construct
  misc_feature 1..20: note = Synthetic Construct
  source 1..20: mol_type = other DNA
agcacccctccatccacctt

SEQ ID NO: 14709 - DNA, 22 bp, synthetic construct
  misc_feature 1..22: note = Synthetic Construct
  source 1..22: mol_type = other DNA
tcccacctttcctgggttcagt

SEQ ID NO: 14710 - DNA, 20 bp, synthetic construct
  misc_feature 1..20: note = Synthetic Construct
  source 1..20: mol_type = other DNA
cgtgccctgccatctgttct

SEQ ID NO: 14711 - DNA, 21 bp, synthetic construct
  misc_feature 1..21: note = Synthetic Construct
  source 1..21: mol_type = other DNA
agcctgatctggtggacaaag

SEQ ID NO: 14712 - DNA, 27 bp, synthetic construct
  misc_feature 1..27: note = Synthetic Construct
  source 1..27: mol_type = other DNA
cacaaacccagtgttttaggagcatga

SEQ ID NO: 14713 - DNA, 20 bp, synthetic construct
  misc_feature 1..20: note = Synthetic Construct
  source 1..20: mol_type = other DNA
ccctccattcccagccatga

SEQ ID NO: 14714 - DNA, 23 bp, synthetic construct
  misc_feature 1..23: note = Synthetic Construct
  source 1..23: mol_type = other DNA
gtatcccctatcagccaccagat

SEQ ID NO: 14715 - DNA, 22 bp, synthetic construct
  misc_feature 1..22: note = Synthetic Construct
  source 1..22: mol_type = other DNA
gggaatcaccacacttgtgtct

SEQ ID NO: 14716 - DNA, 26 bp, synthetic construct
  misc_feature 1..26: note = Synthetic Construct
  source 1..26: mol_type = other DNA
ccagtcatctccaaaaggtctgattc

SEQ ID NO: 14717 - DNA, 23 bp, synthetic construct
  misc_feature 1..23: note = Synthetic Construct
  source 1..23: mol_type = other DNA
gcacacatccacattcgttcttg

SEQ ID NO: 14718 - DNA, 22 bp, synthetic construct
  misc_feature 1..22: note = Synthetic Construct
  source 1..22: mol_type = other DNA
gtgatgtgcgttttggttcctt

SEQ ID NO: 14719 - DNA, 22 bp, synthetic construct
  misc_feature 1..22: note = Synthetic Construct
  source 1..22: mol_type = other DNA
ggggcatgattccacctgtaac

SEQ ID NO: 14720 - DNA, 21 bp, synthetic construct
  misc_feature 1..21: note = Synthetic Construct
  source 1..21: mol_type = other DNA
tgactcacaggtcaccagtct

SEQ ID NO: 14721 - DNA, 20 bp, synthetic construct
  misc_feature 1..20: note = Synthetic Construct
  source 1..20: mol_type = other DNA
agacccctggtgcctcagat

SEQ ID NO: 14722 - DNA, 20 bp, synthetic construct
  misc_feature 1..20: note = Synthetic Construct
  source 1..20: mol_type = other DNA
ctcctccgccctcatgtgaa

SEQ ID NO: 14723 - DNA, 20 bp, synthetic construct
  misc_feature 1..20: note = Synthetic Construct
  source 1..20: mol_type = other DNA
aggtctgctccagcctcatc

SEQ ID NO: 14724 - DNA, 22 bp, synthetic construct
  misc_feature 1..22: note = Synthetic Construct
  source 1..22: mol_type = other DNA
cccagctaagcacatgcacaat

SEQ ID NO: 14725 - DNA, 21 bp, synthetic construct
  misc_feature 1..21: note = Synthetic Construct
  source 1..21: mol_type = other DNA
tgaaagcggatcccggctaga

SEQ ID NO: 14726 - DNA, 22 bp, synthetic construct
  misc_feature 1..22: note = Synthetic Construct
  source 1..22: mol_type = other DNA
cggccagggagaagacaggata

SEQ ID NO: 14727 - DNA, 22 bp, synthetic construct
  misc_feature 1..22: note = Synthetic Construct
  source 1..22: mol_type = other DNA
gagtcttcgtttgcacctctgt

SEQ ID NO: 14728 - DNA, 22 bp, synthetic construct
  misc_feature 1..22: note = Synthetic Construct
  source 1..22: mol_type = other DNA
cagccataagccaagggacaca

SEQ ID NO: 14729 - DNA, 21 bp, synthetic construct
  misc_feature 1..21: note = Synthetic Construct
  source 1..21: mol_type = other DNA
ccctcccttttcaccctggat

SEQ ID NO: 14730 - DNA, 24 bp, synthetic construct
  misc_feature 1..24: note = Synthetic Construct
  source 1..24: mol_type = other DNA
gtggtttgtgtaatctcgctccaa

SEQ ID NO: 14731 - DNA, 21 bp, synthetic construct
  misc_feature 1..21: note = Synthetic Construct
  source 1..21: mol_type = other DNA
caacttgccaggggcaacaac

SEQ ID NO: 14732 - DNA, 25 bp, synthetic construct
  misc_feature 1..25: note = Synthetic Construct
  source 1..25: mol_type = other DNA
gcagctaggagtagtgaccaagaag

SEQ ID NO: 14733 - DNA, 23 bp, synthetic construct
  misc_feature 1..23: note = Synthetic Construct
  source 1..23: mol_type = other DNA
caacccctctagccatgtagtct

SEQ ID NO: 14734 - DNA, 26 bp, synthetic construct
  misc_feature 1..26: note = Synthetic Construct
  source 1..26: mol_type = other DNA
ctgaggtcaattccgattcccacatc

SEQ ID NO: 14735 - DNA, 25 bp, synthetic construct
  misc_feature 1..25: note = Synthetic Construct
  source 1..25: mol_type = other DNA
aattgatagcaggggtgaatcaaga

SEQ ID NO: 14736 - DNA, 24 bp, synthetic construct
  misc_feature 1..24: note = Synthetic Construct
  source 1..24: mol_type = other DNA
gggtttggtgacaatggctctttc

SEQ ID NO: 14737 - DNA, 25 bp, synthetic construct
  misc_feature 1..25: note = Synthetic Construct
  source 1..25: mol_type = other DNA
gactttgatcttgggtgctttcttc

SEQ ID NO: 14738 - DNA, 24 bp, synthetic construct
  misc_feature 1..24: note = Synthetic Construct
  source 1..24: mol_type = other DNA
gcgatggagtaaattaaggcacaa

SEQ ID NO: 14739 - DNA, 23 bp, synthetic construct
  misc_feature 1..23: note = Synthetic Construct
  source 1..23: mol_type = other DNA
atccacccaggggtcaagagtag

SEQ ID NO: 14740 - DNA, 21 bp, synthetic construct
  misc_feature 1..21: note = Synthetic Construct
  source 1..21: mol_type = other DNA
agcccatctcaggcatctagt

SEQ ID NO: 14741 - DNA, 23 bp, synthetic construct
  misc_feature 1..23: note = Synthetic Construct
  source 1..23: mol_type = other DNA
gacagtgacggcataaccctgaa

SEQ ID NO: 14742 - DNA, 24 bp, synthetic construct
  misc_feature 1..24: note = Synthetic Construct
  source 1..24: mol_type = other DNA
caggcactttcctctctgtgtttt

SEQ ID NO: 14743 - DNA, 21 bp, synthetic construct
  misc_feature 1..21: note = Synthetic Construct
  source 1..21: mol_type = other DNA
tcacaccagacccctaaggaa

SEQ ID NO: 14744 - DNA, 22 bp, synthetic construct
  misc_feature 1..22: note = Synthetic Construct
  source 1..22: mol_type = other DNA
acacaggtgtagccagtgtttg

SEQ ID NO: 14745 - DNA, 21 bp, synthetic construct
  misc_feature 1..21: note = Synthetic Construct
  source 1..21: mol_type = other DNA
gtggacttcagagcacagcat

SEQ ID NO: 14746 - DNA, 22 bp, synthetic construct
  misc_feature 1..22: note = Synthetic Construct
  source 1..22: mol_type = other DNA
cccttccctcctggtttcttca

SEQ ID NO: 14747 - DNA, 22 bp, synthetic construct
  misc_feature 1..22: note = Synthetic Construct
  source 1..22: mol_type = other DNA
gactgctgatctggcctccaaa

SEQ ID NO: 14748 - DNA, 20 bp, synthetic construct
  misc_feature 1..20: note = Synthetic Construct
  source 1..20: mol_type = other DNA
gcctagcagttgctcagtgt

SEQ ID NO: 14749 - DNA, 21 bp, synthetic construct
  misc_feature 1..21: note = Synthetic Construct
  source 1..21: mol_type = other DNA
cacaccttggtgctcggtatg

SEQ ID NO: 14750 - DNA, 20 bp, synthetic construct
  misc_feature 1..20: note = Synthetic Construct
  source 1..20: mol_type = other DNA
gcccatcaggtgcttgaaac

SEQ ID NO: 14751 - DNA, 25 bp, synthetic construct
  misc_feature 1..25: note = Synthetic Construct
  source 1..25: mol_type = other DNA
tcctcccttgaatatcctcaactgt

SEQ ID NO: 14752 - DNA, 20 bp, synthetic construct
  misc_feature 1..20: note = Synthetic Construct
  source 1..20: mol_type = other DNA
aaggggacctggtggcttta

SEQ ID NO: 14753 - DNA, 21 bp, synthetic construct
  misc_feature 1..21: note = Synthetic Construct
  source 1..21: mol_type = other DNA
cctgcgacagttccgtcactt

SEQ ID NO: 14754 - DNA, 22 bp, synthetic construct
  misc_feature 1..22: note = Synthetic Construct
  source 1..22: mol_type = other DNA
gctcacacgggcatgacctaat

SEQ ID NO: 14755 - DNA, 20 bp, synthetic construct
  misc_feature 1..20: note = Synthetic Construct
  source 1..20: mol_type = other DNA
ttcagggcatgagcgcctta

SEQ ID NO: 14756 - DNA, 24 bp, synthetic construct
  misc_feature 1..24: note = Synthetic Construct
  source 1..24: mol_type = other DNA
gagacaatcccttgagtgtctgat

SEQ ID NO: 14757 - DNA, 21 bp, synthetic construct
  misc_feature 1..21: note = Synthetic Construct
  source 1..21: mol_type = other DNA
ggtccgcagagagaaggaaac

SEQ ID NO: 14758 - DNA, 23 bp, synthetic construct
  misc_feature 1..23: note = Synthetic Construct
  source 1..23: mol_type = other DNA
ttgttcaagaacttgccctggta

SEQ ID NO: 14759 - DNA, 22 bp, synthetic construct
  misc_feature 1..22: note = Synthetic Construct
  source 1..22: mol_type = other DNA
cctcagtgttctcagggcatct

SEQ ID NO: 14760 - DNA, 21 bp, synthetic construct
  misc_feature 1..21: note = Synthetic Construct
  source 1..21: mol_type = other DNA
acccacagcccataggacaga

SEQ ID NO: 14761 - DNA, 21 bp, synthetic construct
  misc_feature 1..21: note = Synthetic Construct
  source 1..21: mol_type = other DNA
tggtcccaagaggcttttgtt

SEQ ID NO: 14762 - DNA, 19 bp, synthetic construct
  misc_feature 1..19: note = Synthetic Construct
  source 1..19: mol_type = other DNA
gcggaacggcctgtgaagt

SEQ ID NO: 14763 - DNA, 24 bp, synthetic construct
  misc_feature 1..24: note = Synthetic Construct
  source 1..24: mol_type = other DNA
gccatttcatacaccgttgtcttt

SEQ ID NO: 14764 - DNA, 22 bp, synthetic construct
  misc_feature 1..22: note = Synthetic Construct
  source 1..22: mol_type = other DNA
gagtttgcggggctgtttctac

SEQ ID NO: 14765 - DNA, 20 bp, synthetic construct
  misc_feature 1..20: note = Synthetic Construct
  source 1..20: mol_type = other DNA
aggagcgcatgcctgtattc

SEQ ID NO: 14766 - DNA, 22 bp, synthetic construct
  misc_feature 1..22: note = Synthetic Construct
  source 1..22: mol_type = other DNA
tgcagagggatggaggactatg

SEQ ID NO: 14767 - DNA, 22 bp, synthetic construct
  misc_feature 1..22: note = Synthetic Construct
  source 1..22: mol_type = other DNA
ctgtatgttctcgggcctcagt

SEQ ID NO: 14768 - DNA, 19 bp, synthetic construct
  misc_feature 1..19: note = Synthetic Construct
  source 1..19: mol_type = other DNA
ctccggaaacgctgcagat

SEQ ID NO: 14769 - DNA, 23 bp, synthetic construct
  misc_feature 1..23: note = Synthetic Construct
  source 1..23: mol_type = other DNA
cctctggttgggatgagggtttg

SEQ ID NO: 14770 - DNA, 22 bp, synthetic construct
  misc_feature 1..22: note = Synthetic Construct
  source 1..22: mol_type = other DNA
tggtctggaaacctggtgattc

SEQ ID NO: 14771 - DNA, 19 bp, synthetic construct
  misc_feature 1..19: note = Synthetic Construct
  source 1..19: mol_type = other DNA
ttgccggctgacgtcttag

SEQ ID NO: 14772 - DNA, 20 bp, synthetic construct
  misc_feature 1..20: note = Synthetic Construct
  source 1..20: mol_type = other DNA
gctggcatcacctcaacagt

SEQ ID NO: 14773 - DNA, 21 bp, synthetic construct
  misc_feature 1..21: note = Synthetic Construct
  source 1..21: mol_type = other DNA
ggctttggcctgagactgttg

SEQ ID NO: 14774 - DNA, 27 bp, synthetic construct
  misc_feature 1..27: note = Synthetic Construct
  source 1..27: mol_type = other DNA
gctaagaattcagcaagtaggacaaca

SEQ ID NO: 14775 - DNA, 19 bp, synthetic construct
  misc_feature 1..19: note = Synthetic Construct
  source 1..19: mol_type = other DNA
cacccagacagcagctgaa

SEQ ID NO: 14776 - DNA, 22 bp, synthetic construct
  misc_feature 1..22: note = Synthetic Construct
  source 1..22: mol_type = other DNA
cccaagcaatcctcccatctca

SEQ ID NO: 14777 - DNA, 25 bp, synthetic construct
  misc_feature 1..25: note = Synthetic Construct
  source 1..25: mol_type = other DNA
gagggagaagggaacatgaactcta

SEQ ID NO: 14778 - DNA, 21 bp, synthetic construct
  misc_feature 1..21: note = Synthetic Construct
  source 1..21: mol_type = other DNA
ggttgccctccactgtctgtt

SEQ ID NO: 14779 - DNA, 21 bp, synthetic construct
  misc_feature 1..21: note = Synthetic Construct
  source 1..21: mol_type = other DNA
cagccttacctgccctgtact

SEQ ID NO: 14780 - DNA, 22 bp, synthetic construct
  misc_feature 1..22: note = Synthetic Construct
  source 1..22: mol_type = other DNA
cagtggataaagtggcccatgt

SEQ ID NO: 14781 - DNA, 18 bp, synthetic construct
  misc_feature 1..18: note = Synthetic Construct
  source 1..18: mol_type = other DNA
tggcccacacctccatca

SEQ ID NO: 14782 - DNA, 22 bp, synthetic construct
  misc_feature 1..22: note = Synthetic Construct
  source 1..22: mol_type = other DNA
ggggaagttgctgtgtttctgt

SEQ ID NO: 14783 - DNA, 21 bp, synthetic construct
  misc_feature 1..21: note = Synthetic Construct
  source 1..21: mol_type = other DNA
gctaccgacaacggcaacaac

SEQ ID NO: 14784 - DNA, 19 bp, synthetic construct
  misc_feature 1..19: note = Synthetic Construct
  source 1..19: mol_type = other DNA
cgatttgagccccgcttct

SEQ ID NO: 14785 - DNA, 20 bp, synthetic construct
  misc_feature 1..20: note = Synthetic Construct
  source 1..20: mol_type = other DNA
cctcggcacgtaggtggttt

SEQ ID NO: 14786 - DNA, 23 bp, synthetic construct
  misc_feature 1..23: note = Synthetic Construct
  source 1..23: mol_type = other DNA
gcaaaggttgaacagacctggat

SEQ ID NO: 14787 - DNA, 20 bp, synthetic construct
  misc_feature 1..20: note = Synthetic Construct
  source 1..20: mol_type = other DNA
ttcgatccgaccgggacaag

SEQ ID NO: 14788 - DNA, 19 bp, synthetic construct
  misc_feature 1..19: note = Synthetic Construct
  source 1..19: mol_type = other DNA
agggcactcgtgcttttga

SEQ ID NO: 14789 - DNA, 23 bp, synthetic construct
  misc_feature 1..23: note = Synthetic Construct
  source 1..23: mol_type = other DNA
tcatcctggagggtgtagagatg

SEQ ID NO: 14790 - DNA, 18 bp, synthetic construct
  misc_feature 1..18: note = Synthetic Construct
  source 1..18: mol_type = other DNA
tgcactcggcacctgtct

SEQ ID NO: 14791 - DNA, 23 bp, synthetic construct
  misc_feature 1..23: note = Synthetic Construct
  source 1..23: mol_type = other DNA
gcaacttgtgatgccttctttga

SEQ ID NO: 14792 - DNA, 21 bp, synthetic construct
  misc_feature 1..21: note = Synthetic Construct
  source 1..21: mol_type = other DNA
gcaccacgggaactggtgaat

SEQ ID NO: 14793 - DNA, 22 bp, synthetic construct
  misc_feature 1..22: note = Synthetic Construct
  source 1..22: mol_type = other DNA
ataaggcggtaggcaggactca

SEQ ID NO: 14794 - DNA, 19 bp, synthetic construct
  misc_feature 1..19: note = Synthetic Construct
  source 1..19: mol_type = other DNA
tgtccgctaggccctctgt

SEQ ID NO: 14795 - DNA, 22 bp, synthetic construct
  misc_feature 1..22: note = Synthetic Construct
  source 1..22: mol_type = other DNA
tcaaccacgacgaacccagaga

SEQ ID NO: 14796 - DNA, 22 bp, synthetic construct
  misc_feature 1..22: note = Synthetic Construct
  source 1..22: mol_type = other DNA
catttccaccgtggtccctgtt

SEQ ID NO: 14797 - DNA, 22 bp, synthetic construct
  misc_feature 1..22: note = Synthetic Construct
  source 1..22: mol_type = other DNA
gtgctgtgactatcgtgtgagt

SEQ ID NO: 14798 - DNA, 23 bp, synthetic construct
  misc_feature 1..23: note = Synthetic Construct
  source 1..23: mol_type = other DNA
cagattgtaaccccaccccagaa

SEQ ID NO: 14799 - DNA, 25 bp, synthetic construct
  misc_feature 1..25: note = Synthetic Construct
  source 1..25: mol_type = other DNA
aaactccagagtgacccttaaactt

SEQ ID NO: 14800 - DNA, 20 bp, synthetic construct
  misc_feature 1..20: note = Synthetic Construct
  source 1..20: mol_type = other DNA
ccacagggcgaatgcaaagt

SEQ ID NO: 14801 - DNA, 23 bp, synthetic construct
  misc_feature 1..23: note = Synthetic Construct
  source 1..23: mol_type = other DNA
gctcaagaatctgccaggtgtga

SEQ ID NO: 14802 - DNA, 25 bp, synthetic construct
  misc_feature 1..25: note = Synthetic Construct
  source 1..25: mol_type = other DNA
gagtggagccaactttccttaccat

SEQ ID NO: 14803 - DNA, 20 bp, synthetic construct
  misc_feature 1..20: note = Synthetic Construct
  source 1..20: mol_type = other DNA
gcaccaatccacgctgaaca

SEQ ID NO: 14804 - DNA, 21 bp, synthetic construct
  misc_feature 1..21: note = Synthetic Construct
  source 1..21: mol_type = other DNA
aaccgcttcttgctgtgtcta

SEQ ID NO: 14805 - DNA, 26 bp, synthetic construct
  misc_feature 1..26: note = Synthetic Construct
  source 1..26: mol_type = other DNA
ccaaggtcctaaactgacctgagact

SEQ ID NO: 14806 - DNA, 19 bp, synthetic construct
  misc_feature 1..19: note = Synthetic Construct
  source 1..19: mol_type = other DNA
cacactgccacgctcttga

SEQ ID NO: 14807 - DNA, 22 bp, synthetic construct
  misc_feature 1..22: note = Synthetic Construct
  source 1..22: mol_type = other DNA
acccaggtcttcagcagcattc

SEQ ID NO: 14808 - DNA, 23 bp, synthetic construct
  misc_feature 1..23: note = Synthetic Construct
  source 1..23: mol_type = other DNA
aggagagaaccatcgagaggtaa

SEQ ID NO: 14809 - DNA, 21 bp, synthetic construct
  misc_feature 1..21: note = Synthetic Construct
  source 1..21: mol_type = other DNA
gccaagactcacgctctcctt

SEQ ID NO: 14810 - DNA, 20 bp, synthetic construct
  misc_feature 1..20: note = Synthetic Construct
  source 1..20: mol_type = other DNA
tcctatcagcgtccccttca

SEQ ID NO: 14811 - DNA, 24 bp, synthetic construct
  misc_feature 1..24: note = Synthetic Construct
  source 1..24: mol_type = other DNA
cttgtggcctggttttggttaatg

SEQ ID NO: 14812 - DNA, 20 bp, synthetic construct
  misc_feature 1..20: note = Synthetic Construct
  source 1..20: mol_type = other DNA
cctgggagtctggcgtcctt

SEQ ID NO: 14813 - DNA, 24 bp, synthetic construct
  misc_feature 1..24: note = Synthetic Construct
  source 1..24: mol_type = other DNA
gcacgttactaagggcatgtgttc

SEQ ID NO: 14814 - DNA, 21 bp, synthetic construct
  misc_feature 1..21: note = Synthetic Construct
  source 1..21: mol_type = other DNA
gctgctcttctgcagagttga

SEQ ID NO: 14815 - DNA, 25 bp, synthetic construct
  misc_feature 1..25: note = Synthetic Construct
  source 1..25: mol_type = other DNA
ccttggcagcttagtgtatgtcagt

SEQ ID NO: 14816 - DNA, 24 bp, synthetic construct
  misc_feature 1..24: note = Synthetic Construct
  source 1..24: mol_type = other DNA
tgaacccacgtaaagggacattag

SEQ ID NO: 14817 - DNA, 19 bp, synthetic construct
  misc_feature 1..19: note = Synthetic Construct
  source 1..19: mol_type = other DNA
atgggcactgctccactct

SEQ ID NO: 14818 - DNA, 20 bp, synthetic construct
  misc_feature 1..20: note = Synthetic Construct
  source 1..20: mol_type = other DNA
atgggccctgggactgatgt

SEQ ID NO: 14819 - DNA, 22 bp, synthetic construct
  misc_feature 1..22: note = Synthetic Construct
  source 1..22: mol_type = other DNA
agattgggcatgataccgcttt

SEQ ID NO: 14820 - DNA, 21 bp, synthetic construct
  misc_feature 1..21: note = Synthetic Construct
  source 1..21: mol_type = other DNA
cagagcttgttctcgggcaaa

SEQ ID NO: 14821 - DNA, 22 bp, synthetic construct
  misc_feature 1..22: note = Synthetic Construct
  source 1..22: mol_type = other DNA
gccagaggaaactccgcttcta

SEQ ID NO: 14822 - DNA, 23 bp, synthetic construct
  misc_feature 1..23: note = Synthetic Construct
  source 1..23: mol_type = other DNA
ccatcccctggtgaaggaaaatc

SEQ ID NO: 14823 - DNA, 23 bp, synthetic construct
  misc_feature 1..23: note = Synthetic Construct
  source 1..23: mol_type = other DNA
ggttcccatgagcaggaggtagt

SEQ ID NO: 14824 - DNA, 22 bp, synthetic construct
  misc_feature 1..22: note = Synthetic Construct
  source 1..22: mol_type = other DNA
cgctttcagctgcccaggaaat

SEQ ID NO: 14825 - DNA, 22 bp, synthetic construct
  misc_feature 1..22: note = Synthetic Construct
  source 1..22: mol_type = other DNA
gcactaacccatcagcacatct

SEQ ID NO: 14826 - DNA, 25 bp, synthetic construct
  misc_feature 1..25: note = Synthetic Construct
  source 1..25: mol_type = other DNA
cagactccaaagacgtggttgtgta

SEQ ID NO: 14827 - DNA, 19 bp, synthetic construct
  misc_feature 1..19: note = Synthetic Construct
  source 1..19: mol_type = other DNA
ggagcccgtgggtgatgtt

SEQ ID NO: 14828 - DNA, 18 bp, synthetic construct
  misc_feature 1..18: note = Synthetic Construct
  source 1..18: mol_type = other DNA
tgtcccgcagcacacctt

SEQ ID NO: 14829 - DNA, 24 bp, synthetic construct
  misc_feature 1..24: note = Synthetic Construct
  source 1..24: mol_type = other DNA
ccttccaggagcttcgagaacaac

SEQ ID NO: 14830 - DNA, 22 bp, synthetic construct
  misc_feature 1..22: note = Synthetic Construct
  source 1..22: mol_type = other DNA
gggctccgacactgctgtaaat

SEQ ID NO: 14831 - DNA, 20 bp, synthetic construct
  misc_feature 1..20: note = Synthetic Construct
  source 1..20: mol_type = other DNA
tgcgtgatcggcctgaagaa

SEQ ID NO: 14832 - DNA, 25 bp, synthetic construct
  misc_feature 1..25: note = Synthetic Construct
  source 1..25: mol_type = other DNA
gttcagtaatgtcagggcaaacaga

SEQ ID NO: 14833 - DNA, 20 bp, synthetic construct
  misc_feature 1..20: note = Synthetic Construct
  source 1..20: mol_type = other DNA
tgagcacgtagcggtgcatt

SEQ ID NO: 14834 - DNA, 23 bp, synthetic construct
  misc_feature 1..23: note = Synthetic Construct
  source 1..23: mol_type = other DNA
gcaaagcatgtcagtgtggttca

SEQ ID NO: 14835 - DNA, 25 bp, synthetic construct
  misc_feature 1..25: note = Synthetic Construct
  source 1..25: mol_type = other DNA
gactagaaaattgccgtgggtctca

SEQ ID NO: 14836 - DNA, 22 bp, synthetic construct
  misc_feature 1..22: note = Synthetic Construct
  source 1..22: mol_type = other DNA
cagatcagctggagggagcatt

SEQ ID NO: 14837 - DNA, 20 bp, synthetic construct
  misc_feature 1..20: note = Synthetic Construct
  source 1..20: mol_type = other DNA
atctccagcacctgcactca

SEQ ID NO: 14838 - DNA, 23 bp, synthetic construct
  misc_feature 1..23: note = Synthetic Construct
  source 1..23: mol_type = other DNA
gtgctgttgcaaagagtcgagaa

SEQ ID NO: 14839 - DNA, 23 bp, synthetic construct
  misc_feature 1..23: note = Synthetic Construct
  source 1..23: mol_type = other DNA
ggttgaaagatggagccctctga

SEQ ID NO: 14840 - DNA, 22 bp, synthetic construct
  misc_feature 1..22: note = Synthetic Construct
  source 1..22: mol_type = other DNA
gctactggggaagattgcttga

SEQ ID NO: 14841 - DNA, 24 bp, synthetic construct
  misc_feature 1..24: note = Synthetic Construct
  source 1..24: mol_type = other DNA
gccagacgagtcatctacccttgt

SEQ ID NO: 14842 - DNA, 28 bp, synthetic construct
  misc_feature 1..28: note = Synthetic Construct
  source 1..28: mol_type = other DNA
cagtcactattactgtaccaggagtgat

SEQ ID NO: 14843 - DNA, 26 bp, synthetic construct
  misc_feature 1..26: note = Synthetic Construct
  source 1..26: mol_type = other DNA
cacccaaacattggcttttcttccaa

SEQ ID NO: 14844 - DNA, 26 bp, synthetic construct
  misc_feature 1..26: note = Synthetic Construct
  source 1..26: mol_type = other DNA
gaggcactggttttggaaaaacaaca

SEQ ID NO: 14845 - DNA, 19 bp, synthetic construct
  misc_feature 1..19: note = Synthetic Construct
  source 1..19: mol_type = other DNA
catggtccccacccacaag

SEQ ID NO: 14846 - DNA, 25 bp, synthetic construct
  misc_feature 1..25: note = Synthetic Construct
  source 1..25: mol_type = other DNA
gagggagaatacagtccatgtttgt

SEQ ID NO: 14847 - DNA, 22 bp, synthetic construct
  misc_feature 1..22: note = Synthetic Construct
  source 1..22: mol_type = other DNA
agggagggaaactggtgaggta

SEQ ID NO: 14848 - DNA, 24 bp, synthetic construct
  misc_feature 1..24: note = Synthetic Construct
  source 1..24: mol_type = other DNA
ggcaaagtggagagatccagaaca

SEQ ID NO: 14849 - DNA, 25 bp, synthetic construct
  misc_feature 1..25: note = Synthetic Construct
  source 1..25: mol_type = other DNA
ctgagaggagaaactgatgcttctt

SEQ ID NO: 14850 - DNA, 22 bp, synthetic construct
  misc_feature 1..22: note = Synthetic Construct
  source 1..22: mol_type = other DNA
ggtaaccaccagtggccattct

SEQ ID NO: 14851 - DNA, 20 bp, synthetic construct
  misc_feature 1..20: note = Synthetic Construct
  source 1..20: mol_type = other DNA
tctgaggggctgggaactga

SEQ ID NO: 14852 - DNA, 23 bp, synthetic construct
  misc_feature 1..23: note = Synthetic Construct
  source 1..23: mol_type = other DNA
ccaagtggtcccatttcccctta

SEQ ID NO: 14853 - DNA, 22 bp, synthetic construct
  misc_feature 1..22: note = Synthetic Construct
  source 1..22: mol_type = other DNA
ggtgttgctggaaaggtaggat

SEQ ID NO: 14854 - DNA, 21 bp, synthetic construct
  misc_feature 1..21: note = Synthetic Construct
  source 1..21: mol_type = other DNA
aggagggtcacctttgtgtct

SEQ ID NO: 14855 - DNA, 22 bp, synthetic construct
  misc_feature 1..22: note = Synthetic Construct
  source 1..22: mol_type = other DNA
ccagaaaccgtgagtcctgtca

SEQ ID NO: 14856 - DNA, 24 bp, synthetic construct
  misc_feature 1..24: note = Synthetic Construct
  source 1..24: mol_type = other DNA
gaaccgcatagaccagtctaccta

SEQ ID NO: 14857 - DNA, 23 bp, synthetic construct
  misc_feature 1..23: note = Synthetic Construct
  source 1..23: mol_type = other DNA
tggcatcaactccctttcttcaa

SEQ ID NO: 14858 - DNA, 22 bp, synthetic construct
  misc_feature 1..22: note = Synthetic Construct
  source 1..22: mol_type = other DNA
ttgtccctgcctgaaggactca

SEQ ID NO: 14859 - DNA, 26 bp, synthetic construct
  misc_feature 1..26: note = Synthetic Construct
  source 1..26: mol_type = other DNA
ggagcaatgtctacaaggatgagatg

SEQ ID NO: 14860 - DNA, 27 bp, synthetic construct
  misc_feature 1..27: note = Synthetic Construct
  source 1..27: mol_type = other DNA
ggcacacagtcatggtagaataaactt

SEQ ID NO: 14861 - DNA, 22 bp, synthetic construct
  misc_feature 1..22: note = Synthetic Construct
  source 1..22: mol_type = other DNA
cagtgaccaagtgggagagaag

SEQ ID NO: 14862 - DNA, 24 bp, synthetic construct
  misc_feature 1..24: note = Synthetic Construct
  source 1..24: mol_type = other DNA
cacaaattccgggagatgaactga

SEQ ID NO: 14863 - DNA, 21 bp, synthetic construct
  misc_feature 1..21: note = Synthetic Construct
  source 1..21: mol_type = other DNA
ctgcagcagaggtttgcaagt

SEQ ID NO: 14864 - DNA, 23 bp, synthetic construct
  misc_feature 1..23: note = Synthetic Construct
  source 1..23: mol_type = other DNA
gacaggacttgcacagagcatga

SEQ ID NO: 14865 - DNA, 21 bp, synthetic construct
  misc_feature 1..21: note = Synthetic Construct
  source 1..21: mol_type = other DNA
gatgacagacacgcaggaaga

SEQ ID NO: 14866 - DNA, 22 bp, synthetic construct
  misc_feature 1..22: note = Synthetic Construct
  source 1..22: mol_type = other DNA
atatccgccccatctcctcagt

SEQ ID NO: 14867 - DNA, 24 bp, synthetic construct
  misc_feature 1..24: note = Synthetic Construct
  source 1..24: mol_type = other DNA
caaacccaatgctacactccactt

SEQ ID NO: 14868 - DNA, 20 bp, synthetic construct
  misc_feature 1..20: note = Synthetic Construct
  source 1..20: mol_type = other DNA
gggcctgcctccaagagtta

SEQ ID NO: 14869 - DNA, 20 bp, synthetic construct
  misc_feature 1..20: note = Synthetic Construct
  source 1..20: mol_type = other DNA
gtcggcagttctgggcatga

SEQ ID NO: 14870 - DNA, 22 bp, synthetic construct
  misc_feature 1..22: note = Synthetic Construct
  source 1..22: mol_type = other DNA
ctcacaacccagaagcccttga

SEQ ID NO: 14871 - DNA, 20 bp, synthetic construct
  misc_feature 1..20: note = Synthetic Construct
  source 1..20: mol_type = other DNA
gcgccttccttcctccgttt

SEQ ID NO: 14872 - DNA, 19 bp, synthetic construct
  misc_feature 1..19: note = Synthetic Construct
  source 1..19: mol_type = other DNA
tgctggccagaccctgcat

SEQ ID NO: 14873 - DNA, 21 bp, synthetic construct
  misc_feature 1..21: note = Synthetic Construct
  source 1..21: mol_type = other DNA
gctttgcagaccagcaaggaa

SEQ ID NO: 14874 - DNA, 21 bp, synthetic construct
  misc_feature 1..21: note = Synthetic Construct
  source 1..21: mol_type = other DNA
ggcccatcttggggttcagtt

SEQ ID NO: 14875 - DNA, 21 bp, synthetic construct
  misc_feature 1..21: note = Synthetic Construct
  source 1..21: mol_type = other DNA
ccaagggcaggcagtgttttg

SEQ ID NO: 14876 - DNA, 25 bp, synthetic construct
  misc_feature 1..25: note = Synthetic Construct
  source 1..25: mol_type = other DNA
ccatcgtggaatttttgtccaatct

SEQ ID NO: 14877 - DNA, 22 bp, synthetic construct
  misc_feature 1..22: note = Synthetic Construct
  source 1..22: mol_type = other DNA
ggagaactggacggttgtgaag

SEQ ID NO: 14878 - DNA, 22 bp, synthetic construct
  misc_feature 1..22: note = Synthetic Construct
  source 1..22: mol_type = other DNA
cctgttgaagccactagaccaa

SEQ ID NO: 14879 - DNA, 21 bp, synthetic construct
  misc_feature 1..21: note = Synthetic Construct
  source 1..21: mol_type = other DNA
gtgtgatctggtggcttcaca

SEQ ID NO: 14880 - DNA, 22 bp, synthetic construct
  misc_feature 1..22: note = Synthetic Construct
  source 1..22: mol_type = other DNA
agttccctgggtggaggaacaa

SEQ ID NO: 14881 - DNA, 21 bp, synthetic construct
  misc_feature 1..21: note = Synthetic Construct
  source 1..21: mol_type = other DNA
gtcccaaagcagccatagaca

SEQ ID NO: 14882 - DNA, 23 bp, synthetic construct
  misc_feature 1..23: note = Synthetic Construct
  source 1..23: mol_type = other DNA
ggtgcagttgaatggtggcctta

SEQ ID NO: 14883 - DNA, 19 bp, synthetic construct
  misc_feature 1..19: note = Synthetic Construct
  source 1..19: mol_type = other DNA
cctcctgccaccacgtgaa

SEQ ID NO: 14884 - DNA, 22 bp, synthetic construct
  misc_feature 1..22: note = Synthetic Construct
  source 1..22: mol_type = other DNA
gtgagcaagagaccctgactga

SEQ ID NO: 14885 - DNA, 22 bp, synthetic construct
  misc_feature 1..22: note = Synthetic Construct
  source 1..22: mol_type = other DNA
cactgcaccatgctcttcatgt

SEQ ID NO: 14886 - DNA, 19 bp, synthetic construct
  misc_feature 1..19: note = Synthetic Construct
  source 1..19: mol_type = other DNA
gatggccggaagcagaagt

SEQ ID NO: 14887 - DNA, 22 bp, synthetic construct
  misc_feature 1..22: note = Synthetic Construct
  source 1..22: mol_type = other DNA
tcaacctcccgggctaacatga

SEQ ID NO: 14888 - DNA, 26 bp, synthetic construct
  misc_feature 1..26: note = Synthetic Construct
  source 1..26: mol_type = other DNA
catggaatcactcagtgtcatagtca

SEQ ID NO: 14889 - DNA, 21 bp, synthetic construct
  misc_feature 1..21: note = Synthetic Construct
  source 1..21: mol_type = other DNA
tggacacacaggtggaagatg

SEQ ID NO: 14890 - DNA, 22 bp, synthetic construct
  misc_feature 1..22: note = Synthetic Construct
  source 1..22: mol_type = other DNA
actcagtgggttctggatgtga

SEQ ID NO: 14891 - DNA, 21 bp, synthetic construct
  misc_feature 1..21: note = Synthetic Construct
  source 1..21: mol_type = other DNA
ccacctagaacccacgacaaa

SEQ ID NO: 14892 - DNA, 23 bp, synthetic construct
  misc_feature 1..23: note = Synthetic Construct
  source 1..23: mol_type = other DNA
ctcacaaagggctacagggcatt

SEQ ID NO: 14893 - DNA, 24 bp, synthetic construct
  misc_feature 1..24: note = Synthetic Construct
  source 1..24: mol_type = other DNA
ggataggcaactctcagggcaaat

SEQ ID NO: 14894 - DNA, 19 bp, synthetic construct
  misc_feature 1..19: note = Synthetic Construct
  source 1..19: mol_type = other DNA
ctggccgatggggttcatc

SEQ ID NO: 14895 - DNA, 28 bp, synthetic construct
  misc_feature 1..28: note = Synthetic Construct
  source 1..28: mol_type = other DNA
ctgggctcaaacaatacttctaccttag

SEQ ID NO: 14896 - DNA, 25 bp, synthetic construct
  misc_feature 1..25: note = Synthetic Construct
  source 1..25: mol_type = other DNA
gagggactagcacagcaatacaaag

SEQ ID NO: 14897 - DNA, 22 bp, synthetic construct
  misc_feature 1..22: note = Synthetic Construct
  source 1..22: mol_type = other DNA
acacccaacagcccctgataga

SEQ ID NO: 14898 - DNA, 25 bp, synthetic construct
  misc_feature 1..25: note = Synthetic Construct
  source 1..25: mol_type = other DNA
ccctgatcttgcctaacccttcaga

SEQ ID NO: 14899 - DNA, 25 bp, synthetic construct
  misc_feature 1..25: note = Synthetic Construct
  source 1..25: mol_type = other DNA
gccaagatccactgttagaccaaga

SEQ ID NO: 14900 - DNA, 24 bp, synthetic construct
  misc_feature 1..24: note = Synthetic Construct
  source 1..24: mol_type = other DNA
ggaaagctctctgagctgaaaatg

SEQ ID NO: 14901 - DNA, 22 bp, synthetic construct
  misc_feature 1..22: note = Synthetic Construct
  source 1..22: mol_type = other DNA
atgtgatggctttggaccagat

SEQ ID NO: 14902 - DNA, 23 bp, synthetic construct
  misc_feature 1..23: note = Synthetic Construct
  source 1..23: mol_type = other DNA
ggagacagctagggtgtggacat

SEQ ID NO: 14903 - DNA, 26 bp, synthetic construct
  misc_feature 1..26: note = Synthetic Construct
  source 1..26: mol_type = other DNA
gtccacctgacttgcattctttctct

SEQ ID NO: 14904 - DNA, 22 bp, synthetic construct
  misc_feature 1..22: note = Synthetic Construct
  source 1..22: mol_type = other DNA
ccctcccaactctgaagtttgt

SEQ ID NO: 14905 - DNA, 25 bp, synthetic construct
  misc_feature 1..25: note = Synthetic Construct
  source 1..25: mol_type = other DNA
gctgtgtcaaccctcaaagttcaga

SEQ ID NO: 14906 - DNA, 22 bp, synthetic construct
  misc_feature 1..22: note = Synthetic Construct
  source 1..22: mol_type = other DNA
tgactacagctcactgctcttg

SEQ ID NO: 14907 - DNA, 24 bp, synthetic construct
  misc_feature 1..24: note = Synthetic Construct
  source 1..24: mol_type = other DNA
gtcatcggaagttaagccgcatct

SEQ ID NO: 14908 - DNA, 23 bp, synthetic construct
  misc_feature 1..23: note = Synthetic Construct
  source 1..23: mol_type = other DNA
gcaatgtaggagtggatggcttt

SEQ ID NO: 14909 - DNA, 23 bp, synthetic construct
  misc_feature 1..23: note = Synthetic Construct
  source 1..23: mol_type = other DNA
gggtttcaacaactcaagtgcaa

SEQ ID NO: 14910 - DNA, 30 bp, synthetic construct
  misc_feature 1..30: note = Synthetic Construct
  source 1..30: mol_type = other DNA
ctggaaaatcacctaattcaagcccaaatc

SEQ ID NO: 14911 - DNA, 26 bp, synthetic construct
  misc_feature 1..26: note = Synthetic Construct
  source 1..26: mol_type = other DNA
ccaagcatatcatttactccccattc

SEQ ID NO: 14912 - DNA, 22 bp, synthetic construct
  misc_feature 1..22: note = Synthetic Construct
  source 1..22: mol_type = other DNA
ctggcaagggttggagacacat

SEQ ID NO: 14913 - DNA, 22 bp, synthetic construct
  misc_feature 1..22: note = Synthetic Construct
  source 1..22: mol_type = other DNA
tggggacttgtggtgccttttc

SEQ ID NO: 14914 - DNA, 22 bp, synthetic construct
  misc_feature 1..22: note = Synthetic Construct
  source 1..22: mol_type = other DNA
cgggagattaagcgccagttac

SEQ ID NO: 14915 - DNA, 21 bp, synthetic construct
  misc_feature 1..21: note = Synthetic Construct
  source 1..21: mol_type = other DNA
gcatagctggtcacacactct

SEQ ID NO: 14916 - DNA, 20 bp, synthetic construct
  misc_feature 1..20: note = Synthetic Construct
  source 1..20: mol_type = other DNA
ggctccatcctcaggcttca

SEQ ID NO: 14917 - DNA, 24 bp, synthetic construct
  misc_feature 1..24: note = Synthetic Construct
  source 1..24: mol_type = other DNA
cgaggtgagacgctatctatgcaa

SEQ ID NO: 14918 - DNA, 19 bp, synthetic construct
  misc_feature 1..19: note = Synthetic Construct
  source 1..19: mol_type = other DNA
cgctcctgcaggtctctgt

SEQ ID NO: 14919 - DNA, 24 bp, synthetic construct
  misc_feature 1..24: note = Synthetic Construct
  source 1..24: mol_type = other DNA
caggctatgacatcaaggctttct

SEQ ID NO: 14920 - DNA, 22 bp, synthetic construct
  misc_feature 1..22: note = Synthetic Construct
  source 1..22: mol_type = other DNA
gcctcaatgggagcttctcaac

SEQ ID NO: 14921 - DNA, 24 bp, synthetic construct
  misc_feature 1..24: note = Synthetic Construct
  source 1..24: mol_type = other DNA
gaggaccagggagtggaatgaagt

SEQ ID NO: 14922 - DNA, 28 bp, synthetic construct
  misc_feature 1..28: note = Synthetic Construct
  source 1..28: mol_type = other DNA
ctgcctggaatgctctttctctagattt

SEQ ID NO: 14923 - DNA, 23 bp, synthetic construct
  misc_feature 1..23: note = Synthetic Construct
  source 1..23: mol_type = other DNA
cagtgtcaggaaatgtgccttgt

SEQ ID NO: 14924 - DNA, 21 bp, synthetic construct
  misc_feature 1..21: note = Synthetic Construct
  source 1..21: mol_type = other DNA
ggatggctgatgcttccgatt

SEQ ID NO: 14925 - DNA, 22 bp, synthetic construct
  misc_feature 1..22: note = Synthetic Construct
  source 1..22: mol_type = other DNA
cgcgtgccttacattggtgtca

SEQ ID NO: 14926 - DNA, 24 bp, synthetic construct
  misc_feature 1..24: note = Synthetic Construct
  source 1..24: mol_type = other DNA
tcggcttgaccaactacaaattct

SEQ ID NO: 14927 - DNA, 21 bp, synthetic construct
  misc_feature 1..21: note = Synthetic Construct
  source 1..21: mol_type = other DNA
tcgcagtgcctggttctctga

SEQ ID NO: 14928 - DNA, 20 bp, synthetic construct
  misc_feature 1..20: note = Synthetic Construct
  source 1..20: mol_type = other DNA
agttgctctcccagccaaga

SEQ ID NO: 14929 - DNA, 22 bp, synthetic construct
  misc_feature 1..22: note = Synthetic Construct
  source 1..22: mol_type = other DNA
gaggactgacaggttcctgctt

SEQ ID NO: 14930 - DNA, 24 bp, synthetic construct
  misc_feature 1..24: note = Synthetic Construct
  source 1..24: mol_type = other DNA
ccgcagagacaatgtaagatgttc

SEQ ID NO: 14931 - DNA, 20 bp, synthetic construct
  misc_feature 1..20: note = Synthetic Construct
  source 1..20: mol_type = other DNA
agccacactgcctcagcaaa

SEQ ID NO: 14932 - DNA, 22 bp, synthetic construct
  misc_feature 1..22: note = Synthetic Construct
  source 1..22: mol_type = other DNA
cctcaaacctccctgtggctaa

SEQ ID NO: 14933 - DNA, 20 bp, synthetic construct
  misc_feature 1..20: note = Synthetic Construct
  source 1..20: mol_type = other DNA
catgaccctgctcacacctt

SEQ ID NO: 14934 - DNA, 20 bp, synthetic construct
  misc_feature 1..20: note = Synthetic Construct
  source 1..20: mol_type = other DNA
tcccagtgttccctcactca

SEQ ID NO: 14935 - DNA, 22 bp, synthetic construct
  misc_feature 1..22: note = Synthetic Construct
  source 1..22: mol_type = other DNA
ccccaaacccttttctggtgtt

SEQ ID NO: 14936 - DNA, 20 bp, synthetic construct
  misc_feature 1..20: note = Synthetic Construct
  source 1..20: mol_type = other DNA
gcccaaatccagggacaaca

SEQ ID NO: 14937 - DNA, 19 bp, synthetic construct
  misc_feature 1..19: note = Synthetic Construct
  source 1..19: mol_type = other DNA
gccggctggttccatcact

SEQ ID NO: 14938 - DNA, 23 bp, synthetic construct
  misc_feature 1..23: note = Synthetic Construct
  source 1..23: mol_type = other DNA
gagctgggttcaaaccaaaaagt

SEQ ID NO: 14939 - DNA, 26 bp, synthetic construct
  misc_feature 1..26: note = Synthetic Construct
  source 1..26: mol_type = other DNA
gtgcattctccatcatggcattgaaa

SEQ ID NO: 14940 - DNA, 25 bp, synthetic construct
  misc_feature 1..25: note = Synthetic Construct
  source 1..25: mol_type = other DNA
gcttggcctctttctgaacctacta

SEQ ID NO: 14941 - DNA, 21 bp, synthetic construct
  misc_feature 1..21: note = Synthetic Construct
  source 1..21: mol_type = other DNA
gcttcccagcatgaacccttt

SEQ ID NO: 14942 - DNA, 24 bp, synthetic construct
  misc_feature 1..24: note = Synthetic Construct
  source 1..24: mol_type = other DNA
ccttccctgagaatagcacctgtt

SEQ ID NO: 14943 - DNA, 24 bp, synthetic construct
  misc_feature 1..24: note = Synthetic Construct
  source 1..24: mol_type = other DNA
acactcgtaacagcatctttcaga

SEQ ID NO: 14944 - DNA, 22 bp, synthetic construct
  misc_feature 1..22: note = Synthetic Construct
  source 1..22: mol_type = other DNA
tctctggccctcagtcctttgt

SEQ ID NO: 14945 - DNA, 24 bp, synthetic construct
  misc_feature 1..24: note = Synthetic Construct
  source 1..24: mol_type = other DNA
cagccacatgagtcctttccagat

SEQ ID NO: 14946 - DNA, 23 bp, synthetic construct
  misc_feature 1..23: note = Synthetic Construct
  source 1..23: mol_type = other DNA
tcttgccaggtaatagcctcaac

SEQ ID NO: 14947 - DNA, 26 bp, synthetic construct
  misc_feature 1..26: note = Synthetic Construct
  source 1..26: mol_type = other DNA
accagggagactaagaaacacttttg

SEQ ID NO: 14948 - DNA, 24 bp, synthetic construct
  misc_feature 1..24: note = Synthetic Construct
  source 1..24: mol_type = other DNA
catcccttccctacttctccattc

SEQ ID NO: 14949 - DNA, 20 bp, synthetic construct
  misc_feature 1..20: note = Synthetic Construct
  source 1..20: mol_type = other DNA
cccgtccagttggtgctcat

SEQ ID NO: 14950 - DNA, 24 bp, synthetic construct
  misc_feature 1..24: note = Synthetic Construct
  source 1..24: mol_type = other DNA
gcctcaaaaccagggaggatgaca

SEQ ID NO: 14951 - DNA, 25 bp, synthetic construct
  misc_feature 1..25: note = Synthetic Construct
  source 1..25: mol_type = other DNA
ggcaaataaactcacttgcaggtat

SEQ ID NO: 14952 - DNA, 22 bp, synthetic construct
  misc_feature 1..22: note = Synthetic Construct
  source 1..22: mol_type = other DNA
gcaacgggaacttccactcact

SEQ ID NO: 14953 - DNA, 22 bp, synthetic construct
  misc_feature 1..22: note = Synthetic Construct
  source 1..22: mol_type = other DNA
aggaaccagtagggctatcaca

SEQ ID NO: 14954 - DNA, 21 bp, synthetic construct
  misc_feature 1..21: note = Synthetic Construct
  source 1..21: mol_type = other DNA
ggcatgcaaggagagaggaaa

SEQ ID NO: 14955 - DNA, 20 bp, synthetic construct
  misc_feature 1..20: note = Synthetic Construct
  source 1..20: mol_type = other DNA
acccaccctgcctgttatgt

SEQ ID NO: 14956 - DNA, 25 bp, synthetic construct
  misc_feature 1..25: note = Synthetic Construct
  source 1..25: mol_type = other DNA
ccttaacttcctgcagagcttcaat

SEQ ID NO: 14957 - DNA, 23 bp, synthetic construct
  misc_feature 1..23: note = Synthetic Construct
  source 1..23: mol_type = other DNA
gtgggctccaaagttccctttac

SEQ ID NO: 14958 - DNA, 23 bp, synthetic construct
  misc_feature 1..23: note = Synthetic Construct
  source 1..23: mol_type = other DNA
ctcgacatggccctaggtaatga

SEQ ID NO: 14959 - DNA, 25 bp, synthetic construct
  misc_feature 1..25: note = Synthetic Construct
  source 1..25: mol_type = other DNA
gatttctttcctgagtgaggtccaa

SEQ ID NO: 14960 - DNA, 22 bp, synthetic construct
  misc_feature 1..22: note = Synthetic Construct
  source 1..22: mol_type = other DNA
ggggatctttcgccacaaggaa

SEQ ID NO: 14961 - DNA, 22 bp, synthetic construct
  misc_feature 1..22: note = Synthetic Construct
  source 1..22: mol_type = other DNA
ccttcaacgcaaagtgcacaac

SEQ ID NO: 14962 - DNA, 20 bp, synthetic construct
  misc_feature 1..20: note = Synthetic Construct
  source 1..20: mol_type = other DNA
gccgatagtcccagctgttt

SEQ ID NO: 14963 - DNA, 22 bp, synthetic construct
  misc_feature 1..22: note = Synthetic Construct
  source 1..22: mol_type = other DNA
tggtttagcaagcagacagcat

SEQ ID NO: 14964 - DNA, 23 bp, synthetic construct
  misc_feature 1..23: note = Synthetic Construct
  source 1..23: mol_type = other DNA
agcgttggtaagagccattgatt

SEQ ID NO: 14965 - DNA, 19 bp, synthetic construct
  misc_feature 1..19: note = Synthetic Construct
  source 1..19: mol_type = other DNA
aggtgggctggggtcatgt

SEQ ID NO: 14966 - DNA, 20 bp, synthetic construct
  misc_feature 1..20: note = Synthetic Construct
  source 1..20: mol_type = other DNA
tcagcaggcactggcgaatc

SEQ ID NO: 14967 - DNA, 28 bp, synthetic construct
  misc_feature 1..28: note = Synthetic Construct
  source 1..28: mol_type = other DNA
ggttctgaggttctatccaaatgtcttc

SEQ ID NO: 14968 - DNA, 21 bp, synthetic construct
  misc_feature 1..21: note = Synthetic Construct
  source 1..21: mol_type = other DNA
ctcacaggggatggtcgaatg

SEQ ID NO: 14969 - DNA, 22 bp, synthetic construct
  misc_feature 1..22: note = Synthetic Construct
  source 1..22: mol_type = other DNA
tcaggtgtagcgggcagttagt

SEQ ID NO: 14970 - DNA, 21 bp, synthetic construct
  misc_feature 1..21: note = Synthetic Construct
  source 1..21: mol_type = other DNA
cacctttcccaagtggccttt

SEQ ID NO: 14971 - DNA, 22 bp, synthetic construct
  misc_feature 1..22: note = Synthetic Construct
  source 1..22: mol_type = other DNA
ttcccacggagaggagaacaca

SEQ ID NO: 14972 - DNA, 20 bp, synthetic construct
  misc_feature 1..20: note = Synthetic Construct
  source 1..20: mol_type = other DNA
atggctgctgctgccctaga

SEQ ID NO: 14973 - DNA, 25 bp, synthetic construct
  misc_feature 1..25: note = Synthetic Construct
  source 1..25: mol_type = other DNA
ctgtcggaaaacaaagagcatctga

SEQ ID NO: 14974 - DNA, 25 bp, synthetic construct
  misc_feature 1..25: note = Synthetic Construct
  source 1..25: mol_type = other DNA
tctcaaagacgaccaagtgattctt

SEQ ID NO: 14975 - DNA, 22 bp, synthetic construct
  misc_feature 1..22: note = Synthetic Construct
  source 1..22: mol_type = other DNA
cctcctgaattctgaggccttt

SEQ ID NO: 14976 - DNA, 21 bp, synthetic construct
  misc_feature 1..21: note = Synthetic Construct
  source 1..21: mol_type = other DNA
ggaacaatgcccagccacact

SEQ ID NO: 14977 - DNA, 21 bp, synthetic construct
  misc_feature 1..21: note = Synthetic Construct
  source 1..21: mol_type = other DNA
aggcttggttcagtggctcta

SEQ ID NO: 14978 - DNA, 19 bp, synthetic construct
  misc_feature 1..19: note = Synthetic Construct
  source 1..19: mol_type = other DNA
actccgctgctgaggacta

SEQ ID NO: 14979 - DNA, 23 bp, synthetic construct
  misc_feature 1..23: note = Synthetic Construct
  source 1..23: mol_type = other DNA
gaactgaagatgcacccacacta

SEQ ID NO: 14980 - DNA, 22 bp, synthetic construct
  misc_feature 1..22: note = Synthetic Construct
  source 1..22: mol_type = other DNA
ggaccacatgcctggttagtca

SEQ ID NO: 14981 - DNA, 22 bp, synthetic construct
  misc_feature 1..22: note = Synthetic Construct
  source 1..22: mol_type = other DNA
gccaccagagcttgacactgtt

SEQ ID NO: 14982 - DNA, 23 bp, synthetic construct
  misc_feature 1..23: note = Synthetic Construct
  source 1..23: mol_type = other DNA
gagaagtaggggcatgtgtgtga

SEQ ID NO: 14983 - DNA, 23 bp, synthetic construct
  misc_feature 1..23: note = Synthetic Construct
  source 1..23: mol_type = other DNA
gaccagagcagatttggatgaga

SEQ ID NO: 14984 - DNA, 24 bp, synthetic construct
  misc_feature 1..24: note = Synthetic Construct
  source 1..24: mol_type = other DNA
ggaaaagctacagcctaccccaaa

SEQ ID NO: 14985 - DNA, 24 bp, synthetic construct
  misc_feature 1..24: note = Synthetic Construct
  source 1..24: mol_type = other DNA
tgaacaccaacagtaagaggacaa

SEQ ID NO: 14986 - DNA, 21 bp, synthetic construct
  misc_feature 1..21: note = Synthetic Construct
  source 1..21: mol_type = other DNA
acggattacctgtgtgccatt

SEQ ID NO: 14987 - DNA, 19 bp, synthetic construct
  misc_feature 1..19: note = Synthetic Construct
  source 1..19: mol_type = other DNA
agggtgggcgaccagtttg

SEQ ID NO: 14988 - DNA, 23 bp, synthetic construct
  misc_feature 1..23: note = Synthetic Construct
  source 1..23: mol_type = other DNA
ggacttcagggagcttctactca

SEQ ID NO: 14989 - DNA, 26 bp, synthetic construct
  misc_feature 1..26: note = Synthetic Construct
  source 1..26: mol_type = other DNA
cttccaacacagggaatcaaagttca

SEQ ID NO: 14990 - DNA, 24 bp, synthetic construct
  misc_feature 1..24: note = Synthetic Construct
  source 1..24: mol_type = other DNA
caccacgctagttggtgatagaac

SEQ ID NO: 14991 - DNA, 20 bp, synthetic construct
  misc_feature 1..20: note = Synthetic Construct
  source 1..20: mol_type = other DNA
gccttgctgtcctccaaact

SEQ ID NO: 14992 - DNA, 22 bp, synthetic construct
  misc_feature 1..22: note = Synthetic Construct
  source 1..22: mol_type = other DNA
gatgccactgtcattccagaca

SEQ ID NO: 14993 - DNA, 22 bp, synthetic construct
  misc_feature 1..22: note = Synthetic Construct
  source 1..22: mol_type = other DNA
aacgtctcgccactccctgtct

SEQ ID NO: 14994 - DNA, 21 bp, synthetic construct
  misc_feature 1..21: note = Synthetic Construct
  source 1..21: mol_type = other DNA
gtggtgctggatgggaaggaa

SEQ ID NO: 14995 - DNA, 22 bp, synthetic construct
  misc_feature 1..22: note = Synthetic Construct
  source 1..22: mol_type = other DNA
caagacacccatgccctcactt

SEQ ID NO: 14996 - DNA, 23 bp, synthetic construct
  misc_feature 1..23: note = Synthetic Construct
  source 1..23: mol_type = other DNA
gcttcagcaagtcatcctgatct

SEQ ID NO: 14997 - DNA, 20 bp, synthetic construct
  misc_feature 1..20: note = Synthetic Construct
  source 1..20: mol_type = other DNA
cctcgaggaacttcgccttt

SEQ ID NO: 14998 - DNA, 23 bp, synthetic construct
  misc_feature 1..23: note = Synthetic Construct
  source 1..23: mol_type = other DNA
tcaacctctcaggctctagtgat

SEQ ID NO: 14999 - DNA, 20 bp, synthetic construct
  misc_feature 1..20: note = Synthetic Construct
  source 1..20: mol_type = other DNA
tccgctgcactcaaaacgaa

SEQ ID NO: 15000 - DNA, 25 bp, synthetic construct
  misc_feature 1..25: note = Synthetic Construct
  source 1..25: mol_type = other DNA
ccactcacagaagtgccactgtttc

SEQ ID NO: 15001 - DNA, 23 bp, synthetic construct
  misc_feature 1..23: note = Synthetic Construct
  source 1..23: mol_type = other DNA
gcacccaaaatggacatccaaca

SEQ ID NO: 15002 - DNA, 19 bp, synthetic construct
  misc_feature 1..19: note = Synthetic Construct
  source 1..19: mol_type = other DNA
ggccagctcttcactgcat

SEQ ID NO: 15003 - DNA, 25 bp, synthetic construct
  misc_feature 1..25: note = Synthetic Construct
  source 1..25: mol_type = other DNA
gcactaacacgtagcctgagtaatg

SEQ ID NO: 15004 - DNA, 20 bp, synthetic construct
  misc_feature 1..20: note = Synthetic Construct
  source 1..20: mol_type = other DNA
tggtgtggttgcgggagaag

SEQ ID NO: 15005 - DNA, 21 bp, synthetic construct
  misc_feature 1..21: note = Synthetic Construct
  source 1..21: mol_type = other DNA
ccatcgtgctaggcaggtagt

SEQ ID NO: 15006 - DNA, 26 bp, synthetic construct
  misc_feature 1..26: note = Synthetic Construct
  source 1..26: mol_type = other DNA
cctctttaccttccagctccttgcat

SEQ ID NO: 15007 - DNA, 22 bp, synthetic construct
  misc_feature 1..22: note = Synthetic Construct
  source 1..22: mol_type = other DNA
ggtggcgaagaccacagtaaag

SEQ ID NO: 15008 - DNA, 20 bp, synthetic construct
  misc_feature 1..20: note = Synthetic Construct
  source 1..20: mol_type = other DNA
ggaacttcgcactggagcaa

SEQ ID NO: 15009 - DNA, 22 bp, synthetic construct
  misc_feature 1..22: note = Synthetic Construct
  source 1..22: mol_type = other DNA
tccctgcaggtgaaatcttgtt

SEQ ID NO: 15010 - DNA, 23 bp, synthetic construct
  misc_feature 1..23: note = Synthetic Construct
  source 1..23: mol_type = other DNA
gggacatttgaccagagacagaa

SEQ ID NO: 15011 - DNA, 23 bp, synthetic construct
  misc_feature 1..23: note = Synthetic Construct
  source 1..23: mol_type = other DNA
tctccacctacccctttctgtag

SEQ ID NO: 15012 - DNA, 20 bp, synthetic construct
  misc_feature 1..20: note = Synthetic Construct
  source 1..20: mol_type = other DNA
tctggcagggctggagtaga

SEQ ID NO: 15013 - DNA, 20 bp, synthetic construct
  misc_feature 1..20: note = Synthetic Construct
  source 1..20: mol_type = other DNA
cccagcagcaatgtggaaca

SEQ ID NO: 15014 - DNA, 21 bp, synthetic construct
  misc_feature 1..21: note = Synthetic Construct
  source 1..21: mol_type = other DNA
tctttccgctctcccttctct

SEQ ID NO: 15015 - DNA, 22 bp, synthetic construct
  misc_feature 1..22: note = Synthetic Construct
  source 1..22: mol_type = other DNA
ccaagacacggaaactcctcat

SEQ ID NO: 15016 - DNA, 23 bp, synthetic construct
  misc_feature 1..23: note = Synthetic Construct
  source 1..23: mol_type = other DNA
ggatcacttgaccacaggaggtt

SEQ ID NO: 15017 - DNA, 25 bp, synthetic construct
  misc_feature 1..25: note = Synthetic Construct
  source 1..25: mol_type = other DNA
gatctagctcctgcctacttcatgt

SEQ ID NO: 15018 - DNA, 26 bp, synthetic construct
  misc_feature 1..26: note = Synthetic Construct
  source 1..26: mol_type = other DNA
ctgtgtcctactgaacgttgtactga

SEQ ID NO: 15019 - DNA, 21 bp, synthetic construct
  misc_feature 1..21: note = Synthetic Construct
  source 1..21: mol_type = other DNA
gcatcactgccttccaactca

SEQ ID NO: 15020 - DNA, 21 bp, synthetic construct
  misc_feature 1..21: note = Synthetic Construct
  source 1..21: mol_type = other DNA
ggaaaaacaacccggggaaca

SEQ ID NO: 15021 - DNA, 23 bp, synthetic construct
  misc_feature 1..23: note = Synthetic Construct
  source 1..23: mol_type = other DNA
ttcctggtatgaccctgaacttg

SEQ ID NO: 15022 - DNA, 21 bp, synthetic construct
  misc_feature 1..21: note = Synthetic Construct
  source 1..21: mol_type = other DNA
cctgggacatagggagcacat

SEQ ID NO: 15023 - DNA, 30 bp, synthetic construct
  misc_feature 1..30: note = Synthetic Construct
  source 1..30: mol_type = other DNA
cggttgagaggttatatcttaggcctgtta

SEQ ID NO: 15024 - DNA, 20 bp, synthetic construct
  misc_feature 1..20: note = Synthetic Construct
  source 1..20: mol_type = other DNA
tgtggctgggatggagatca

SEQ ID NO: 15025 - DNA, 22 bp, synthetic construct
  misc_feature 1..22: note = Synthetic Construct
  source 1..22: mol_type = other DNA
tcagccacacattaacccaact

SEQ ID NO: 15026 - DNA, 21 bp, synthetic construct
  misc_feature 1..21: note = Synthetic Construct
  source 1..21: mol_type = other DNA
taaggcggtacaggggtgact

SEQ ID NO: 15027 - DNA, 23 bp, synthetic construct
  misc_feature 1..23: note = Synthetic Construct
  source 1..23: mol_type = other DNA
gcagtttagcctctgggttgaag

SEQ ID NO: 15028 - DNA, 22 bp, synthetic construct
  misc_feature 1..22: note = Synthetic Construct
  source 1..22: mol_type = other DNA
gaatacgccaggtcttgtcagt

SEQ ID NO: 15029 - DNA, 22 bp, synthetic construct
  misc_feature 1..22: note = Synthetic Construct
  source 1..22: mol_type = other DNA
cccatgaaggttcttggctttg

SEQ ID NO: 15030 - DNA, 22 bp, synthetic construct
  misc_feature 1..22: note = Synthetic Construct
  source 1..22: mol_type = other DNA
cacccttggatgctggtagtgt

SEQ ID NO: 15031 - DNA, 26 bp, synthetic construct
  misc_feature 1..26: note = Synthetic Construct
  source 1..26: mol_type = other DNA
ggttgggattgttttgtgggctattt

SEQ ID NO: 15032 - DNA, 22 bp, synthetic construct
  misc_feature 1..22: note = Synthetic Construct
  source 1..22: mol_type = other DNA
gcagacctgtgtttgagaccta

SEQ ID NO: 15033 - DNA, 22 bp, synthetic construct
  misc_feature 1..22: note = Synthetic Construct
  source 1..22: mol_type = other DNA
tcttggtgaggtcctgcaattt

SEQ ID NO: 15034 - DNA, 24 bp, synthetic construct
  misc_feature 1..24: note = Synthetic Construct
  source 1..24: mol_type = other DNA
ggaagcatctgcatcctagtagtt

SEQ ID NO: 15035 - DNA, 23 bp, synthetic construct
  misc_feature 1..23: note = Synthetic Construct
  source 1..23: mol_type = other DNA
cgatacagctgttgtctccagaa

SEQ ID NO: 15036 - DNA, 20 bp, synthetic construct
  misc_feature 1..20: note = Synthetic Construct
  source 1..20: mol_type = other DNA
gcctccactttgtgcagtgt

SEQ ID NO: 15037 - DNA, 20 bp, synthetic construct
  misc_feature 1..20: note = Synthetic Construct
  source 1..20: mol_type = other DNA
tggaggtgagggcaagttca

SEQ ID NO: 15038 - DNA, 21 bp, synthetic construct
  misc_feature 1..21: note = Synthetic Construct
  source 1..21: mol_type = other DNA
tggaaaggctggctgtctatg

SEQ ID NO: 15039 - DNA, 22 bp, synthetic construct
  misc_feature 1..22: note = Synthetic Construct
  source 1..22: mol_type = other DNA
cagtccatcttctgtgctgcta

SEQ ID NO: 15040 - DNA, 24 bp, synthetic construct
  misc_feature 1..24: note = Synthetic Construct
  source 1..24: mol_type = other DNA
cccctcccctataaaccttaggaa

SEQ ID NO: 15041 - DNA, 22 bp, synthetic construct
  misc_feature 1..22: note = Synthetic Construct
  source 1..22: mol_type = other DNA
ctgctccaggaagctgctgaat

SEQ ID NO: 15042 - DNA, 20 bp, synthetic construct
  misc_feature 1..20: note = Synthetic Construct
  source 1..20: mol_type = other DNA
ccttgcgtgctggctgtaga

SEQ ID NO: 15043 - DNA, 24 bp, synthetic construct
  misc_feature 1..24: note = Synthetic Construct
  source 1..24: mol_type = other DNA
ctcagggactagaagcaccaggta

SEQ ID NO: 15044 - DNA, 24 bp, synthetic construct
  misc_feature 1..24: note = Synthetic Construct
  source 1..24: mol_type = other DNA
gcagggtcttctttttccctcaca

SEQ ID NO: 15045 - DNA, 21 bp, synthetic construct
  misc_feature 1..21: note = Synthetic Construct
  source 1..21: mol_type = other DNA
gaggtgcagatccacactgtt

SEQ ID NO: 15046 - DNA, 21 bp, synthetic construct
  misc_feature 1..21: note = Synthetic Construct
  source 1..21: mol_type = other DNA
gccatcctttgctgtcagtgt

SEQ ID NO: 15047 - DNA, 23 bp, synthetic construct
  misc_feature 1..23: note = Synthetic Construct
  source 1..23: mol_type = other DNA
gccatttaccacccaaactggat

SEQ ID NO: 15048 - DNA, 22 bp, synthetic construct
  misc_feature 1..22: note = Synthetic Construct
  source 1..22: mol_type = other DNA
caggaaccacagagccccaaat

SEQ ID NO: 15049 - DNA, 27 bp, synthetic construct
  misc_feature 1..27: note = Synthetic Construct
  source 1..27: mol_type = other DNA
ctgttgtgacctgattctcatgtattc

SEQ ID NO: 15050 - DNA, 23 bp, synthetic construct
  misc_feature 1..23: note = Synthetic Construct
  source 1..23: mol_type = other DNA
gcaaggagtaccagctcaaggta

SEQ ID NO: 15051 - DNA, 26 bp, synthetic construct
  misc_feature 1..26: note = Synthetic Construct
  source 1..26: mol_type = other DNA
gtctccatcaacctcacttgttttac

SEQ ID NO: 15052 - DNA, 26 bp, synthetic construct
  misc_feature 1..26: note = Synthetic Construct
  source 1..26: mol_type = other DNA
ggtagcctctttcactcattgtggta

SEQ ID NO: 15053 - DNA, 22 bp, synthetic construct
  misc_feature 1..22: note = Synthetic Construct
  source 1..22: mol_type = other DNA
gtgttttgctgttctccagcat

SEQ ID NO: 15054 - DNA, 23 bp, synthetic construct
  misc_feature 1..23: note = Synthetic Construct
  source 1..23: mol_type = other DNA
gtgggagaaaagtagcagtggat

SEQ ID NO: 15055 - DNA, 25 bp, synthetic construct
  misc_feature 1..25: note = Synthetic Construct
  source 1..25: mol_type = other DNA
cagagcaggtttgatgatcccgttt

SEQ ID NO: 15056 - DNA, 19 bp, synthetic construct
  misc_feature 1..19: note = Synthetic Construct
  source 1..19: mol_type = other DNA
tggaagacgcctcctcact

SEQ ID NO: 15057 - DNA, 20 bp, synthetic construct
  misc_feature 1..20: note = Synthetic Construct
  source 1..20: mol_type = other DNA
tggctgccttctcccttcat

SEQ ID NO: 15058 - DNA, 20 bp, synthetic construct
  misc_feature 1..20: note = Synthetic Construct
  source 1..20: mol_type = other DNA
tgtactgaccgaggctgtga

SEQ ID NO: 15059 - DNA, 22 bp, synthetic construct
  misc_feature 1..22: note = Synthetic Construct
  source 1..22: mol_type = other DNA
tgcttgcattgccagaactact

SEQ ID NO: 15060 - DNA, 21 bp, synthetic construct
  misc_feature 1..21: note = Synthetic Construct
  source 1..21: mol_type = other DNA
tggccaagtggtcctgcttct

SEQ ID NO: 15061 - DNA, 19 bp, synthetic construct
  misc_feature 1..19: note = Synthetic Construct
  source 1..19: mol_type = other DNA
acctgcctaaggccacact

SEQ ID NO: 15062 - DNA, 20 bp, synthetic construct
  misc_feature 1..20: note = Synthetic Construct
  source 1..20: mol_type = other DNA
gcagcctttggcctcttcta

SEQ ID NO: 15063 - DNA, 20 bp, synthetic construct
  misc_feature 1..20: note = Synthetic Construct
  source 1..20: mol_type = other DNA
cggcaagcctttagcccaat

SEQ ID NO: 15064 - DNA, 21 bp, synthetic construct
  misc_feature 1..21: note = Synthetic Construct
  source 1..21: mol_type = other DNA
ggctctcgtgcccatttcttc

SEQ ID NO: 15065 - DNA, 28 bp, synthetic construct
  misc_feature 1..28: note = Synthetic Construct
  source 1..28: mol_type = other DNA
gcagactcaaggtcacactatttctctt

SEQ ID NO: 15066 - DNA, 22 bp, synthetic construct
  misc_feature 1..22: note = Synthetic Construct
  source 1..22: mol_type = other DNA
atccgggacccaggtgaaaaag

SEQ ID NO: 15067 - DNA, 22 bp, synthetic construct
  misc_feature 1..22: note = Synthetic Construct
  source 1..22: mol_type = other DNA
tcacatgcccattgtgggttag

SEQ ID NO: 15068 - DNA, 23 bp, synthetic construct
  misc_feature 1..23: note = Synthetic Construct
  source 1..23: mol_type = other DNA
cctccagccaccaaattgttgtt

SEQ ID NO: 15069 - DNA, 22 bp, synthetic construct
  misc_feature 1..22: note = Synthetic Construct
  source 1..22: mol_type = other DNA
ggacagacaggcagggagaaaa

SEQ ID NO: 15070 - DNA, 24 bp, synthetic construct
  misc_feature 1..24: note = Synthetic Construct
  source 1..24: mol_type = other DNA
cacacatcccttcctcaaggacat

SEQ ID NO: 15071 - DNA, 24 bp, synthetic construct
  misc_feature 1..24: note = Synthetic Construct
  source 1..24: mol_type = other DNA
cacagacagtgtggaaggcatcta

SEQ ID NO: 15072 - DNA, 19 bp, synthetic construct
  misc_feature 1..19: note = Synthetic Construct
  source 1..19: mol_type = other DNA
cgagctcgggatggggttt

SEQ ID NO: 15073 - DNA, 24 bp, synthetic construct
  misc_feature 1..24: note = Synthetic Construct
  source 1..24: mol_type = other DNA
gctgatgcttagtgtttggacaac

SEQ ID NO: 15074 - DNA, 20 bp, synthetic construct
  misc_feature 1..20: note = Synthetic Construct
  source 1..20: mol_type = other DNA
gccctctgcaaaaccagtga

SEQ ID NO: 15075 - DNA, 25 bp, synthetic construct
  misc_feature 1..25: note = Synthetic Construct
  source 1..25: mol_type = other DNA
aggttcctgtgtatcagaattgctt

SEQ ID NO: 15076 - DNA, 20 bp, synthetic construct
  misc_feature 1..20: note = Synthetic Construct
  source 1..20: mol_type = other DNA
aagcccaccctttcccaact

SEQ ID NO: 15077 - DNA, 25 bp, synthetic construct
  misc_feature 1..25: note = Synthetic Construct
  source 1..25: mol_type = other DNA
ggttgtctggagtcagtatgagaca

SEQ ID NO: 15078 - DNA, 22 bp, synthetic construct
  misc_feature 1..22: note = Synthetic Construct
  source 1..22: mol_type = other DNA
gggatagtcattgtgccctgtt

SEQ ID NO: 15079 - DNA, 22 bp, synthetic construct
  misc_feature 1..22: note = Synthetic Construct
  source 1..22: mol_type = other DNA
caccaaatggctcatccacaga

SEQ ID NO: 15080 - DNA, 24 bp, synthetic construct
  misc_feature 1..24: note = Synthetic Construct
  source 1..24: mol_type = other DNA
cagtaggagggcaaagtcacagaa

SEQ ID NO: 15081 - DNA, 25 bp, synthetic construct
  misc_feature 1..25: note = Synthetic Construct
  source 1..25: mol_type = other DNA
ggagaggcaagagtcaaagctcaaa

SEQ ID NO: 15082 - DNA, 22 bp, synthetic construct
  misc_feature 1..22: note = Synthetic Construct
  source 1..22: mol_type = other DNA
ccttcacgttgcatcgggtatt

SEQ ID NO: 15083 - DNA, 22 bp, synthetic construct
  misc_feature 1..22: note = Synthetic Construct
  source 1..22: mol_type = other DNA
tcagaaggtctctgtgccatga

SEQ ID NO: 15084 - DNA, 21 bp, synthetic construct
  misc_feature 1..21: note = Synthetic Construct
  source 1..21: mol_type = other DNA
accagccagtcccaggttttc

SEQ ID NO: 15085 - DNA, 24 bp, synthetic construct
  misc_feature 1..24: note = Synthetic Construct
  source 1..24: mol_type = other DNA
cctgggtagtgcctttgcccatta

SEQ ID NO: 15086 - DNA, 21 bp, synthetic construct
  misc_feature 1..21: note = Synthetic Construct
  source 1..21: mol_type = other DNA
aaggccccaccatccttcagt

SEQ ID NO: 15087 - DNA, 21 bp, synthetic construct
  misc_feature 1..21: note = Synthetic Construct
  source 1..21: mol_type = other DNA
ggctcatctcagcccatgttc

SEQ ID NO: 15088 - DNA, 22 bp, synthetic construct
  misc_feature 1..22: note = Synthetic Construct
  source 1..22: mol_type = other DNA
ttcacagaccagcctccaggaa

SEQ ID NO: 15089 - DNA, 25 bp, synthetic construct
  misc_feature 1..25: note = Synthetic Construct
  source 1..25: mol_type = other DNA
gcattctccagggcatttgacttag

SEQ ID NO: 15090 - DNA, 23 bp, synthetic construct
  misc_feature 1..23: note = Synthetic Construct
  source 1..23: mol_type = other DNA
ccaccttgtctaccacagagttc

SEQ ID NO: 15091 - DNA, 27 bp, synthetic construct
  misc_feature 1..27: note = Synthetic Construct
  source 1..27: mol_type = other DNA
cacagtcttactagggttcaacaggat

SEQ ID NO: 15092 - DNA, 22 bp, synthetic construct
  misc_feature 1..22: note = Synthetic Construct
  source 1..22: mol_type = other DNA
cgcacttcctcccttttaggtt

SEQ ID NO: 15093 - DNA, 23 bp, synthetic construct
  misc_feature 1..23: note = Synthetic Construct
  source 1..23: mol_type = other DNA
gcctcatatccagagaccagaga

SEQ ID NO: 15094 - DNA, 20 bp, synthetic construct
  misc_feature 1..20: note = Synthetic Construct
  source 1..20: mol_type = other DNA
aggcaaaggagcctccaaca

SEQ ID NO: 15095 - DNA, 22 bp, synthetic construct
  misc_feature 1..22: note = Synthetic Construct
  source 1..22: mol_type = other DNA
gggtgacaacgtgtgctggaat

SEQ ID NO: 15096 - DNA, 22 bp, synthetic construct
  misc_feature 1..22: note = Synthetic Construct
  source 1..22: mol_type = other DNA
gcacatagccctcaaggtcaca

SEQ ID NO: 15097 - DNA, 24 bp, synthetic construct
  misc_feature 1..24: note = Synthetic Construct
  source 1..24: mol_type = other DNA
gaactttttggcctctgactgtct

SEQ ID NO: 15098 - DNA, 20 bp, synthetic construct
  misc_feature 1..20: note = Synthetic Construct
  source 1..20: mol_type = other DNA
tgctggttcacggtgtccaa

SEQ ID NO: 15099 - DNA, 24 bp, synthetic construct
  misc_feature 1..24: note = Synthetic Construct
  source 1..24: mol_type = other DNA
ccagccggtctgtacataggatct

SEQ ID NO: 15100 - DNA, 23 bp, synthetic construct
  misc_feature 1..23: note = Synthetic Construct
  source 1..23: mol_type = other DNA
agcagggagagagactgattcat

SEQ ID NO: 15101 - DNA, 23 bp, synthetic construct
  misc_feature 1..23: note = Synthetic Construct
  source 1..23: mol_type = other DNA
ccccaagtggtcctactgaaatc

SEQ ID NO: 15102 - DNA, 20 bp, synthetic construct
  misc_feature 1..20: note = Synthetic Construct
  source 1..20: mol_type = other DNA
gtggtgaggggaccatggaa

SEQ ID NO: 15103 - DNA, 23 bp, synthetic construct
  misc_feature 1..23: note = Synthetic Construct
  source 1..23: mol_type = other DNA
gctcattccttcagctggtgtgt

SEQ ID NO: 15104 - DNA, 25 bp, synthetic construct
  misc_feature 1..25: note = Synthetic Construct
  source 1..25: mol_type = other DNA
ggcaaggaatctgaaaacaggacta

SEQ ID NO: 15105 - DNA, 20 bp, synthetic construct
  misc_feature 1..20: note = Synthetic Construct
  source 1..20: mol_type = other DNA
aggtcgtcggctttgactgt

SEQ ID NO: 15106 - DNA, 19 bp, synthetic construct
  misc_feature 1..19: note = Synthetic Construct
  source 1..19: mol_type = other DNA
gcctgccgtgggtcattgt

SEQ ID NO: 15107 - DNA, 22 bp, synthetic construct
  misc_feature 1..22: note = Synthetic Construct
  source 1..22: mol_type = other DNA
tggggtttcgggatggtcaaac

SEQ ID NO: 15108 - DNA, 22 bp, synthetic construct
  misc_feature 1..22: note = Synthetic Construct
  source 1..22: mol_type = other DNA
cagggtttggctcttgccttca

SEQ ID NO: 15109 - DNA, 23 bp, synthetic construct
  misc_feature 1..23: note = Synthetic Construct
  source 1..23: mol_type = other DNA
tggatgtgcgataagtccatgtt

SEQ ID NO: 15110 - DNA, 24 bp, synthetic construct
  misc_feature 1..24: note = Synthetic Construct
  source 1..24: mol_type = other DNA
gcgtccaaatgaccttgaatttgt

SEQ ID NO: 15111 - DNA, 23 bp, synthetic construct
  misc_feature 1..23: note = Synthetic Construct
  source 1..23: mol_type = other DNA
gccaatgtggcagcataccatct

SEQ ID NO: 15112 - DNA, 20 bp, synthetic construct
  misc_feature 1..20: note = Synthetic Construct
  source 1..20: mol_type = other DNA
ggtgcaaactgcggcaaatc

SEQ ID NO: 15113 - DNA, 22 bp, synthetic construct
  misc_feature 1..22: note = Synthetic Construct
  source 1..22: mol_type = other DNA
ggaaatggtccctgtcgtgcat

SEQ ID NO: 15114 - DNA, 22 bp, synthetic construct
  misc_feature 1..22: note = Synthetic Construct
  source 1..22: mol_type = other DNA
acacagtccagtggctccatgt

SEQ ID NO: 15115 - DNA, 20 bp, synthetic construct
  misc_feature 1..20: note = Synthetic Construct
  source 1..20: mol_type = other DNA
aggcccaagggctgctaaac

SEQ ID NO: 15116 - DNA, 24 bp, synthetic construct
  misc_feature 1..24: note = Synthetic Construct
  source 1..24: mol_type = other DNA
ggatggagacttggctggttctca

SEQ ID NO: 15117 - DNA, 23 bp, synthetic construct
  misc_feature 1..23: note = Synthetic Construct
  source 1..23: mol_type = other DNA
cccacatccaggacctaccatct

SEQ ID NO: 15118 - DNA, 21 bp, synthetic construct
  misc_feature 1..21: note = Synthetic Construct
  source 1..21: mol_type = other DNA
ggagttcgcgtggactcacaa

SEQ ID NO: 15119 - DNA, 24 bp, synthetic construct
  misc_feature 1..24: note = Synthetic Construct
  source 1..24: mol_type = other DNA
ctgtggtagcaatgggaagactga

SEQ ID NO: 15120 - DNA, 22 bp, synthetic construct
  misc_feature 1..22: note = Synthetic Construct
  source 1..22: mol_type = other DNA
cttgcattcctgggcctcagtt

SEQ ID NO: 15121 - DNA, 20 bp, synthetic construct
  misc_feature 1..20: note = Synthetic Construct
  source 1..20: mol_type = other DNA
acactcaggcacccaacagt

SEQ ID NO: 15122 - DNA, 22 bp, synthetic construct
  misc_feature 1..22: note = Synthetic Construct
  source 1..22: mol_type = other DNA
gtactcccgtggccttcagaac

SEQ ID NO: 15123 - DNA, 20 bp, synthetic construct
  misc_feature 1..20: note = Synthetic Construct
  source 1..20: mol_type = other DNA
actggcccagcaggcacatc

SEQ ID NO: 15124 - DNA, 20 bp, synthetic construct
  misc_feature 1..20: note = Synthetic Construct
  source 1..20: mol_type = other DNA
gtgcgctttgcagggatttg

SEQ ID NO: 15125 - DNA, 21 bp, synthetic construct
  misc_feature 1..21: note = Synthetic Construct
  source 1..21: mol_type = other DNA
tgagctggtgccagaggtttg

SEQ ID NO: 15126 - DNA, 19 bp, synthetic construct
  misc_feature 1..19: note = Synthetic Construct
  source 1..19: mol_type = other DNA
tggggcccacagccttgaa

SEQ ID NO: 15127 - DNA, 21 bp, synthetic construct
  misc_feature 1..21: note = Synthetic Construct
  source 1..21: mol_type = other DNA
gggaagtgactggcccaatgt

SEQ ID NO: 15128 - DNA, 22 bp, synthetic construct
  misc_feature 1..22: note = Synthetic Construct
  source 1..22: mol_type = other DNA
tcaagggaggctgggagacaaa

SEQ ID NO: 15129 - DNA, 21 bp, synthetic construct
  misc_feature 1..21: note = Synthetic Construct
  source 1..21: mol_type = other DNA
tacctgcacagctccggacaa

SEQ ID NO: 15130 - DNA, 21 bp, synthetic construct
  misc_feature 1..21: note = Synthetic Construct
  source 1..21: mol_type = other DNA
gcagggactgtgggaagtttg

SEQ ID NO: 15131 - DNA, 20 bp, synthetic construct
  misc_feature 1..20: note = Synthetic Construct
  source 1..20: mol_type = other DNA
gtcaggtgaaaggcgggatt

SEQ ID NO: 15132 - DNA, 22 bp, synthetic construct
  misc_feature 1..22: note = Synthetic Construct
  source 1..22: mol_type = other DNA
ccacacagaccctgaagacaca

SEQ ID NO: 15133 - DNA, 25 bp, synthetic construct
  misc_feature 1..25: note = Synthetic Construct
  source 1..25: mol_type = other DNA
gggtgctctttctggactgagtttc

SEQ ID NO: 15134 - DNA, 25 bp, synthetic construct
  misc_feature 1..25: note = Synthetic Construct
  source 1..25: mol_type = other DNA
gctggatggagagagatgagagtaa

SEQ ID NO: 15135 - DNA, 24 bp, synthetic construct
  misc_feature 1..24: note = Synthetic Construct
  source 1..24: mol_type = other DNA
aacataatccgcttgcctagaact

SEQ ID NO: 15136 - DNA, 20 bp, synthetic construct
  misc_feature 1..20: note = Synthetic Construct
  source 1..20: mol_type = other DNA
ctggtcactggcacacttct

SEQ ID NO: 15137 - DNA, 26 bp, synthetic construct
  misc_feature 1..26: note = Synthetic Construct
  source 1..26: mol_type = other DNA
cactgtcacagagagttgggtcatac

SEQ ID NO: 15138 - DNA, 22 bp, synthetic construct
  misc_feature 1..22: note = Synthetic Construct
  source 1..22: mol_type = other DNA
ggctttccaggttcccaagaca

SEQ ID NO: 15139 - DNA, 21 bp, synthetic construct
  misc_feature 1..21: note = Synthetic Construct
  source 1..21: mol_type = other DNA
gctgaggtgcttcttctccat

SEQ ID NO: 15140 - DNA, 22 bp, synthetic construct
  misc_feature 1..22: note = Synthetic Construct
  source 1..22: mol_type = other DNA
gagggaagcaaagagcccttga

SEQ ID NO: 15141 - DNA, 18 bp, synthetic construct
  misc_feature 1..18: note = Synthetic Construct
  source 1..18: mol_type = other DNA
aagccctgccccttcaga

SEQ ID NO: 15142 - DNA, 24 bp, synthetic construct
  misc_feature 1..24: note = Synthetic Construct
  source 1..24: mol_type = other DNA
gttccaggagaccataccttcctt

SEQ ID NO: 15143 - DNA, 21 bp, synthetic construct
  misc_feature 1..21: note = Synthetic Construct
  source 1..21: mol_type = other DNA
ggcctgctgagtagctgcaat

SEQ ID NO: 15144 - DNA, 20 bp, synthetic construct
  misc_feature 1..20: note = Synthetic Construct
  source 1..20: mol_type = other DNA
tggctcacactggacctgat

SEQ ID NO: 15145 - DNA, 20 bp, synthetic construct
  misc_feature 1..20: note = Synthetic Construct
  source 1..20: mol_type = other DNA
caggctgcaagttggcttca

SEQ ID NO: 15146 - DNA, 20 bp, synthetic construct
  misc_feature 1..20: note = Synthetic Construct
  source 1..20: mol_type = other DNA
tcgagttgggagggtgagtt

SEQ ID NO: 15147 - DNA, 21 bp, synthetic construct
  misc_feature 1..21: note = Synthetic Construct
  source 1..21: mol_type = other DNA
ctgcaagctcaccgcattttc

SEQ ID NO: 15148 - DNA, 20 bp, synthetic construct
  misc_feature 1..20: note = Synthetic Construct
  source 1..20: mol_type = other DNA
atggccacaccctggcattt

SEQ ID NO: 15149 - DNA, 22 bp, synthetic construct
  misc_feature 1..22: note = Synthetic Construct
  source 1..22: mol_type = other DNA
gtgaggaaagcaggcactcact

SEQ ID NO: 15150 - DNA, 23 bp, synthetic construct
  misc_feature 1..23: note = Synthetic Construct
  source 1..23: mol_type = other DNA
gcttagtggcctcattgctgtat

SEQ ID NO: 15151 - DNA, 22 bp, synthetic construct
  misc_feature 1..22: note = Synthetic Construct
  source 1..22: mol_type = other DNA
gtctgtgatccctcgcgtttca

SEQ ID NO: 15152 - DNA, 22 bp, synthetic construct
  misc_feature 1..22: note = Synthetic Construct
  source 1..22: mol_type = other DNA
ccacctcgaaagagggtacaga

SEQ ID NO: 15153 - DNA, 20 bp, synthetic construct
  misc_feature 1..20: note = Synthetic Construct
  source 1..20: mol_type = other DNA
agagcaaaggctctggcatt

SEQ ID NO: 15154 - DNA, 24 bp, synthetic construct
  misc_feature 1..24: note = Synthetic Construct
  source 1..24: mol_type = other DNA
gattggagggactgagaccagaga

SEQ ID NO: 15155 - DNA, 20 bp, synthetic construct
  misc_feature 1..20: note = Synthetic Construct
  source 1..20: mol_type = other DNA
tggatgggacacgaccttga

SEQ ID NO: 15156 - DNA, 25 bp, synthetic construct
  misc_feature 1..25: note = Synthetic Construct
  source 1..25: mol_type = other DNA
agtctgacattagacaggggataca

SEQ ID NO: 15157 - DNA, 22 bp, synthetic construct
  misc_feature 1..22: note = Synthetic Construct
  source 1..22: mol_type = other DNA
ccagggaccagtaggaagcaat

SEQ ID NO: 15158 - DNA, 22 bp, synthetic construct
  misc_feature 1..22: note = Synthetic Construct
  source 1..22: mol_type = other DNA
gaaagcaaccacgttgtgttca

SEQ ID NO: 15159 - DNA, 22 bp, synthetic construct
  misc_feature 1..22: note = Synthetic Construct
  source 1..22: mol_type = other DNA
caaatggctctgcccagctcta

SEQ ID NO: 15160 - DNA, 24 bp, synthetic construct
  misc_feature 1..24: note = Synthetic Construct
  source 1..24: mol_type = other DNA
cacgtcagcatagcgcttttaact

SEQ ID NO: 15161 - DNA, 22 bp, synthetic construct
  misc_feature 1..22: note = Synthetic Construct
  source 1..22: mol_type = other DNA
ggcaatgtggccatcaggtttg

SEQ ID NO: 15162 - DNA, 22 bp, synthetic construct
  misc_feature 1..22: note = Synthetic Construct
  source 1..22: mol_type = other DNA
gttagaaggggaaggggtccaa

SEQ ID NO: 15163 - DNA, 25 bp, synthetic construct
  misc_feature 1..25: note = Synthetic Construct
  source 1..25: mol_type = other DNA
cacatggaggcatagttaccaggaa

SEQ ID NO: 15164 - DNA, 21 bp, synthetic construct
  misc_feature 1..21: note = Synthetic Construct
  source 1..21: mol_type = other DNA
cgccctagcttcacagagctt

SEQ ID NO: 15165 - DNA, 22 bp, synthetic construct
  misc_feature 1..22: note = Synthetic Construct
  source 1..22: mol_type = other DNA
tggactgtcccagaccttgaat

SEQ ID NO: 15166 - DNA, 25 bp, synthetic construct
  misc_feature 1..25: note = Synthetic Construct
  source 1..25: mol_type = other DNA
caagtctgtgaactactggttcgtt

SEQ ID NO: 15167 - DNA, 24 bp, synthetic construct
  misc_feature 1..24: note = Synthetic Construct
  source 1..24: mol_type = other DNA
caatagcaccgataaggcaaccta

SEQ ID NO: 15168 - DNA, 23 bp, synthetic construct
  misc_feature 1..23: note = Synthetic Construct
  source 1..23: mol_type = other DNA
cccaatttggtctctccaacagt

SEQ ID NO: 15169 - DNA, 22 bp, synthetic construct
  misc_feature 1..22: note = Synthetic Construct
  source 1..22: mol_type = other DNA
cctcgtctctctctgacaggta

SEQ ID NO: 15170 - DNA, 22 bp, synthetic construct
  misc_feature 1..22: note = Synthetic Construct
  source 1..22: mol_type = other DNA
agagactgaggcagggccataa

SEQ ID NO: 15171 - DNA, 30 bp, synthetic construct
  misc_feature 1..30: note = Synthetic Construct
  source 1..30: mol_type = other DNA
ggtccggatagtaaatagagatgagtaaca

SEQ ID NO: 15172 - DNA, 23 bp, synthetic construct
  misc_feature 1..23: note = Synthetic Construct
  source 1..23: mol_type = other DNA
gcacaactgtttgcactatcctt

SEQ ID NO: 15173 - DNA, 24 bp, synthetic construct
  misc_feature 1..24: note = Synthetic Construct
  source 1..24: mol_type = other DNA
gcttactaaagagcccttgggaat

SEQ ID NO: 15174 - DNA, 22 bp, synthetic construct
  misc_feature 1..22: note = Synthetic Construct
  source 1..22: mol_type = other DNA
tgaggccagcacctctcgtaat

SEQ ID NO: 15175 - DNA, 24 bp, synthetic construct
  misc_feature 1..24: note = Synthetic Construct
  source 1..24: mol_type = other DNA
gggtgatccgggagtgctaataac

SEQ ID NO: 15176 - DNA, 23 bp, synthetic construct
  misc_feature 1..23: note = Synthetic Construct
  source 1..23: mol_type = other DNA
gggtgagggacaaggacagaaga

SEQ ID NO: 15177 - DNA, 23 bp, synthetic construct
  misc_feature 1..23: note = Synthetic Construct
  source 1..23: mol_type = other DNA
gtccctaaagctttccgccaaca

SEQ ID NO: 15178 - DNA, 20 bp, synthetic construct
  misc_feature 1..20: note = Synthetic Construct
  source 1..20: mol_type = other DNA
ggggtggggagaggcaagta

SEQ ID NO: 15179 - DNA, 24 bp, synthetic construct
  misc_feature 1..24: note = Synthetic Construct
  source 1..24: mol_type = other DNA
gcagagcccagaatcattcgtcta

SEQ ID NO: 15180 - DNA, 26 bp, synthetic construct
  misc_feature 1..26: note = Synthetic Construct
  source 1..26: mol_type = other DNA
caggtgacgttttcagtttggagaca

SEQ ID NO: 15181 - DNA, 22 bp, synthetic construct
  misc_feature 1..22: note = Synthetic Construct
  source 1..22: mol_type = other DNA
ccatgcccacctctaagagaca

SEQ ID NO: 15182 - DNA, 21 bp, synthetic construct
  misc_feature 1..21: note = Synthetic Construct
  source 1..21: mol_type = other DNA
gtacacagggcaccaggtcat

SEQ ID NO: 15183 - DNA, 25 bp, synthetic construct
  misc_feature 1..25: note = Synthetic Construct
  source 1..25: mol_type = other DNA
gtgtgcaaaaggagggtgaaagtga

SEQ ID NO: 15184 - DNA, 22 bp, synthetic construct
  misc_feature 1..22: note = Synthetic Construct
  source 1..22: mol_type = other DNA
gctgatctcagtggctcaaact

SEQ ID NO: 15185 - DNA, 26 bp, synthetic construct
  misc_feature 1..26: note = Synthetic Construct
  source 1..26: mol_type = other DNA
ggtgggcaagtaatttacaggggaaa

SEQ ID NO: 15186 - DNA, 24 bp, synthetic construct
  misc_feature 1..24: note = Synthetic Construct
  source 1..24: mol_type = other DNA
cagagctcagtgctagacatggat

SEQ ID NO: 15187 - DNA, 22 bp, synthetic construct
  misc_feature 1..22: note = Synthetic Construct
  source 1..22: mol_type = other DNA
ttgggacatgggacagctccta

SEQ ID NO: 15188 - DNA, 23 bp, synthetic construct
  misc_feature 1..23: note = Synthetic Construct
  source 1..23: mol_type = other DNA
ctgcaccagttcaaggcaagtct

SEQ ID NO: 15189 - DNA, 27 bp, synthetic construct
  misc_feature 1..27: note = Synthetic Construct
  source 1..27: mol_type = other DNA
gccccatagatccaaagcatagtgtaa

SEQ ID NO: 15190 - DNA, 24 bp, synthetic construct
  misc_feature 1..24: note = Synthetic Construct
  source 1..24: mol_type = other DNA
ggttgggttgagaagtgcctcaga

SEQ ID NO: 15191 - DNA, 23 bp, synthetic construct
  misc_feature 1..23: note = Synthetic Construct
  source 1..23: mol_type = other DNA
ccccgaaggatctcgttaaaaca

SEQ ID NO: 15192 - DNA, 22 bp, synthetic construct
  misc_feature 1..22: note = Synthetic Construct
  source 1..22: mol_type = other DNA
ccaactggcattcctgcctcta

SEQ ID NO: 15193 - DNA, 26 bp, synthetic construct
  misc_feature 1..26: note = Synthetic Construct
  source 1..26: mol_type = other DNA
ggcgatcatctttaactactccttct

SEQ ID NO: 15194 - DNA, 21 bp, synthetic construct
  misc_feature 1..21: note = Synthetic Construct
  source 1..21: mol_type = other DNA
cagaatgggtggggcaagaca

SEQ ID NO: 15195 - DNA, 20 bp, synthetic construct
  misc_feature 1..20: note = Synthetic Construct
  source 1..20: mol_type = other DNA
agggagcctcaagtgcatca

SEQ ID NO: 15196 - DNA, 25 bp, synthetic construct
  misc_feature 1..25: note = Synthetic Construct
  source 1..25: mol_type = other DNA
aagctctttccacttcaggatcttt

SEQ ID NO: 15197 - DNA, 22 bp, synthetic construct
  misc_feature 1..22: note = Synthetic Construct
  source 1..22: mol_type = other DNA
tccccagaagtggtaacaggta

SEQ ID NO: 15198 - DNA, 20 bp, synthetic construct
  misc_feature 1..20: note = Synthetic Construct
  source 1..20: mol_type = other DNA
agctagcagggctgatgcaa

SEQ ID NO: 15199 - DNA, 25 bp, synthetic construct
  misc_feature 1..25: note = Synthetic Construct
  source 1..25: mol_type = other DNA
gtctcaccttttccacccttgaatg

SEQ ID NO: 15200 - DNA, 20 bp, synthetic construct
  misc_feature 1..20: note = Synthetic Construct
  source 1..20: mol_type = other DNA
cagaccacagagcccgaagt

SEQ ID NO: 15201 - DNA, 24 bp, synthetic construct
  misc_feature 1..24: note = Synthetic Construct
  source 1..24: mol_type = other DNA
tgcagtagttgaggtgaatggttt

SEQ ID NO: 15202 - DNA, 23 bp, synthetic construct
  misc_feature 1..23: note = Synthetic Construct
  source 1..23: mol_type = other DNA
gaggaaaagcagccagacataca

SEQ ID NO: 15203 - DNA, 22 bp, synthetic construct
  misc_feature 1..22: note = Synthetic Construct
  source 1..22: mol_type = other DNA
gtggaagatggactggccttgt

SEQ ID NO: 15204 - DNA, 24 bp, synthetic construct
  misc_feature 1..24: note = Synthetic Construct
  source 1..24: mol_type = other DNA
gaacccaatctgtctaccttgtca

SEQ ID NO: 15205 - DNA, 20 bp, synthetic construct
  misc_feature 1..20: note = Synthetic Construct
  source 1..20: mol_type = other DNA
acaaggcgcccaagtgatct

SEQ ID NO: 15206 - DNA, 23 bp, synthetic construct
  misc_feature 1..23: note = Synthetic Construct
  source 1..23: mol_type = other DNA
cgttcagttgccatctgctgttc

SEQ ID NO: 15207 - DNA, 21 bp, synthetic construct
  misc_feature 1..21: note = Synthetic Construct
  source 1..21: mol_type = other DNA
caccgagccatccctgagttc

SEQ ID NO: 15208 - DNA, 22 bp, synthetic construct
  misc_feature 1..22: note = Synthetic Construct
  source 1..22: mol_type = other DNA
gggtgcccactcagggttattc

SEQ ID NO: 15209 - DNA, 20 bp, synthetic construct
  misc_feature 1..20: note = Synthetic Construct
  source 1..20: mol_type = other DNA
atgtggcccagaacccacaa

SEQ ID NO: 15210 - DNA, 25 bp, synthetic construct
  misc_feature 1..25: note = Synthetic Construct
  source 1..25: mol_type = other DNA
cgatcccactttgaggtgaacttga

SEQ ID NO: 15211 - DNA, 24 bp, synthetic construct
  misc_feature 1..24: note = Synthetic Construct
  source 1..24: mol_type = other DNA
cctggttgtctctgtcccaagtca

SEQ ID NO: 15212 - DNA, 20 bp, synthetic construct
  misc_feature 1..20: note = Synthetic Construct
  source 1..20: mol_type = other DNA
cccttgcagggatccagatg

SEQ ID NO: 15213 - DNA, 23 bp, synthetic construct
  misc_feature 1..23: note = Synthetic Construct
  source 1..23: mol_type = other DNA
ggctacctccaaccatcatcttg

SEQ ID NO: 15214 - DNA, 22 bp, synthetic construct
  misc_feature 1..22: note = Synthetic Construct
  source 1..22: mol_type = other DNA
acataggtggtagccaggaagt

SEQ ID NO: 15215 - DNA, 23 bp, synthetic construct
  misc_feature 1..23: note = Synthetic Construct
  source 1..23: mol_type = other DNA
aaagaagtctgaccatgccttga

SEQ ID NO: 15216 - DNA, 20 bp, synthetic construct
  misc_feature 1..20: note = Synthetic Construct
  source 1..20: mol_type = other DNA
cccaggccagcttgttctct

SEQ ID NO: 15217 - DNA, 24 bp, synthetic construct
  misc_feature 1..24: note = Synthetic Construct
  source 1..24: mol_type = other DNA
gtgtaagggtgagtctttcagcaa

SEQ ID NO: 15218 - DNA, 21 bp, synthetic construct
  misc_feature 1..21: note = Synthetic Construct
  source 1..21: mol_type = other DNA
ccaaaacaggcagccacaaga

SEQ ID NO: 15219 - DNA, 22 bp, synthetic construct
  misc_feature 1..22: note = Synthetic Construct
  source 1..22: mol_type = other DNA
ccctttcatctccccagccatt

SEQ ID NO: 15220 - DNA, 22 bp, synthetic construct
  misc_feature 1..22: note = Synthetic Construct
  source 1..22: mol_type = other DNA
attccttccctcctggggtcta

SEQ ID NO: 15221 - DNA, 25 bp, synthetic construct
  misc_feature 1..25: note = Synthetic Construct
  source 1..25: mol_type = other DNA
gagcccaagtttcttcacttggaaa

SEQ ID NO: 15222 - DNA, 22 bp, synthetic construct
  misc_feature 1..22: note = Synthetic Construct
  source 1..22: mol_type = other DNA
gggccatcagtgagctttcttc

SEQ ID NO: 15223 - DNA, 24 bp, synthetic construct
  misc_feature 1..24: note = Synthetic Construct
  source 1..24: mol_type = other DNA
ggatctccactgttgcctagaatg

SEQ ID NO: 15224 - DNA, 21 bp, synthetic construct
  misc_feature 1..21: note = Synthetic Construct
  source 1..21: mol_type = other DNA
ggtggttctgtgggtttctgt

SEQ ID NO: 15225 - DNA, 24 bp, synthetic construct
  misc_feature 1..24: note = Synthetic Construct
  source 1..24: mol_type = other DNA
ggggtactttcagctctctctagt

SEQ ID NO: 15226 - DNA, 19 bp, synthetic construct
  misc_feature 1..19: note = Synthetic Construct
  source 1..19: mol_type = other DNA
agcagcagcggaagcacat

SEQ ID NO: 15227 - DNA, 21 bp, synthetic construct
  misc_feature 1..21: note = Synthetic Construct
  source 1..21: mol_type = other DNA
aggaacacagaggaggagcaa

SEQ ID NO: 15228 - DNA, 23 bp, synthetic construct
  misc_feature 1..23: note = Synthetic Construct
  source 1..23: mol_type = other DNA
gtaaccactccctggctacttct

SEQ ID NO: 15229 - DNA, 26 bp, synthetic construct
  misc_feature 1..26: note = Synthetic Construct
  source 1..26: mol_type = other DNA
ggactgcagaaaatgttacaggtctt

SEQ ID NO: 15230 - DNA, 25 bp, synthetic construct
  misc_feature 1..25: note = Synthetic Construct
  source 1..25: mol_type = other DNA
cttctcattggaatcttggctcctt

SEQ ID NO: 15231 - DNA, 22 bp, synthetic construct
  misc_feature 1..22: note = Synthetic Construct
  source 1..22: mol_type = other DNA
aggcatcctggaagcaatcaag

SEQ ID NO: 15232 - DNA, 24 bp, synthetic construct
  misc_feature 1..24: note = Synthetic Construct
  source 1..24: mol_type = other DNA
ggccagtgtgtcaaaagaagacta

SEQ ID NO: 15233 - DNA, 24 bp, synthetic construct
  misc_feature 1..24: note = Synthetic Construct
  source 1..24: mol_type = other DNA
gcctacgaggtacagctcaggata

SEQ ID NO: 15234 - DNA, 24 bp, synthetic construct
  misc_feature 1..24: note = Synthetic Construct
  source 1..24: mol_type = other DNA
ctcttcaagttggaagggatgaga

SEQ ID NO: 15235 - DNA, 23 bp, synthetic construct
  misc_feature 1..23: note = Synthetic Construct
  source 1..23: mol_type = other DNA
gctacagtggcagagtcgagtag

SEQ ID NO: 15236 - DNA, 23 bp, synthetic construct
  misc_feature 1..23: note = Synthetic Construct
  source 1..23: mol_type = other DNA
gaggaaagcagagcgaagagtga

SEQ ID NO: 15237 - DNA, 21 bp, synthetic construct
  misc_feature 1..21: note = Synthetic Construct
  source 1..21: mol_type = other DNA
ggtggaagaggcagacaccat

SEQ ID NO: 15238 - DNA, 20 bp, synthetic construct
  misc_feature 1..20: note = Synthetic Construct
  source 1..20: mol_type = other DNA
acggtccatcgcttgcatct

SEQ ID NO: 15239 - DNA, 23 bp, synthetic construct
  misc_feature 1..23: note = Synthetic Construct
  source 1..23: mol_type = other DNA
agaagcatctgaagtgccttgtt

SEQ ID NO: 15240 - DNA, 22 bp, synthetic construct
  misc_feature 1..22: note = Synthetic Construct
  source 1..22: mol_type = other DNA
cgggccagggaaagaaaagatg

SEQ ID NO: 15241 - DNA, 19 bp, synthetic construct
  misc_feature 1..19: note = Synthetic Construct
  source 1..19: mol_type = other DNA
tccacagggcctggtacat

SEQ ID NO: 15242 - DNA, 22 bp, synthetic construct
  misc_feature 1..22: note = Synthetic Construct
  source 1..22: mol_type = other DNA
cctcacccagatccagcaccta

SEQ ID NO: 15243 - DNA, 27 bp, synthetic construct
  misc_feature 1..27: note = Synthetic Construct
  source 1..27: mol_type = other DNA
ccacaggtggttcagatagactctaca

SEQ ID NO: 15244 - DNA, 23 bp, synthetic construct
  misc_feature 1..23: note = Synthetic Construct
  source 1..23: mol_type = other DNA
tggaggaattccactgcttcatt

SEQ ID NO: 15245 - DNA, 21 bp, synthetic construct
  misc_feature 1..21: note = Synthetic Construct
  source 1..21: mol_type = other DNA
tgggaaggcagaggcagttct

SEQ ID NO: 15246 - DNA, 23 bp, synthetic construct
  misc_feature 1..23: note = Synthetic Construct
  source 1..23: mol_type = other DNA
cacttcagggatcagccaattca

SEQ ID NO: 15247 - DNA, 27 bp, synthetic construct
  misc_feature 1..27: note = Synthetic Construct
  source 1..27: mol_type = other DNA
cctggataggtagcagacaagtactaa

SEQ ID NO: 15248 - DNA, 21 bp, synthetic construct
  misc_feature 1..21: note = Synthetic Construct
  source 1..21: mol_type = other DNA
agggaggcagaggaagcaaag

SEQ ID NO: 15249 - DNA, 19 bp, synthetic construct
  misc_feature 1..19: note = Synthetic Construct
  source 1..19: mol_type = other DNA
cccctcccctgtgcttaca

SEQ ID NO: 15250 - DNA, 21 bp, synthetic construct
  misc_feature 1..21: note = Synthetic Construct
  source 1..21: mol_type = other DNA
ccaaagctgttccggttcttg

SEQ ID NO: 15251 - DNA, 23 bp, synthetic construct
  misc_feature 1..23: note = Synthetic Construct
  source 1..23: mol_type = other DNA
atgcttcttgcctaccttgtctt

SEQ ID NO: 15252 - DNA, 20 bp, synthetic construct
  misc_feature 1..20: note = Synthetic Construct
  source 1..20: mol_type = other DNA
tgaggtgggccaagttcaga

SEQ ID NO: 15253 - DNA, 25 bp, synthetic construct
  misc_feature 1..25: note = Synthetic Construct
  source 1..25: mol_type = other DNA
gactggggattagctatggtgtcta

SEQ ID NO: 15254 - DNA, 20 bp, synthetic construct
  misc_feature 1..20: note = Synthetic Construct
  source 1..20: mol_type = other DNA
tggtgggagggatccgcata

SEQ ID NO: 15255 - DNA, 21 bp, synthetic construct
  misc_feature 1..21: note = Synthetic Construct
  source 1..21: mol_type = other DNA
gttgcctcaaagccacacttg

SEQ ID NO: 15256 - DNA, 23 bp, synthetic construct
  misc_feature 1..23: note = Synthetic Construct
  source 1..23: mol_type = other DNA
ccctgaggttcattgagcacttt

SEQ ID NO: 15257 - DNA, 21 bp, synthetic construct
  misc_feature 1..21: note = Synthetic Construct
  source 1..21: mol_type = other DNA
ggtgacaaacccagcccaaca

SEQ ID NO: 15258 - DNA, 25 bp, synthetic construct
  misc_feature 1..25: note = Synthetic Construct
  source 1..25: mol_type = other DNA
acgtacatctaagccagtgtgtaag

SEQ ID NO: 15259 - DNA, 20 bp, synthetic construct
  misc_feature 1..20: note = Synthetic Construct
  source 1..20: mol_type = other DNA
gcagccacacaaggagtctt

SEQ ID NO: 15260 - DNA, 24 bp, synthetic construct
  misc_feature 1..24: note = Synthetic Construct
  source 1..24: mol_type = other DNA
ccacgcgtctaaacactaccttgt

SEQ ID NO: 15261 - DNA, 23 bp, synthetic construct
  misc_feature 1..23: note = Synthetic Construct
  source 1..23: mol_type = other DNA
gggtggaacaggaataccaagaa

SEQ ID NO: 15262 - DNA, 21 bp, synthetic construct
  misc_feature 1..21: note = Synthetic Construct
  source 1..21: mol_type = other DNA
agaactggagttggggcacta

SEQ ID NO: 15263 - DNA, 23 bp, synthetic construct
  misc_feature 1..23: note = Synthetic Construct
  source 1..23: mol_type = other DNA
cacaaataagcacagcggggaat

SEQ ID NO: 15264 - DNA, 20 bp, synthetic construct
  misc_feature 1..20: note = Synthetic Construct
  source 1..20: mol_type = other DNA
acgcgcctccagctacattt

SEQ ID NO: 15265 - DNA, 24 bp, synthetic construct
  misc_feature 1..24: note = Synthetic Construct
  source 1..24: mol_type = other DNA
ccaaaacagctggctaccctattc

SEQ ID NO: 15266 - DNA, 20 bp, synthetic construct
  misc_feature 1..20: note = Synthetic Construct
  source 1..20: mol_type = other DNA
accccaagtagccaccattg

SEQ ID NO: 15267 - DNA, 22 bp, synthetic construct
  misc_feature 1..22: note = Synthetic Construct
  source 1..22: mol_type = other DNA
agagcaggagtctctgatgcaa

SEQ ID NO: 15268 - DNA, 22 bp, synthetic construct
  misc_feature 1..22: note = Synthetic Construct
  source 1..22: mol_type = other DNA
caggcgaaaggctcacaggtta

SEQ ID NO: 15269 - DNA, 23 bp, synthetic construct
  misc_feature 1..23: note = Synthetic Construct
  source 1..23: mol_type = other DNA
gggcttagcagctcttggttttg

SEQ ID NO: 15270 - DNA, 20 bp, synthetic construct
  misc_feature 1..20: note = Synthetic Construct
  source 1..20: mol_type = other DNA
ccctttagccttggcactgt

SEQ ID NO: 15271 - DNA, 21 bp, synthetic construct
  misc_feature 1..21: note = Synthetic Construct
  source 1..21: mol_type = other DNA
gggaagatgatggtgcaggaa

SEQ ID NO: 15272 - DNA, 22 bp, synthetic construct
  misc_feature 1..22: note = Synthetic Construct
  source 1..22: mol_type = other DNA
tcctcacagagcctatctgcat

SEQ ID NO: 15273 - DNA, 21 bp, synthetic construct
  misc_feature 1..21: note = Synthetic Construct
  source 1..21: mol_type = other DNA
tgaaggtcccttccagccatt

SEQ ID NO: 15274 - DNA, 19 bp, synthetic construct
  misc_feature 1..19: note = Synthetic Construct
  source 1..19: mol_type = other DNA
tctcacagctggcctggta

SEQ ID NO: 15275 - DNA, 20 bp, synthetic construct
  misc_feature 1..20: note = Synthetic Construct
  source 1..20: mol_type = other DNA
ggaggcggtgaagcattcta

SEQ ID NO: 15276 - DNA, 23 bp, synthetic construct
  misc_feature 1..23: note = Synthetic Construct
  source 1..23: mol_type = other DNA
cctctacaactgcactgatcaca

SEQ ID NO: 15277 - DNA, 24 bp, synthetic construct
  misc_feature 1..24: note = Synthetic Construct
  source 1..24: mol_type = other DNA
ccatgcacgatttctatggtcaag

SEQ ID NO: 15278 - DNA, 21 bp, synthetic construct
  misc_feature 1..21: note = Synthetic Construct
  source 1..21: mol_type = other DNA
gggtggcaatagcccttggat

SEQ ID NO: 15279 - DNA, 22 bp, synthetic construct
  misc_feature 1..22: note = Synthetic Construct
  source 1..22: mol_type = other DNA
cgcaatgatagccatgggaaga

SEQ ID NO: 15280 - DNA, 20 bp, synthetic construct
  misc_feature 1..20: note = Synthetic Construct
  source 1..20: mol_type = other DNA
aaagtccccgaaggcaggta

SEQ ID NO: 15281 - DNA, 24 bp, synthetic construct
  misc_feature 1..24: note = Synthetic Construct
  source 1..24: mol_type = other DNA
ggtcttgctgggtactatcaccat

SEQ ID NO: 15282 - DNA, 24 bp, synthetic construct
  misc_feature 1..24: note = Synthetic Construct
  source 1..24: mol_type = other DNA
ccgcacttgaagtatgaggctgaa

SEQ ID NO: 15283 - DNA, 22 bp, synthetic construct
  misc_feature 1..22: note = Synthetic Construct
  source 1..22: mol_type = other DNA
acagggcattgcttcagcttag

SEQ ID NO: 15284 - DNA, 21 bp, synthetic construct
  misc_feature 1..21: note = Synthetic Construct
  source 1..21: mol_type = other DNA
tggtccagcccctttcagact

SEQ ID NO: 15285 - DNA, 24 bp, synthetic construct
  misc_feature 1..24: note = Synthetic Construct
  source 1..24: mol_type = other DNA
gtcagctaacaactgacggtgtct

SEQ ID NO: 15286 - DNA, 22 bp, synthetic construct
  misc_feature 1..22: note = Synthetic Construct
  source 1..22: mol_type = other DNA
gaagaaggcctcatcacagtca

SEQ ID NO: 15287 - DNA, 20 bp, synthetic construct
  misc_feature 1..20: note = Synthetic Construct
  source 1..20: mol_type = other DNA
ccccaggaaacggagaaaca

SEQ ID NO: 15288 - DNA, 25 bp, synthetic construct
  misc_feature 1..25: note = Synthetic Construct
  source 1..25: mol_type = other DNA
tggagtgtgactggaaaacaattca

SEQ ID NO: 15289 - DNA, 20 bp, synthetic construct
  misc_feature 1..20: note = Synthetic Construct
  source 1..20: mol_type = other DNA
gcaggagcggggaagagtta

SEQ ID NO: 15290 - DNA, 23 bp, synthetic construct
  misc_feature 1..23: note = Synthetic Construct
  source 1..23: mol_type = other DNA
acaaggaagggaagacagcctat

SEQ ID NO: 15291 - DNA, 22 bp, synthetic construct
  misc_feature 1..22: note = Synthetic Construct
  source 1..22: mol_type = other DNA
caagctggtagcaagccctgat

SEQ ID NO: 15292 - DNA, 21 bp, synthetic construct
  misc_feature 1..21: note = Synthetic Construct
  source 1..21: mol_type = other DNA
gttagcaagcagccaggttct

SEQ ID NO: 15293 - DNA, 23 bp, synthetic construct
  misc_feature 1..23: note = Synthetic Construct
  source 1..23: mol_type = other DNA
tccccattgggttacatgggtta

SEQ ID NO: 15294 - DNA, 24 bp, synthetic construct
  misc_feature 1..24: note = Synthetic Construct
  source 1..24: mol_type = other DNA
cttgaactggtcccattgtctagt

SEQ ID NO: 15295 - DNA, 22 bp, synthetic construct
  misc_feature 1..22: note = Synthetic Construct
  source 1..22: mol_type = other DNA
acatgggcacttttacctcaca

SEQ ID NO: 15296 - DNA, 21 bp, synthetic construct
  misc_feature 1..21: note = Synthetic Construct
  source 1..21: mol_type = other DNA
ggccacaagcatgtctgtctt

SEQ ID NO: 15297 - DNA, 20 bp, synthetic construct
  misc_feature 1..20: note = Synthetic Construct
  source 1..20: mol_type = other DNA
tgcggctaatgtggctcaga

SEQ ID NO: 15298 - DNA, 23 bp, synthetic construct
  misc_feature 1..23: note = Synthetic Construct
  source 1..23: mol_type = other DNA
tctgggtttcaactacagccaaa

SEQ ID NO: 15299 - DNA, 24 bp, synthetic construct
  misc_feature 1..24: note = Synthetic Construct
  source 1..24: mol_type = other DNA
gtgtctgatggaacctgcccaatc

SEQ ID NO: 15300 - DNA, 25 bp, synthetic construct
  misc_feature 1..25: note = Synthetic Construct
  source 1..25: mol_type = other DNA
cacatccgtgtaagttagctgcttt

SEQ ID NO: 15301 - DNA, 22 bp, synthetic construct
  misc_feature 1..22: note = Synthetic Construct
  source 1..22: mol_type = other DNA
gtggtgctccagagcttgaact

SEQ ID NO: 15302 - DNA, 25 bp, synthetic construct
  misc_feature 1..25: note = Synthetic Construct
  source 1..25: mol_type = other DNA
caccatgcataaccacagggcaata

SEQ ID NO: 15303 - DNA, 24 bp, synthetic construct
  misc_feature 1..24: note = Synthetic Construct
  source 1..24: mol_type = other DNA
ccacacaggccccattacttccta

SEQ ID NO: 15304 - DNA, 24 bp, synthetic construct
  misc_feature 1..24: note = Synthetic Construct
  source 1..24: mol_type = other DNA
ggtcaaggcctattacccatgctt

SEQ ID NO: 15305 - DNA, 24 bp, synthetic construct
  misc_feature 1..24: note = Synthetic Construct
  source 1..24: mol_type = other DNA
tctcatgtaagagaggctggatct

SEQ ID NO: 15306 - DNA, 20 bp, synthetic construct
  misc_feature 1..20: note = Synthetic Construct
  source 1..20: mol_type = other DNA
gtggcctcctttctgcttgt

SEQ ID NO: 15307 - DNA, 22 bp, synthetic construct
  misc_feature 1..22: note = Synthetic Construct
  source 1..22: mol_type = other DNA
ttaggaatggctgtgtgtggtt

SEQ ID NO: 15308 - DNA, 22 bp, synthetic construct
  misc_feature 1..22: note = Synthetic Construct
  source 1..22: mol_type = other DNA
gcggtgaaacccgtgttctctt

SEQ ID NO: 15309 - DNA, 22 bp, synthetic construct
  misc_feature 1..22: note = Synthetic Construct
  source 1..22: mol_type = other DNA
tcccacctacctgctgttcttg

SEQ ID NO: 15310 - DNA, 24 bp, synthetic construct
  misc_feature 1..24: note = Synthetic Construct
  source 1..24: mol_type = other DNA
ggtttgacccctcttgcttgtttg

SEQ ID NO: 15311 - DNA, 23 bp, synthetic construct
  misc_feature 1..23: note = Synthetic Construct
  source 1..23: mol_type = other DNA
aaagagttgcatcctcagggttt

SEQ ID NO: 15312 - DNA, 18 bp, synthetic construct
  misc_feature 1..18: note = Synthetic Construct
  source 1..18: mol_type = other DNA
tggcacggcagctcagtt

SEQ ID NO: 15313 - DNA, 20 bp, synthetic construct
  misc_feature 1..20: note = Synthetic Construct
  source 1..20: mol_type = other DNA
caagctggccctgtgactga

SEQ ID NO: 15314 - DNA, 24 bp, synthetic construct
  misc_feature 1..24: note = Synthetic Construct
  source 1..24: mol_type = other DNA
tggccctgaagaaagagaaatgat

SEQ ID NO: 15315 - DNA, 26 bp, synthetic construct
  misc_feature 1..26: note = Synthetic Construct
  source 1..26: mol_type = other DNA
gcaggactacagggatgatgtaataa

SEQ ID NO: 15316 - DNA, 21 bp, synthetic construct
  misc_feature 1..21: note = Synthetic Construct
  source 1..21: mol_type = other DNA
ggctgacggcaagacatgaag

SEQ ID NO: 15317 - DNA, 23 bp, synthetic construct
  misc_feature 1..23: note = Synthetic Construct
  source 1..23: mol_type = other DNA
cttgatgctcctggcattgttct

SEQ ID NO: 15318 - DNA, 24 bp, synthetic construct
  misc_feature 1..24: note = Synthetic Construct
  source 1..24: mol_type = other DNA
cacgtgctagatgtgaaggcaagt

SEQ ID NO: 15319 - DNA, 20 bp, synthetic construct
  misc_feature 1..20: note = Synthetic Construct
  source 1..20: mol_type = other DNA
ttagcccggctggcctagtt

SEQ ID NO: 15320 - DNA, 20 bp, synthetic construct
  misc_feature 1..20: note = Synthetic Construct
  source 1..20: mol_type = other DNA
agccagcccctttgttcctt

SEQ ID NO: 15321 - DNA, 23 bp, synthetic construct
  misc_feature 1..23: note = Synthetic Construct
  source 1..23: mol_type = other DNA
aaaccctgtacagagactgcaaa

SEQ ID NO: 15322 - DNA, 21 bp, synthetic construct
  misc_feature 1..21: note = Synthetic Construct
  source 1..21: mol_type = other DNA
gggagtgggacttgcaaccaa

SEQ ID NO: 15323 - DNA, 23 bp, synthetic construct
  misc_feature 1..23: note = Synthetic Construct
  source 1..23: mol_type = other DNA
gcttaacgccaggtcagaagatg

SEQ ID NO: 15324 - DNA, 21 bp, synthetic construct
  misc_feature 1..21: note = Synthetic Construct
  source 1..21: mol_type = other DNA
tgctggtaatcctgggaggtt

SEQ ID NO: 15325 - DNA, 22 bp, synthetic construct
  misc_feature 1..22: note = Synthetic Construct
  source 1..22: mol_type = other DNA
tcctcctggccaagctctttag

SEQ ID NO: 15326 - DNA, 20 bp, synthetic construct
  misc_feature 1..20: note = Synthetic Construct
  source 1..20: mol_type = other DNA
tccagggagggaagtgttca

SEQ ID NO: 15327 - DNA, 20 bp, synthetic construct
  misc_feature 1..20: note = Synthetic Construct
  source 1..20: mol_type = other DNA
gacccagggtgcctggtaaa

SEQ ID NO: 15328 - DNA, 20 bp, synthetic construct
  misc_feature 1..20: note = Synthetic Construct
  source 1..20: mol_type = other DNA
attcccgccggcagaccaaa

SEQ ID NO: 15329 - DNA, 26 bp, synthetic construct
  misc_feature 1..26: note = Synthetic Construct
  source 1..26: mol_type = other DNA
ctccaacttcatttcccactgttttc

SEQ ID NO: 15330 - DNA, 27 bp, synthetic construct
  misc_feature 1..27: note = Synthetic Construct
  source 1..27: mol_type = other DNA
gcctgcactttttcctcttctcctcta

SEQ ID NO: 15331 - DNA, 21 bp, synthetic construct
  misc_feature 1..21: note = Synthetic Construct
  source 1..21: mol_type = other DNA
cagggtgaggatgtccagcta

SEQ ID NO: 15332 - DNA, 25 bp, synthetic construct
  misc_feature 1..25: note = Synthetic Construct
  source 1..25: mol_type = other DNA
cactgtgcttttcctgatcgcatct

SEQ ID NO: 15333 - DNA, 26 bp, synthetic construct
  misc_feature 1..26: note = Synthetic Construct
  source 1..26: mol_type = other DNA
gcccctttgcaccactataagaggat

SEQ ID NO: 15334 - DNA, 22 bp, synthetic construct
  misc_feature 1..22: note = Synthetic Construct
  source 1..22: mol_type = other DNA
gttcttcccctggacccaaagt

SEQ ID NO: 15335 - DNA, 21 bp, synthetic construct
  misc_feature 1..21: note = Synthetic Construct
  source 1..21: mol_type = other DNA
gtgcaaggctggcttcagttc

SEQ ID NO: 15336 - DNA, 21 bp, synthetic construct
  misc_feature 1..21: note = Synthetic Construct
  source 1..21: mol_type = other DNA
gggctttgtctcagcttcctt

SEQ ID NO: 15337 - DNA, 22 bp, synthetic construct
  misc_feature 1..22: note = Synthetic Construct
  source 1..22: mol_type = other DNA
agacggcccagagttctgatag

SEQ ID NO: 15338 - DNA, 23 bp, synthetic construct
  misc_feature 1..23: note = Synthetic Construct
  source 1..23: mol_type = other DNA
tcccactgaagctgaaacgtatg

SEQ ID NO: 15339 - DNA, 22 bp, synthetic construct
  misc_feature 1..22: note = Synthetic Construct
  source 1..22: mol_type = other DNA
aatcatctccccattcggcatt

SEQ ID NO: 15340 - DNA, 24 bp, synthetic construct
  misc_feature 1..24: note = Synthetic Construct
  source 1..24: mol_type = other DNA
ctgaatggcctgaagtcagaaaac

SEQ ID NO: 15341 - DNA, 20 bp, synthetic construct
  misc_feature 1..20: note = Synthetic Construct
  source 1..20: mol_type = other DNA
aggcaagacctcacctgttg

SEQ ID NO: 15342 - DNA, 20 bp, synthetic construct
  misc_feature 1..20: note = Synthetic Construct
  source 1..20: mol_type = other DNA
ccagcatcacgggtgtgtga

SEQ ID NO: 15343 - DNA, 25 bp, synthetic construct
  misc_feature 1..25: note = Synthetic Construct
  source 1..25: mol_type = other DNA
gatagtggtgctattcactgcctat

SEQ ID NO: 15344 - DNA, 20 bp, synthetic construct
  misc_feature 1..20: note = Synthetic Construct
  source 1..20: mol_type = other DNA
gaccacatggtctgctgctt

SEQ ID NO: 15345 - DNA, 21 bp, synthetic construct
  misc_feature 1..21: note = Synthetic Construct
  source 1..21: mol_type = other DNA
aagatcccaggcccacactca

SEQ ID NO: 15346 - DNA, 25 bp, synthetic construct
  misc_feature 1..25: note = Synthetic Construct
  source 1..25: mol_type = other DNA
gtcaataagcgtgaaacgtggtaac

SEQ ID NO: 15347 - DNA, 24 bp, synthetic construct
  misc_feature 1..24: note = Synthetic Construct
  source 1..24: mol_type = other DNA
gttccccagaccaccttctaccta

SEQ ID NO: 15348 - DNA, 23 bp, synthetic construct
  misc_feature 1..23: note = Synthetic Construct
  source 1..23: mol_type = other DNA
acctctagacacactgcctatct

SEQ ID NO: 15349 - DNA, 23 bp, synthetic construct
  misc_feature 1..23: note = Synthetic Construct
  source 1..23: mol_type = other DNA
cctgcttctcacaaagcaagcta

SEQ ID NO: 15350 - DNA, 19 bp, synthetic construct
  misc_feature 1..19: note = Synthetic Construct
  source 1..19: mol_type = other DNA
cggctgctgtcctgctttg

SEQ ID NO: 15351 - DNA, 20 bp, synthetic construct
  misc_feature 1..20: note = Synthetic Construct
  source 1..20: mol_type = other DNA
tggccattccaggcaggtaa

SEQ ID NO: 15352 - DNA, 22 bp, synthetic construct
  misc_feature 1..22: note = Synthetic Construct
  source 1..22: mol_type = other DNA
tgaaaggttgaagctgcacaga

SEQ ID NO: 15353 - DNA, 20 bp, synthetic construct
  misc_feature 1..20: note = Synthetic Construct
  source 1..20: mol_type = other DNA
tccaccgactccgcggctat

SEQ ID NO: 15354 - DNA, 21 bp, synthetic construct
  misc_feature 1..21: note = Synthetic Construct
  source 1..21: mol_type = other DNA
ccttcctgcctctttgccttt

SEQ ID NO: 15355 - DNA, 22 bp, synthetic construct
  misc_feature 1..22: note = Synthetic Construct
  source 1..22: mol_type = other DNA
actactgtgcccttaccccaat

SEQ ID NO: 15356 - DNA, 21 bp, synthetic construct
  misc_feature 1..21: note = Synthetic Construct
  source 1..21: mol_type = other DNA
ctatccttccatcgccacgtt

SEQ ID NO: 15357 - DNA, 24 bp, synthetic construct
  misc_feature 1..24: note = Synthetic Construct
  source 1..24: mol_type = other DNA
gtgggttacctctcaaagctaagt

SEQ ID NO: 15358 - DNA, 20 bp, synthetic construct
  misc_feature 1..20: note = Synthetic Construct
  source 1..20: mol_type = other DNA
tggctggagtggcagcctta

SEQ ID NO: 15359 - DNA, 21 bp, synthetic construct
  misc_feature 1..21: note = Synthetic Construct
  source 1..21: mol_type = other DNA
cgccctggaaactcacagctt

SEQ ID NO: 15360 - DNA, 22 bp, synthetic construct
  misc_feature 1..22: note = Synthetic Construct
  source 1..22: mol_type = other DNA
gcatggcagggactggattgat

SEQ ID NO: 15361 - DNA, 24 bp, synthetic construct
  misc_feature 1..24: note = Synthetic Construct
  source 1..24: mol_type = other DNA
gatgcctcccctctcttcctagat

SEQ ID NO: 15362 - DNA, 22 bp, synthetic construct
  misc_feature 1..22: note = Synthetic Construct
  source 1..22: mol_type = other DNA
agaaagggcaaggtggttttgt

SEQ ID NO: 15363 - DNA, 25 bp, synthetic construct
  misc_feature 1..25: note = Synthetic Construct
  source 1..25: mol_type = other DNA
ctgttgataccttgaggtgctggaa

SEQ ID NO: 15364 - DNA, 21 bp, synthetic construct
  misc_feature 1..21: note = Synthetic Construct
  source 1..21: mol_type = other DNA
ggtcttgggacacgagccaat

SEQ ID NO: 15365 - DNA, 20 bp, synthetic construct
  misc_feature 1..20: note = Synthetic Construct
  source 1..20: mol_type = other DNA
cagcggcaaaacaccctctt

SEQ ID NO: 15366 - DNA, 20 bp, synthetic construct
  misc_feature 1..20: note = Synthetic Construct
  source 1..20: mol_type = other DNA
ggcctcgaaggcatcaccta

SEQ ID NO: 15367 - DNA, 23 bp, synthetic construct
  misc_feature 1..23: note = Synthetic Construct
  source 1..23: mol_type = other DNA
gggagaagctatgagctgagtgt

SEQ ID NO: 15368 - DNA, 20 bp, synthetic construct
  misc_feature 1..20: note = Synthetic Construct
  source 1..20: mol_type = other DNA
tgtcccacacgctgcatatc

SEQ ID NO: 15369 - DNA, 24 bp, synthetic construct
  misc_feature 1..24: note = Synthetic Construct
  source 1..24: mol_type = other DNA
tctggcaactacagtgatgtgaaa

SEQ ID NO: 15370 - DNA, 25 bp, synthetic construct
  misc_feature 1..25: note = Synthetic Construct
  source 1..25: mol_type = other DNA
cagtgaaaccttctaagcccctttg

SEQ ID NO: 15371 - DNA, 20 bp, synthetic construct
  misc_feature 1..20: note = Synthetic Construct
  source 1..20: mol_type = other DNA
tccaccttcctgtccgaagt

SEQ ID NO: 15372 - DNA, 21 bp, synthetic construct
  misc_feature 1..21: note = Synthetic Construct
  source 1..21: mol_type = other DNA
tagcctgggtcagggatgaag

SEQ ID NO: 15373 - DNA, 20 bp, synthetic construct
  misc_feature 1..20: note = Synthetic Construct
  source 1..20: mol_type = other DNA
tgctgggcaaccaagctcat

SEQ ID NO: 15374 - DNA, 22 bp, synthetic construct
  misc_feature 1..22: note = Synthetic Construct
  source 1..22: mol_type = other DNA
acgcctcaccctacaagccata

SEQ ID NO: 15375 - DNA, 20 bp, synthetic construct
  misc_feature 1..20: note = Synthetic Construct
  source 1..20: mol_type = other DNA
cagcctgtttcagggtgaca

SEQ ID NO: 15376 - DNA, 23 bp, synthetic construct
  misc_feature 1..23: note = Synthetic Construct
  source 1..23: mol_type = other DNA
ggtacggaagtcggcctaaatct

SEQ ID NO: 15377 - DNA, 22 bp, synthetic construct
  misc_feature 1..22: note = Synthetic Construct
  source 1..22: mol_type = other DNA
cgccagtcaaaacagccgttag

SEQ ID NO: 15378 - DNA, 20 bp, synthetic construct
  misc_feature 1..20: note = Synthetic Construct
  source 1..20: mol_type = other DNA
tcgtctcctccccgctctgt

SEQ ID NO: 15379 - DNA, 22 bp, synthetic construct
  misc_feature 1..22: note = Synthetic Construct
  source 1..22: mol_type = other DNA
ctgtagtccaggctgtggatga

SEQ ID NO: 15380 - DNA, 22 bp, synthetic construct
  misc_feature 1..22: note = Synthetic Construct
  source 1..22: mol_type = other DNA
atgggtccatgggaggggactt

SEQ ID NO: 15381 - DNA, 20 bp, synthetic construct
  misc_feature 1..20: note = Synthetic Construct
  source 1..20: mol_type = other DNA
gcttctcgccaaggtcatct

SEQ ID NO: 15382 - DNA, 22 bp, synthetic construct
  misc_feature 1..22: note = Synthetic Construct
  source 1..22: mol_type = other DNA
cttctgagggtgtggaagcaaa

SEQ ID NO: 15383 - DNA, 23 bp, synthetic construct
  misc_feature 1..23: note = Synthetic Construct
  source 1..23: mol_type = other DNA
ccactgaccccaataagcccaat

SEQ ID NO: 15384 - DNA, 23 bp, synthetic construct
  misc_feature 1..23: note = Synthetic Construct
  source 1..23: mol_type = other DNA
gagcgtctgcaaaacacatcttg

SEQ ID NO: 15385 - DNA, 22 bp, synthetic construct
  misc_feature 1..22: note = Synthetic Construct
  source 1..22: mol_type = other DNA
ggtgaaggtagttggggtgaag

SEQ ID NO: 15386 - DNA, 22 bp, synthetic construct
  misc_feature 1..22: note = Synthetic Construct
  source 1..22: mol_type = other DNA
ggagaactggggatgctgcttt

SEQ ID NO: 15387 - DNA, 20 bp, synthetic construct
  misc_feature 1..20: note = Synthetic Construct
  source 1..20: mol_type = other DNA
tggagactggtcagcaccat

SEQ ID NO: 15388 - DNA, 24 bp, synthetic construct
  misc_feature 1..24: note = Synthetic Construct
  source 1..24: mol_type = other DNA
aggaattgaacattgctgggtttc

SEQ ID NO: 15389 - DNA, 21 bp, synthetic construct
  misc_feature 1..21: note = Synthetic Construct
  source 1..21: mol_type = other DNA
tcagagggaaggctccatgtt

SEQ ID NO: 15390 - DNA, 22 bp, synthetic construct
  misc_feature 1..22: note = Synthetic Construct
  source 1..22: mol_type = other DNA
tctctgcaggactggcgtttag

SEQ ID NO: 15391 - DNA, 20 bp, synthetic construct
  misc_feature 1..20: note = Synthetic Construct
  source 1..20: mol_type = other DNA
actggctgtgactggtggta

SEQ ID NO: 15392 - DNA, 23 bp, synthetic construct
  misc_feature 1..23: note = Synthetic Construct
  source 1..23: mol_type = other DNA
cacaggactcatacctgggaaac

SEQ ID NO: 15393 - DNA, 22 bp, synthetic construct
  misc_feature 1..22: note = Synthetic Construct
  source 1..22: mol_type = other DNA
ttccccacatcaggaggtgttc

SEQ ID NO: 15394 - DNA, 25 bp, synthetic construct
  misc_feature 1..25: note = Synthetic Construct
  source 1..25: mol_type = other DNA
catcagcttatgtgaagctggtact

SEQ ID NO: 15395 - DNA, 22 bp, synthetic construct
  misc_feature 1..22: note = Synthetic Construct
  source 1..22: mol_type = other DNA
ggtgaaggccaatctcctgttg

SEQ ID NO: 15396 - DNA, 20 bp, synthetic construct
  misc_feature 1..20: note = Synthetic Construct
  source 1..20: mol_type = other DNA
agggctgcaactgccaagaa

SEQ ID NO: 15397 - DNA, 23 bp, synthetic construct
  misc_feature 1..23: note = Synthetic Construct
  source 1..23: mol_type = other DNA
gtgcacctcagaggattggctta

SEQ ID NO: 15398 - DNA, 21 bp, synthetic construct
  misc_feature 1..21: note = Synthetic Construct
  source 1..21: mol_type = other DNA
gaggcagtgggcttgagatac

SEQ ID NO: 15399 - DNA, 20 bp, synthetic construct
  misc_feature 1..20: note = Synthetic Construct
  source 1..20: mol_type = other DNA
gctacagggctgtggcatca

SEQ ID NO: 15400 - DNA, 24 bp, synthetic construct
  misc_feature 1..24: note = Synthetic Construct
  source 1..24: mol_type = other DNA
gcacagcgtgggaggataaggtat

SEQ ID NO: 15401 - DNA, 22 bp, synthetic construct
  misc_feature 1..22: note = Synthetic Construct
  source 1..22: mol_type = other DNA
taagggcagcctctccgtggtt

SEQ ID NO: 15402 - DNA, 21 bp, synthetic construct
  misc_feature 1..21: note = Synthetic Construct
  source 1..21: mol_type = other DNA
aggggtttccggaagactttg

SEQ ID NO: 15403 - DNA, 25 bp, synthetic construct
  misc_feature 1..25: note = Synthetic Construct
  source 1..25: mol_type = other DNA
agggaagtgactgttcttccttcta

SEQ ID NO: 15404 - DNA, 24 bp, synthetic construct
  misc_feature 1..24: note = Synthetic Construct
  source 1..24: mol_type = other DNA
gaattagggaccccaagagtcaac

SEQ ID NO: 15405 - DNA, 21 bp, synthetic construct
  misc_feature 1..21: note = Synthetic Construct
  source 1..21: mol_type = other DNA
aggctcctcaaaaggcaaact

SEQ ID NO: 15406 - DNA, 22 bp, synthetic construct
  misc_feature 1..22: note = Synthetic Construct
  source 1..22: mol_type = other DNA
gtagcccatagccctcaagtct

SEQ ID NO: 15407 - DNA, 23 bp, synthetic construct
  misc_feature 1..23: note = Synthetic Construct
  source 1..23: mol_type = other DNA
ctggggctgattcttgcacacta

SEQ ID NO: 15408 - DNA, 21 bp, synthetic construct
  misc_feature 1..21: note = Synthetic Construct
  source 1..21: mol_type = other DNA
ggctggatgttgagaggaaca

SEQ ID NO: 15409 - DNA, 24 bp, synthetic construct
  misc_feature 1..24: note = Synthetic Construct
  source 1..24: mol_type = other DNA
gcctgtcatcctagttctggagta

SEQ ID NO: 15410 - DNA, 22 bp, synthetic construct
  misc_feature 1..22: note = Synthetic Construct
  source 1..22: mol_type = other DNA
ggccaggtggcagccttaaaat

SEQ ID NO: 15411 - DNA, 26 bp, synthetic construct
  misc_feature 1..26: note = Synthetic Construct
  source 1..26: mol_type = other DNA
gcctgccccattgatatttaaacaag

SEQ ID NO: 15412 - DNA, 22 bp, synthetic construct
  misc_feature 1..22: note = Synthetic Construct
  source 1..22: mol_type = other DNA
gtgcctaaggccactccttatt

SEQ ID NO: 15413 - DNA, 23 bp, synthetic construct
  misc_feature 1..23: note = Synthetic Construct
  source 1..23: mol_type = other DNA
tgactagccaatgtccacagaag

SEQ ID NO: 15414 - DNA, 22 bp, synthetic construct
  misc_feature 1..22: note = Synthetic Construct
  source 1..22: mol_type = other DNA
atcctcccgctcctcttcagat

SEQ ID NO: 15415 - DNA, 23 bp, synthetic construct
  misc_feature 1..23: note = Synthetic Construct
  source 1..23: mol_type = other DNA
caccaaattccaaagggccaagt

SEQ ID NO: 15416 - DNA, 20 bp, synthetic construct
  misc_feature 1..20: note = Synthetic Construct
  source 1..20: mol_type = other DNA
ggcactgggccttttgttca

SEQ ID NO: 15417 - DNA, 22 bp, synthetic construct
  misc_feature 1..22: note = Synthetic Construct
  source 1..22: mol_type = other DNA
tggcagtagtgcttcaggtatg

SEQ ID NO: 15418 - DNA, 22 bp, synthetic construct
  misc_feature 1..22: note = Synthetic Construct
  source 1..22: mol_type = other DNA
gggtgaggctgaggaaagtgtt

SEQ ID NO: 15419 - DNA, 20 bp, synthetic construct
  misc_feature 1..20: note = Synthetic Construct
  source 1..20: mol_type = other DNA
gctgagccccaagggaaaaa

SEQ ID NO: 15420 - DNA, 23 bp, synthetic construct
  misc_feature 1..23: note = Synthetic Construct
  source 1..23: mol_type = other DNA
gaccgccagctaaaaatgctttg

SEQ ID NO: 15421 - DNA, 24 bp, synthetic construct
  misc_feature 1..24: note = Synthetic Construct
  source 1..24: mol_type = other DNA
ctccaagacgctgaaaccttcctt

SEQ ID NO: 15422 - DNA, 20 bp, synthetic construct
  misc_feature 1..20: note = Synthetic Construct
  source 1..20: mol_type = other DNA
ttggaggcaagtggcacaga

SEQ ID NO: 15423 - DNA, 25 bp, synthetic construct
  misc_feature 1..25: note = Synthetic Construct
  source 1..25: mol_type = other DNA
gatgcatcagggctacagtgtatag

SEQ ID NO: 15424 - DNA, 21 bp, synthetic construct
  misc_feature 1..21: note = Synthetic Construct
  source 1..21: mol_type = other DNA
agagagggagccctgatctga

SEQ ID NO: 15425 - DNA, 24 bp, synthetic construct
  misc_feature 1..24: note = Synthetic Construct
  source 1..24: mol_type = other DNA
ccccagacatggtagaggagatac

SEQ ID NO: 15426 - DNA, 22 bp, synthetic construct
  misc_feature 1..22: note = Synthetic Construct
  source 1..22: mol_type = other DNA
acttgtccatgtgcgtcatact

SEQ ID NO: 15427 - DNA, 20 bp, synthetic construct
  misc_feature 1..20: note = Synthetic Construct
  source 1..20: mol_type = other DNA
tgtggggctttggcagagaa

SEQ ID NO: 15428 - DNA, 21 bp, synthetic construct
  misc_feature 1..21: note = Synthetic Construct
  source 1..21: mol_type = other DNA
gccatgatctggtcggaaact

SEQ ID NO: 15429 - DNA, 22 bp, synthetic construct
  misc_feature 1..22: note = Synthetic Construct
  source 1..22: mol_type = other DNA
gtgggagctgtcaagaggaaga

SEQ ID NO: 15430 - DNA, 22 bp, synthetic construct
  misc_feature 1..22: note = Synthetic Construct
  source 1..22: mol_type = other DNA
ccctgaaggctccatcctgaga

SEQ ID NO: 15431 - DNA, 24 bp, synthetic construct
  misc_feature 1..24: note = Synthetic Construct
  source 1..24: mol_type = other DNA
catgtttcagccctgacagctttg

SEQ ID NO: 15432 - DNA, 19 bp, synthetic construct
  misc_feature 1..19: note = Synthetic Construct
  source 1..19: mol_type = other DNA
ggctttggccccggcttat

SEQ ID NO: 15433 - DNA, 24 bp, synthetic construct
  misc_feature 1..24: note = Synthetic Construct
  source 1..24: mol_type = other DNA
gcaggctgatgtttgcatcgtctt

SEQ ID NO: 15434 - DNA, 21 bp, synthetic construct
  misc_feature 1..21: note = Synthetic Construct
  source 1..21: mol_type = other DNA
attccctcctccggcactgat

SEQ ID NO: 15435 - DNA, 24 bp, synthetic construct
  misc_feature 1..24: note = Synthetic Construct
  source 1..24: mol_type = other DNA
ctccgtacctggatgaggaagatg

SEQ ID NO: 15436 - DNA, 21 bp, synthetic construct
  misc_feature 1..21: note = Synthetic Construct
  source 1..21: mol_type = other DNA
gtgccttggcacatgctgtag

SEQ ID NO: 15437 - DNA, 20 bp, synthetic construct
  misc_feature 1..20: note = Synthetic Construct
  source 1..20: mol_type = other DNA
agtggtggagtcgtgctaga

SEQ ID NO: 15438 - DNA, 22 bp, synthetic construct
  misc_feature 1..22: note = Synthetic Construct
  source 1..22: mol_type = other DNA
gtccccagatcccaggaaacaa

SEQ ID NO: 15439 - DNA, 23 bp, synthetic construct
  misc_feature 1..23: note = Synthetic Construct
  source 1..23: mol_type = other DNA
gacagctagcctaaagcctccat

SEQ ID NO: 15440 - DNA, 21 bp, synthetic construct
  misc_feature 1..21: note = Synthetic Construct
  source 1..21: mol_type = other DNA
gaaccagcaatggcagagaca

SEQ ID NO: 15441 - DNA, 20 bp, synthetic construct
  misc_feature 1..20: note = Synthetic Construct
  source 1..20: mol_type = other DNA
agctgtgtccactgggtcat

SEQ ID NO: 15442 - DNA, 20 bp, synthetic construct
  misc_feature 1..20: note = Synthetic Construct
  source 1..20: mol_type = other DNA
ccccacaatggccaaagcaa

SEQ ID NO: 15443 - DNA, 23 bp, synthetic construct
  misc_feature 1..23: note = Synthetic Construct
  source 1..23: mol_type = other DNA
gtccagactataccctgcactca

SEQ ID NO: 15444 - DNA, 24 bp, synthetic construct
  misc_feature 1..24: note = Synthetic Construct
  source 1..24: mol_type = other DNA
gtttggtacacaactgtccagcta

SEQ ID NO: 15445 - DNA, 24 bp, synthetic construct
  misc_feature 1..24: note = Synthetic Construct
  source 1..24: mol_type = other DNA
ggatctgttgtagccccagaagtt

SEQ ID NO: 15446 - DNA, 21 bp, synthetic construct
  misc_feature 1..21: note = Synthetic Construct
  source 1..21: mol_type = other DNA
taggcagtggcagggtggttt

SEQ ID NO: 15447 - DNA, 21 bp, synthetic construct
  misc_feature 1..21: note = Synthetic Construct
  source 1..21: mol_type = other DNA
tgcttcttcacccctctgaac

SEQ ID NO: 15448 - DNA, 22 bp, synthetic construct
  misc_feature 1..22: note = Synthetic Construct
  source 1..22: mol_type = other DNA
ctgtgttggctccttccctttc

SEQ ID NO: 15449 - DNA, 23 bp, synthetic construct
  misc_feature 1..23: note = Synthetic Construct
  source 1..23: mol_type = other DNA
ccccattctatgcagccttggaa

SEQ ID NO: 15450 - DNA, 27 bp, synthetic construct
  misc_feature 1..27: note = Synthetic Construct
  source 1..27: mol_type = other DNA
gctgcttctacaaatccagctagaaac

SEQ ID NO: 15451 - DNA, 21 bp, synthetic construct
  misc_feature 1..21: note = Synthetic Construct
  source 1..21: mol_type = other DNA
ctccattggcctggtttgctt

SEQ ID NO: 15452 - DNA, 24 bp, synthetic construct
  misc_feature 1..24: note = Synthetic Construct
  source 1..24: mol_type = other DNA
gacaccctggacccttgacttcta

SEQ ID NO: 15453 - DNA, 20 bp, synthetic construct
  misc_feature 1..20: note = Synthetic Construct
  source 1..20: mol_type = other DNA
gtggttgggaagcaggtcaa

SEQ ID NO: 15454 - DNA, 22 bp, synthetic construct
  misc_feature 1..22: note = Synthetic Construct
  source 1..22: mol_type = other DNA
gcagtttctgcaccacacattc

SEQ ID NO: 15455 - DNA, 28 bp, synthetic construct
  misc_feature 1..28: note = Synthetic Construct
  source 1..28: mol_type = other DNA
catgcttccaataacctcttcgtagtct

SEQ ID NO: 15456 - DNA, 24 bp, synthetic construct
  misc_feature 1..24: note = Synthetic Construct
  source 1..24: mol_type = other DNA
ggacgtttgcaatcctgggcatag

SEQ ID NO: 15457 - DNA, 21 bp, synthetic construct
  misc_feature 1..21: note = Synthetic Construct
  source 1..21: mol_type = other DNA
ggtcctccgaggcttgttgaa

SEQ ID NO: 15458 - DNA, 21 bp, synthetic construct
  misc_feature 1..21: note = Synthetic Construct
  source 1..21: mol_type = other DNA
aggggcagactccacttgctt

SEQ ID NO: 15459 - DNA, 22 bp, synthetic construct
  misc_feature 1..22: note = Synthetic Construct
  source 1..22: mol_type = other DNA
gtatgggatgtgcaggatgaca

SEQ ID NO: 15460 - DNA, 20 bp, synthetic construct
  misc_feature 1..20: note = Synthetic Construct
  source 1..20: mol_type = other DNA
agcttggggtatgggtgcaa

SEQ ID NO: 15461 - DNA, 20 bp, synthetic construct
  misc_feature 1..20: note = Synthetic Construct
  source 1..20: mol_type = other DNA
ttgcaactcggcagggaact

SEQ ID NO: 15462 - DNA, 23 bp, synthetic construct
  misc_feature 1..23: note = Synthetic Construct
  source 1..23: mol_type = other DNA
acaccaggtataaggtggcattg

SEQ ID NO: 15463 - DNA, 22 bp, synthetic construct
  misc_feature 1..22: note = Synthetic Construct
  source 1..22: mol_type = other DNA
tgtctgggtgggtgctacactt

SEQ ID NO: 15464 - DNA, 20 bp, synthetic construct
  misc_feature 1..20: note = Synthetic Construct
  source 1..20: mol_type = other DNA
agcctggaggctgaaagact

SEQ ID NO: 15465 - DNA, 20 bp, synthetic construct
  misc_feature 1..20: note = Synthetic Construct
  source 1..20: mol_type = other DNA
agcgcgtcaaaggctgaagt

SEQ ID NO: 15466 - DNA, 24 bp, synthetic construct
  misc_feature 1..24: note = Synthetic Construct
  source 1..24: mol_type = other DNA
gcttaatcctctggatgcagttct

SEQ ID NO: 15467 - DNA, 22 bp, synthetic construct
  misc_feature 1..22: note = Synthetic Construct
  source 1..22: mol_type = other DNA
tggccgtgtgagtctgtaaaac

SEQ ID NO: 15468 - DNA, 22 bp, synthetic construct
  misc_feature 1..22: note = Synthetic Construct
  source 1..22: mol_type = other DNA
gagtgggttggggaggtgataa

SEQ ID NO: 15469 - DNA, 22 bp, synthetic construct
  misc_feature 1..22: note = Synthetic Construct
  source 1..22: mol_type = other DNA
caccatgccttcctcctccatt

SEQ ID NO: 15470 - DNA, 25 bp, synthetic construct
  misc_feature 1..25: note = Synthetic Construct
  source 1..25: mol_type = other DNA
aatctgtactcccagaggtgaaaag

SEQ ID NO: 15471 - DNA, 21 bp, synthetic construct
  misc_feature 1..21: note = Synthetic Construct
  source 1..21: mol_type = other DNA
atggctgcttcaggggcagtt

SEQ ID NO: 15472 - DNA, 24 bp, synthetic construct
  misc_feature 1..24: note = Synthetic Construct
  source 1..24: mol_type = other DNA
gtgcaccagaatagatgtgagact

SEQ ID NO: 15473 - DNA, 25 bp, synthetic construct
  misc_feature 1..25: note = Synthetic Construct
  source 1..25: mol_type = other DNA
cagggtctttcttccctcatgtaaa

SEQ ID NO: 15474 - DNA, 22 bp, synthetic construct
  misc_feature 1..22: note = Synthetic Construct
  source 1..22: mol_type = other DNA
tgaaaggggagcccaagtctct

SEQ ID NO: 15475 - DNA, 23 bp, synthetic construct
  misc_feature 1..23: note = Synthetic Construct
  source 1..23: mol_type = other DNA
gagtgcctgaagagggcagtatc

SEQ ID NO: 15476 - DNA, 22 bp, synthetic construct
  misc_feature 1..22: note = Synthetic Construct
  source 1..22: mol_type = other DNA
gcaggaggacaggcaacttaga

SEQ ID NO: 15477 - DNA, 19 bp, synthetic construct
  misc_feature 1..19: note = Synthetic Construct
  source 1..19: mol_type = other DNA
tgtcccagccaagcctaga

SEQ ID NO: 15478 - DNA, 24 bp, synthetic construct
  misc_feature 1..24: note = Synthetic Construct
  source 1..24: mol_type = other DNA
gtggtcctaggtaagctggtgttg

SEQ ID NO: 15479 - DNA, 23 bp, synthetic construct
  misc_feature 1..23: note = Synthetic Construct
  source 1..23: mol_type = other DNA
ggatatagtcgtggtgggcttca

SEQ ID NO: 15480 - DNA, 24 bp, synthetic construct
  misc_feature 1..24: note = Synthetic Construct
  source 1..24: mol_type = other DNA
gaggcactggtatccatgttgaga

SEQ ID NO: 15481 - DNA, 20 bp, synthetic construct
  misc_feature 1..20: note = Synthetic Construct
  source 1..20: mol_type = other DNA
aggtgacaggaacccaggaa

SEQ ID NO: 15482 - DNA, 23 bp, synthetic construct
  misc_feature 1..23: note = Synthetic Construct
  source 1..23: mol_type = other DNA
acagaccgtaagacaagggtttg

SEQ ID NO: 15483 - DNA, 20 bp, synthetic construct
  misc_feature 1..20: note = Synthetic Construct
  source 1..20: mol_type = other DNA
ccagcaacagcagtgccaaa

SEQ ID NO: 15484 - DNA, 21 bp, synthetic construct
  misc_feature 1..21: note = Synthetic Construct
  source 1..21: mol_type = other DNA
cccagccaacatctcaccttt

SEQ ID NO: 15485 - DNA, 28 bp, synthetic construct
  misc_feature 1..28: note = Synthetic Construct
  source 1..28: mol_type = other DNA
gcctaagcctctttttcactaccctcta

SEQ ID NO: 15486 - DNA, 25 bp, synthetic construct
  misc_feature 1..25: note = Synthetic Construct
  source 1..25: mol_type = other DNA
ggttcacagatggttctgcacgata

SEQ ID NO: 15487 - DNA, 19 bp, synthetic construct
  misc_feature 1..19: note = Synthetic Construct
  source 1..19: mol_type = other DNA
tcatggccaccaccagact

SEQ ID NO: 15488 - DNA, 24 bp, synthetic construct
  misc_feature 1..24: note = Synthetic Construct
  source 1..24: mol_type = other DNA
ggaaaggtctaagcttggttcaca

SEQ ID NO: 15489 - DNA, 22 bp, synthetic construct
  misc_feature 1..22: note = Synthetic Construct
  source 1..22: mol_type = other DNA
gcctggttgcatttccctatgt

SEQ ID NO: 15490 - DNA, 20 bp, synthetic construct
  misc_feature 1..20: note = Synthetic Construct
  source 1..20: mol_type = other DNA
tctgtgcctgcgtggagttg

SEQ ID NO: 15491 - DNA, 25 bp, synthetic construct
  misc_feature 1..25: note = Synthetic Construct
  source 1..25: mol_type = other DNA
ctgctgcatagccagagatctttac

SEQ ID NO: 15492 - DNA, 20 bp, synthetic construct
  misc_feature 1..20: note = Synthetic Construct
  source 1..20: mol_type = other DNA
tgcccaggttgctccctagt

SEQ ID NO: 15493 - DNA, 21 bp, synthetic construct
  misc_feature 1..21: note = Synthetic Construct
  source 1..21: mol_type = other DNA
gccatccactgagggcagaag

SEQ ID NO: 15494 - DNA, 24 bp, synthetic construct
  misc_feature 1..24: note = Synthetic Construct
  source 1..24: mol_type = other DNA
cctgcccatcatccttcaggtctt

SEQ ID NO: 15495 - DNA, 22 bp, synthetic construct
  misc_feature 1..22: note = Synthetic Construct
  source 1..22: mol_type = other DNA
ctgcctgctgtctcagcttttc

SEQ ID NO: 15496 - DNA, 22 bp, synthetic construct
  misc_feature 1..22: note = Synthetic Construct
  source 1..22: mol_type = other DNA
tcaggcttcatctcctccagaa

SEQ ID NO: 15497 - DNA, 25 bp, synthetic construct
  misc_feature 1..25: note = Synthetic Construct
  source 1..25: mol_type = other DNA
caagtagcagattggtgtaggaagt

SEQ ID NO: 15498 - DNA, 24 bp, synthetic construct
  misc_feature 1..24: note = Synthetic Construct
  source 1..24: mol_type = other DNA
ggaattcaggacaggaaagtgtct

SEQ ID NO: 15499 - DNA, 26 bp, synthetic construct
  misc_feature 1..26: note = Synthetic Construct
  source 1..26: mol_type = other DNA
gctcctaaggaaattcttggggatga

SEQ ID NO: 15500 - DNA, 19 bp, synthetic construct
  misc_feature 1..19: note = Synthetic Construct
  source 1..19: mol_type = other DNA
ccacaggctgcaagacaca

SEQ ID NO: 15501 - DNA, 21 bp, synthetic construct
  misc_feature 1..21: note = Synthetic Construct
  source 1..21: mol_type = other DNA
tgccagggctagagtttgaag

SEQ ID NO: 15502 - DNA, 26 bp, synthetic construct
  misc_feature 1..26: note = Synthetic Construct
  source 1..26: mol_type = other DNA
gcaggcacacaatagtaaggaacaga

SEQ ID NO: 15503 - DNA, 23 bp, synthetic construct
  misc_feature 1..23: note = Synthetic Construct
  source 1..23: mol_type = other DNA
ccccagaggtactgggtcaagat

SEQ ID NO: 15504 - DNA, 22 bp, synthetic construct
  misc_feature 1..22: note = Synthetic Construct
  source 1..22: mol_type = other DNA
cgaatgggttactccccagtga

SEQ ID NO: 15505 - DNA, 22 bp, synthetic construct
  misc_feature 1..22: note = Synthetic Construct
  source 1..22: mol_type = other DNA
tcagcttgtcctcttgcagaaa

SEQ ID NO: 15506 - DNA, 25 bp, synthetic construct
  misc_feature 1..25: note = Synthetic Construct
  source 1..25: mol_type = other DNA
gggcttgaatgtgcttgaatagttg

SEQ ID NO: 15507 - DNA, 22 bp, synthetic construct
  misc_feature 1..22: note = Synthetic Construct
  source 1..22: mol_type = other DNA
ttccttctggcccagggtgtat

SEQ ID NO: 15508 - DNA, 21 bp, synthetic construct
  misc_feature 1..21: note = Synthetic Construct
  source 1..21: mol_type = other DNA
cctcaggcccaggggtgataa

SEQ ID NO: 15509 - DNA, 20 bp, synthetic construct
  misc_feature 1..20: note = Synthetic Construct
  source 1..20: mol_type = other DNA
gcaggtctgtgggtcagcta

SEQ ID NO: 15510 - DNA, 26 bp, synthetic construct
  misc_feature 1..26: note = Synthetic Construct
  source 1..26: mol_type = other DNA
ctctgaattaaagccagcagaagcta

SEQ ID NO: 15511 - DNA, 22 bp, synthetic construct
  misc_feature 1..22: note = Synthetic Construct
  source 1..22: mol_type = other DNA
acagagagccggcacctattct

SEQ ID NO: 15512 - DNA, 22 bp, synthetic construct
  misc_feature 1..22: note = Synthetic Construct
  source 1..22: mol_type = other DNA
tgggagcatccctcctcctaac

SEQ ID NO: 15513 - DNA, 22 bp, synthetic construct
  misc_feature 1..22: note = Synthetic Construct
  source 1..22: mol_type = other DNA
aaccgcagagaaaaagggatgt

SEQ ID NO: 15514 - DNA, 26 bp, synthetic construct
  misc_feature 1..26: note = Synthetic Construct
  source 1..26: mol_type = other DNA
gaggcagtgatgactcatgtttaaga

SEQ ID NO: 15515 - DNA, 20 bp, synthetic construct
  misc_feature 1..20: note = Synthetic Construct
  source 1..20: mol_type = other DNA
gccccagcctactcctctga

SEQ ID NO: 15516 - DNA, 22 bp, synthetic construct
  misc_feature 1..22: note = Synthetic Construct
  source 1..22: mol_type = other DNA
gagctgctgtaggagggatgaa

SEQ ID NO: 15517 - DNA, 20 bp, synthetic construct
  misc_feature 1..20: note = Synthetic Construct
  source 1..20: mol_type = other DNA
tgccaaggctctgactgcaa

SEQ ID NO: 15518 - DNA, 24 bp, synthetic construct
  misc_feature 1..24: note = Synthetic Construct
  source 1..24: mol_type = other DNA
gcaggtgctacactagatgcaaac

SEQ ID NO: 15519 - DNA, 22 bp, synthetic construct
  misc_feature 1..22: note = Synthetic Construct
  source 1..22: mol_type = other DNA
gctactccagggcaaagctact

SEQ ID NO: 15520 - DNA, 22 bp, synthetic construct
  misc_feature 1..22: note = Synthetic Construct
  source 1..22: mol_type = other DNA
tgccacttgacacccatcaaag

SEQ ID NO: 15521 - DNA, 21 bp, synthetic construct
  misc_feature 1..21: note = Synthetic Construct
  source 1..21: mol_type = other DNA
ggccccaggtcaggacatagt

SEQ ID NO: 15522 - DNA, 23 bp, synthetic construct
  misc_feature 1..23: note = Synthetic Construct
  source 1..23: mol_type = other DNA
gccatatacctagcaccacactt

SEQ ID NO: 15523 - DNA, 27 bp, synthetic construct
  misc_feature 1..27: note = Synthetic Construct
  source 1..27: mol_type = other DNA
gtgatacctcaagactgagaccacaaa

SEQ ID NO: 15524 - DNA, 22 bp, synthetic construct
  misc_feature 1..22: note = Synthetic Construct
  source 1..22: mol_type = other DNA
actggaacccagggcttttaac

SEQ ID NO: 15525 - DNA, 22 bp, synthetic construct
  misc_feature 1..22: note = Synthetic Construct
  source 1..22: mol_type = other DNA
cgcagagacatgtgggcaaaga

SEQ ID NO: 15526 - DNA, 24 bp, synthetic construct
  misc_feature 1..24: note = Synthetic Construct
  source 1..24: mol_type = other DNA
gactccactgggtgttaacttttg

SEQ ID NO: 15527 - DNA, 20 bp, synthetic construct
  misc_feature 1..20: note = Synthetic Construct
  source 1..20: mol_type = other DNA
ttgccccacttcctccagaa

SEQ ID NO: 15528 - DNA, 21 bp, synthetic construct
  misc_feature 1..21: note = Synthetic Construct
  source 1..21: mol_type = other DNA
aaggctggatgcagggctaga

SEQ ID NO: 15529 - DNA, 20 bp, synthetic construct
  misc_feature 1..20: note = Synthetic Construct
  source 1..20: mol_type = other DNA
cagccccaccagagggtaag

SEQ ID NO: 15530 - DNA, 20 bp, synthetic construct
  misc_feature 1..20: note = Synthetic Construct
  source 1..20: mol_type = other DNA
tgctccacacatgggcacaa

SEQ ID NO: 15531 - DNA, 21 bp, synthetic construct
  misc_feature 1..21: note = Synthetic Construct
  source 1..21: mol_type = other DNA
agtggctctgggcctgtgtaa

SEQ ID NO: 15532 - DNA, 21 bp, synthetic construct
  misc_feature 1..21: note = Synthetic Construct
  source 1..21: mol_type = other DNA
ggtgggccttgtggagaatgt

SEQ ID NO: 15533 - DNA, 21 bp, synthetic construct
  misc_feature 1..21: note = Synthetic Construct
  source 1..21: mol_type = other DNA
ctgcatcttgccttcccagaa

SEQ ID NO: 15534 - DNA, 24 bp, synthetic construct
  misc_feature 1..24: note = Synthetic Construct
  source 1..24: mol_type = other DNA
attaagacagggaggcacatgaat

SEQ ID NO: 15535 - DNA, 24 bp, synthetic construct
  misc_feature 1..24: note = Synthetic Construct
  source 1..24: mol_type = other DNA
cgtaaggggaggaggtaagcaaca

SEQ ID NO: 15536 - DNA, 24 bp, synthetic construct
  misc_feature 1..24: note = Synthetic Construct
  source 1..24: mol_type = other DNA
cactgaccatccagcctgattttg

SEQ ID NO: 15537 - DNA, 23 bp, synthetic construct
  misc_feature 1..23: note = Synthetic Construct
  source 1..23: mol_type = other DNA
tgggccatgcataaaagctaaca

SEQ ID NO: 15538 - DNA, 23 bp, synthetic construct
  misc_feature 1..23: note = Synthetic Construct
  source 1..23: mol_type = other DNA
gaatgggtggctcctctctgaag

SEQ ID NO: 15539 - DNA, 24 bp, synthetic construct
  misc_feature 1..24: note = Synthetic Construct
  source 1..24: mol_type = other DNA
tcactctcatagcactgtgtttca

SEQ ID NO: 15540 - DNA, 21 bp, synthetic construct
  misc_feature 1..21: note = Synthetic Construct
  source 1..21: mol_type = other DNA
caaagctgcaagacgccctaa

SEQ ID NO: 15541 - DNA, 22 bp, synthetic construct
  misc_feature 1..22: note = Synthetic Construct
  source 1..22: mol_type = other DNA
ggccatgtggaaatgggacctt

SEQ ID NO: 15542 - DNA, 22 bp, synthetic construct
  misc_feature 1..22: note = Synthetic Construct
  source 1..22: mol_type = other DNA
cagtgtttcgggtaggggtaga

SEQ ID NO: 15543 - DNA, 25 bp, synthetic construct
  misc_feature 1..25: note = Synthetic Construct
  source 1..25: mol_type = other DNA
cgcttggaaagagagacaggaaatc

SEQ ID NO: 15544 - DNA, 22 bp, synthetic construct
  misc_feature 1..22: note = Synthetic Construct
  source 1..22: mol_type = other DNA
cttgtcagcaagctgggtctct

SEQ ID NO: 15545 - DNA, 26 bp, synthetic construct
  misc_feature 1..26: note = Synthetic Construct
  source 1..26: mol_type = other DNA
gcctaagaaatcgctacaagactaga

SEQ ID NO: 15546 - DNA, 23 bp, synthetic construct
  misc_feature 1..23: note = Synthetic Construct
  source 1..23: mol_type = other DNA
gcagcctcgaaactaacccacaa

SEQ ID NO: 15547 - DNA, 25 bp, synthetic construct
  misc_feature 1..25: note = Synthetic Construct
  source 1..25: mol_type = other DNA
ggaaggagtctctctcagagctgta

SEQ ID NO: 15548 - DNA, 22 bp, synthetic construct
  misc_feature 1..22: note = Synthetic Construct
  source 1..22: mol_type = other DNA
ggctgttgccatgaacccatag

SEQ ID NO: 15549 - DNA, 24 bp, synthetic construct
  misc_feature 1..24: note = Synthetic Construct
  source 1..24: mol_type = other DNA
aaccaacctgtttacagtctcact

SEQ ID NO: 15550 - DNA, 22 bp, synthetic construct
  misc_feature 1..22: note = Synthetic Construct
  source 1..22: mol_type = other DNA
ccctctggtgcaggagagtaaa

SEQ ID NO: 15551 - DNA, 20 bp, synthetic construct
  misc_feature 1..20: note = Synthetic Construct
  source 1..20: mol_type = other DNA
agcagagaccagcccatcat

SEQ ID NO: 15552 - DNA, 25 bp, synthetic construct
  misc_feature 1..25: note = Synthetic Construct
  source 1..25: mol_type = other DNA
ccaaggactcctgcaatcctagtca

SEQ ID NO: 15553 - DNA, 24 bp, synthetic construct
  misc_feature 1..24: note = Synthetic Construct
  source 1..24: mol_type = other DNA
cactaagacttgcctccccatcat

SEQ ID NO: 15554 - DNA, 25 bp, synthetic construct
  misc_feature 1..25: note = Synthetic Construct
  source 1..25: mol_type = other DNA
ccttcctcacaagtgctttctgaat

SEQ ID NO: 15555 - DNA, 21 bp, synthetic construct
  misc_feature 1..21: note = Synthetic Construct
  source 1..21: mol_type = other DNA
tcctcaaccctttgcacacat

SEQ ID NO: 15556 - DNA, 22 bp, synthetic construct
  misc_feature 1..22: note = Synthetic Construct
  source 1..22: mol_type = other DNA
gtggcagtcttagcttccagtt

SEQ ID NO: 15557 - DNA, 22 bp, synthetic construct
  misc_feature 1..22: note = Synthetic Construct
  source 1..22: mol_type = other DNA
cagcaaagcagcaggtgacaga

SEQ ID NO: 15558 - DNA, 20 bp, synthetic construct
  misc_feature 1..20: note = Synthetic Construct
  source 1..20: mol_type = other DNA
agtggctgtcaagcccaact

SEQ ID NO: 15559 - DNA, 24 bp, synthetic construct
  misc_feature 1..24: note = Synthetic Construct
  source 1..24: mol_type = other DNA
gcctaacacaaaacaggtccattt

SEQ ID NO: 15560 - DNA, 26 bp, synthetic construct
  misc_feature 1..26: note = Synthetic Construct
  source 1..26: mol_type = other DNA
ggctctaagaccatgctacctcattc

SEQ ID NO: 15561 - DNA, 21 bp, synthetic construct
  misc_feature 1..21: note = Synthetic Construct
  source 1..21: mol_type = other DNA
tgggaaccagcacatggattg

SEQ ID NO: 15562 - DNA, 20 bp, synthetic construct
  misc_feature 1..20: note = Synthetic Construct
  source 1..20: mol_type = other DNA
ttctgtcgctgtgcgtcctt

SEQ ID NO: 15563 - DNA, 24 bp, synthetic construct
  misc_feature 1..24: note = Synthetic Construct
  source 1..24: mol_type = other DNA
ccacgggtgagtcatcctcatatc

SEQ ID NO: 15564 - DNA, 23 bp, synthetic construct
  misc_feature 1..23: note = Synthetic Construct
  source 1..23: mol_type = other DNA
ccagccattgtgttgaatccttt

SEQ ID NO: 15565 - DNA, 20 bp, synthetic construct
  misc_feature 1..20: note = Synthetic Construct
  source 1..20: mol_type = other DNA
gggtggtactgtgcgtccaa

SEQ ID NO: 15566 - DNA, 26 bp, synthetic construct
  misc_feature 1..26: note = Synthetic Construct
  source 1..26: mol_type = other DNA
ggggctcatttaaatactccctctgt

SEQ ID NO: 15567 - DNA, 23 bp, synthetic construct
  misc_feature 1..23: note = Synthetic Construct
  source 1..23: mol_type = other DNA
tgctatttgggtgtcagtccttt

SEQ ID NO: 15568 - DNA, 22 bp, synthetic construct
  misc_feature 1..22: note = Synthetic Construct
  source 1..22: mol_type = other DNA
cagagcccaagggcattgaaca

SEQ ID NO: 15569 - DNA, 22 bp, synthetic construct
  misc_feature 1..22: note = Synthetic Construct
  source 1..22: mol_type = other DNA
tctctaccctgacagtgcaaca

SEQ ID NO: 15570 - DNA, 24 bp, synthetic construct
  misc_feature 1..24: note = Synthetic Construct
  source 1..24: mol_type = other DNA
aaggttccatctgtggaagagttt

SEQ ID NO: 15571 - DNA, 19 bp, synthetic construct
  misc_feature 1..19: note = Synthetic Construct
  source 1..19: mol_type = other DNA
ggctgccagcaggttgtct

SEQ ID NO: 15572 - DNA, 22 bp, synthetic construct
  misc_feature 1..22: note = Synthetic Construct
  source 1..22: mol_type = other DNA
tcctcgggagagtgacctgtaa

SEQ ID NO: 15573 - DNA, 23 bp, synthetic construct
  misc_feature 1..23: note = Synthetic Construct
  source 1..23: mol_type = other DNA
ggaactgcagacaagagctaaac

SEQ ID NO: 15574 - DNA, 23 bp, synthetic construct
  misc_feature 1..23: note = Synthetic Construct
  source 1..23: mol_type = other DNA
cacatgcatcctgtcctaactgt

SEQ ID NO: 15575 - DNA, 25 bp, synthetic construct
  misc_feature 1..25: note = Synthetic Construct
  source 1..25: mol_type = other DNA
cagacctgtttcctcatcaatctct

SEQ ID NO: 15576 - DNA, 23 bp, synthetic construct
  misc_feature 1..23: note = Synthetic Construct
  source 1..23: mol_type = other DNA
gggttcttctaatgctggagaca

SEQ ID NO: 15577 - DNA, 23 bp, synthetic construct
  misc_feature 1..23: note = Synthetic Construct
  source 1..23: mol_type = other DNA
tgtcctatagcagactcccaagt

SEQ ID NO: 15578 - DNA, 21 bp, synthetic construct
  misc_feature 1..21: note = Synthetic Construct
  source 1..21: mol_type = other DNA
gcagcccttgccgagaataga

SEQ ID NO: 15579 - DNA, 22 bp, synthetic construct
  misc_feature 1..22: note = Synthetic Construct
  source 1..22: mol_type = other DNA
cactccgatgccctggtattca

SEQ ID NO: 15580 - DNA, 23 bp, synthetic construct
  misc_feature 1..23: note = Synthetic Construct
  source 1..23: mol_type = other DNA
gtcctgtgaggcattgtggaagt

SEQ ID NO: 15581 - DNA, 22 bp, synthetic construct
  misc_feature 1..22: note = Synthetic Construct
  source 1..22: mol_type = other DNA
actgcatgaaggctctgtgatt

SEQ ID NO: 15582 - DNA, 24 bp, synthetic construct
  misc_feature 1..24: note = Synthetic Construct
  source 1..24: mol_type = other DNA
gccaggactctaaagggagcttgt

SEQ ID NO: 15583 - DNA, 21 bp, synthetic construct
  misc_feature 1..21: note = Synthetic Construct
  source 1..21: mol_type = other DNA
tcccacacctcagccttggaa

SEQ ID NO: 15584 - DNA, 19 bp, synthetic construct
  misc_feature 1..19: note = Synthetic Construct
  source 1..19: mol_type = other DNA
actggccaggctcccattc

SEQ ID NO: 15585 - DNA, 23 bp, synthetic construct
  misc_feature 1..23: note = Synthetic Construct
  source 1..23: mol_type = other DNA
tgcccttctgcctactgaaaatc

SEQ ID NO: 15586 - DNA, 22 bp, synthetic construct
  misc_feature 1..22: note = Synthetic Construct
  source 1..22: mol_type = other DNA
acccctccacaacctcaagtca

SEQ ID NO: 15587 - DNA, 21 bp, synthetic construct
  misc_feature 1..21: note = Synthetic Construct
  source 1..21: mol_type = other DNA
caccttagcagcccactttct

SEQ ID NO: 15588 - DNA, 21 bp, synthetic construct
  misc_feature 1..21: note = Synthetic Construct
  source 1..21: mol_type = other DNA
cagcaggctccagttcaatct

SEQ ID NO: 15589 - DNA, 24 bp, synthetic construct
  misc_feature 1..24: note = Synthetic Construct
  source 1..24: mol_type = other DNA
ggaagggatgcagagcacagatac

SEQ ID NO: 15590 - DNA, 25 bp, synthetic construct
  misc_feature 1..25: note = Synthetic Construct
  source 1..25: mol_type = other DNA
cacctacccagtggtagtagtgaca

SEQ ID NO: 15591 - DNA, 25 bp, synthetic construct
  misc_feature 1..25: note = Synthetic Construct
  source 1..25: mol_type = other DNA
gcccctactgatagtgtgcgtaaag

SEQ ID NO: 15592 - DNA, 21 bp, synthetic construct
  misc_feature 1..21: note = Synthetic Construct
  source 1..21: mol_type = other DNA
aattctgccggatccgacttt

SEQ ID NO: 15593 - DNA, 21 bp, synthetic construct
  misc_feature 1..21: note = Synthetic Construct
  source 1..21: mol_type = other DNA
ttctctctgcatgggttgcat

SEQ ID NO: 15594 - DNA, 21 bp, synthetic construct
  misc_feature 1..21: note = Synthetic Construct
  source 1..21: mol_type = other DNA
gtgggagttctgtcccagaga

SEQ ID NO: 15595 - DNA, 21 bp, synthetic construct
  misc_feature 1..21: note = Synthetic Construct
  source 1..21: mol_type = other DNA
gcctcggcctcctgtgttttt

SEQ ID NO: 15596 - DNA, 22 bp, synthetic construct
  misc_feature 1..22: note = Synthetic Construct
  source 1..22: mol_type = other DNA
gcccctcctttctggagtgttt

SEQ ID NO: 15597 - DNA, 19 bp, synthetic construct
  misc_feature 1..19: note = Synthetic Construct
  source 1..19: mol_type = other DNA
agacggcctctggggcatt

SEQ ID NO: 15598 - DNA, 20 bp, synthetic construct
  misc_feature 1..20: note = Synthetic Construct
  source 1..20: mol_type = other DNA
ggtgggcaattgtggtgcat

SEQ ID NO: 15599 - DNA, 22 bp, synthetic construct
  misc_feature 1..22: note = Synthetic Construct
  source 1..22: mol_type = other DNA
ggaaatcatcctgccaccagta

SEQ ID NO: 15600 - DNA, 18 bp, synthetic construct
  misc_feature 1..18: note = Synthetic Construct
  source 1..18: mol_type = other DNA
tcggtggccttgggaaac

SEQ ID NO: 15601 - DNA, 26 bp, synthetic construct
  misc_feature 1..26: note = Synthetic Construct
  source 1..26: mol_type = other DNA
ccccaggcaattcaattcattcatca

SEQ ID NO: 15602 - DNA, 20 bp, synthetic construct
  misc_feature 1..20: note = Synthetic Construct
  source 1..20: mol_type = other DNA
agcttggctgggtgggtttt

SEQ ID NO: 15603 - DNA, 20 bp, synthetic construct
  misc_feature 1..20: note = Synthetic Construct
  source 1..20: mol_type = other DNA
agctccaggtctcagtgcat

SEQ ID NO: 15604 - DNA, 20 bp, synthetic construct
  misc_feature 1..20: note = Synthetic Construct
  source 1..20: mol_type = other DNA
aggtggcctgggaacctctt

SEQ ID NO: 15605 - DNA, 21 bp, synthetic construct
  misc_feature 1..21: note = Synthetic Construct
  source 1..21: mol_type = other DNA
ccagtttcgccctgctgaaga

SEQ ID NO: 15606 - DNA, 25 bp, synthetic construct
  misc_feature 1..25: note = Synthetic Construct
  source 1..25: mol_type = other DNA
gagttttcgagttccaagttccaat

SEQ ID NO: 15607 - DNA, 22 bp, synthetic construct
  misc_feature 1..22: note = Synthetic Construct
  source 1..22: mol_type = other DNA
ccagttcccggacatagacact

SEQ ID NO: 15608 - DNA, 22 bp, synthetic construct
  misc_feature 1..22: note = Synthetic Construct
  source 1..22: mol_type = other DNA
gtgtccagggtaaatggcaaga

SEQ ID NO: 15609 - DNA, 24 bp, synthetic construct
  misc_feature 1..24: note = Synthetic Construct
  source 1..24: mol_type = other DNA
ccacttccctgtggaagagctaga

SEQ ID NO: 15610 - DNA, 22 bp, synthetic construct
  misc_feature 1..22: note = Synthetic Construct
  source 1..22: mol_type = other DNA
gctcgcttttccttccgccatt

SEQ ID NO: 15611 - DNA, 24 bp, synthetic construct
  misc_feature 1..24: note = Synthetic Construct
  source 1..24: mol_type = other DNA
caggttttgccacagttagtgatg

SEQ ID NO: 15612 - DNA, 21 bp, synthetic construct
  misc_feature 1..21: note = Synthetic Construct
  source 1..21: mol_type = other DNA
tgggctcaagtgcctcctaga

SEQ ID NO: 15613 - DNA, 22 bp, synthetic construct
  misc_feature 1..22: note = Synthetic Construct
  source 1..22: mol_type = other DNA
gaacggaggcagtgagatcaag

SEQ ID NO: 15614 - DNA, 22 bp, synthetic construct
  misc_feature 1..22: note = Synthetic Construct
  source 1..22: mol_type = other DNA
ccccaccacagcatgaagatga

SEQ ID NO: 15615 - DNA, 22 bp, synthetic construct
  misc_feature 1..22: note = Synthetic Construct
  source 1..22: mol_type = other DNA
ggggccacaggtgctaatgaaa

SEQ ID NO: 15616 - DNA, 21 bp, synthetic construct
  misc_feature 1..21: note = Synthetic Construct
  source 1..21: mol_type = other DNA
ggtcacaaaacacgcgggaaa

SEQ ID NO: 15617 - DNA, 26 bp, synthetic construct
  misc_feature 1..26: note = Synthetic Construct
  source 1..26: mol_type = other DNA
gctgaggtgaccttctccagattttc

SEQ ID NO: 15618 - DNA, 24 bp, synthetic construct
  misc_feature 1..24: note = Synthetic Construct
  source 1..24: mol_type = other DNA
ggacccagaaacttgcacttaaac

SEQ ID NO: 15619 - DNA, 24 bp, synthetic construct
  misc_feature 1..24: note = Synthetic Construct
  source 1..24: mol_type = other DNA
gctgtagaagggaagttagcacaa

SEQ ID NO: 15620 - DNA, 22 bp, synthetic construct
  misc_feature 1..22: note = Synthetic Construct
  source 1..22: mol_type = other DNA
ctgctgtaagcctctgggacta

SEQ ID NO: 15621 - DNA, 21 bp, synthetic construct
  misc_feature 1..21: note = Synthetic Construct
  source 1..21: mol_type = other DNA
ccgtggaatgtggcgatctga

SEQ ID NO: 15622 - DNA, 23 bp, synthetic construct
  misc_feature 1..23: note = Synthetic Construct
  source 1..23: mol_type = other DNA
ctacaggtgctattgagctggaa

SEQ ID NO: 15623 - DNA, 22 bp, synthetic construct
  misc_feature 1..22: note = Synthetic Construct
  source 1..22: mol_type = other DNA
gggacataccactgagtgcaaa

SEQ ID NO: 15624 - DNA, 25 bp, synthetic construct
  misc_feature 1..25: note = Synthetic Construct
  source 1..25: mol_type = other DNA
ggggtcatatctctggacctatcat

SEQ ID NO: 15625 - DNA, 23 bp, synthetic construct
  misc_feature 1..23: note = Synthetic Construct
  source 1..23: mol_type = other DNA
tgctccagggtttttagcatttg

SEQ ID NO: 15626 - DNA, 24 bp, synthetic construct
  misc_feature 1..24: note = Synthetic Construct
  source 1..24: mol_type = other DNA
gctgtgggcagaactttgatctct

SEQ ID NO: 15627 - DNA, 22 bp, synthetic construct
  misc_feature 1..22: note = Synthetic Construct
  source 1..22: mol_type = other DNA
tgtcagatcgtggggccctaaa

SEQ ID NO: 15628 - DNA, 24 bp, synthetic construct
  misc_feature 1..24: note = Synthetic Construct
  source 1..24: mol_type = other DNA
ccacctatcaattcccagttggtt

SEQ ID NO: 15629 - DNA, 24 bp, synthetic construct
  misc_feature 1..24: note = Synthetic Construct
  source 1..24: mol_type = other DNA
cttgctacaatcagaccaccctta

SEQ ID NO: 15630 - DNA, 22 bp, synthetic construct
  misc_feature 1..22: note = Synthetic Construct
  source 1..22: mol_type = other DNA
tgctctgtcatcaggctgaatc

SEQ ID NO: 15631 - DNA, 20 bp, synthetic construct
  misc_feature 1..20: note = Synthetic Construct
  source 1..20: mol_type = other DNA
tgtccaactgcctgcacact

SEQ ID NO: 15632 - DNA, 24 bp, synthetic construct
  misc_feature 1..24: note = Synthetic Construct
  source 1..24: mol_type = other DNA
ccagcttcctctagtgacagattt

SEQ ID NO: 15633 - DNA, 21 bp, synthetic construct
  misc_feature 1..21: note = Synthetic Construct
  source 1..21: mol_type = other DNA
ccacgtacgccctctagtgaa

SEQ ID NO: 15634 - DNA, 24 bp, synthetic construct
  misc_feature 1..24: note = Synthetic Construct
  source 1..24: mol_type = other DNA
gccctacccattttgtgcaaggaa

SEQ ID NO: 15635 - DNA, 19 bp, synthetic construct
  misc_feature 1..19: note = Synthetic Construct
  source 1..19: mol_type = other DNA
cccgcgtctgtgctcttca

SEQ ID NO: 15636 - DNA, 22 bp, synthetic construct
  misc_feature 1..22: note = Synthetic Construct
  source 1..22: mol_type = other DNA
ccatgagctagagggtcctaca

SEQ ID NO: 15637 - DNA, 22 bp, synthetic construct
  misc_feature 1..22: note = Synthetic Construct
  source 1..22: mol_type = other DNA
gccaggactgtagaaccaggat

SEQ ID NO: 15638 - DNA, 19 bp, synthetic construct
  misc_feature 1..19: note = Synthetic Construct
  source 1..19: mol_type = other DNA
tgcctcagactggggatgt

SEQ ID NO: 15639 - DNA, 25 bp, synthetic construct
  misc_feature 1..25: note = Synthetic Construct
  source 1..25: mol_type = other DNA
gctctcacacatttacccaacagat

SEQ ID NO: 15640 - DNA, 21 bp, synthetic construct
  misc_feature 1..21: note = Synthetic Construct
  source 1..21: mol_type = other DNA
gcctgtcttctggaggtgtga

SEQ ID NO: 15641 - DNA, 19 bp, synthetic construct
  misc_feature 1..19: note = Synthetic Construct
  source 1..19: mol_type = other DNA
aaggcacgtggtggcagaa

SEQ ID NO: 15642 - DNA, 20 bp, synthetic construct
  misc_feature 1..20: note = Synthetic Construct
  source 1..20: mol_type = other DNA
ctgcaggctgtttggtctga

SEQ ID NO: 15643 - DNA, 22 bp, synthetic construct
  misc_feature 1..22: note = Synthetic Construct
  source 1..22: mol_type = other DNA
cgtggggacttcatgatggaaa

SEQ ID NO: 15644 - DNA, 22 bp, synthetic construct
  misc_feature 1..22: note = Synthetic Construct
  source 1..22: mol_type = other DNA
ctgggtgaagacggtgtgtcaa

SEQ ID NO: 15645 - DNA, 24 bp, synthetic construct
  misc_feature 1..24: note = Synthetic Construct
  source 1..24: mol_type = other DNA
gggaaagcaaacctacacacaaac

SEQ ID NO: 15646 - DNA, 19 bp, synthetic construct
  misc_feature 1..19: note = Synthetic Construct
  source 1..19: mol_type = other DNA
agaggctcgctggctgtga

SEQ ID NO: 15647 - DNA, 23 bp, synthetic construct
  misc_feature 1..23: note = Synthetic Construct
  source 1..23: mol_type = other DNA
ggtgcatttctggaacgaacaag

SEQ ID NO: 15648 - DNA, 23 bp, synthetic construct
  misc_feature 1..23: note = Synthetic Construct
  source 1..23: mol_type = other DNA
gggaagcttctagaggagccaat

SEQ ID NO: 15649 - DNA, 22 bp, synthetic construct
  misc_feature 1..22: note = Synthetic Construct
  source 1..22: mol_type = other DNA
cctgctggaaatgtggctaaga

SEQ ID NO: 15650 - DNA, 23 bp, synthetic construct
  misc_feature 1..23: note = Synthetic Construct
  source 1..23: mol_type = other DNA
agtggtgtgagagagatgtggaa

SEQ ID NO: 15651 - DNA, 22 bp, synthetic construct
  misc_feature 1..22: note = Synthetic Construct
  source 1..22: mol_type = other DNA
ctcccatctcatccccatgcaa

SEQ ID NO: 15652 - DNA, 26 bp, synthetic construct
  misc_feature 1..26: note = Synthetic Construct
  source 1..26: mol_type = other DNA
agaccgtaagcaatataccagtcttg

SEQ ID NO: 15653 - DNA, 23 bp, synthetic construct
  misc_feature 1..23: note = Synthetic Construct
  source 1..23: mol_type = other DNA
ctggggagggagtaacaagaaga

SEQ ID NO: 15654 - DNA, 27 bp, synthetic construct
  misc_feature 1..27: note = Synthetic Construct
  source 1..27: mol_type = other DNA
gaggtgatgggtgactatcctatcagt

SEQ ID NO: 15655 - DNA, 24 bp, synthetic construct
  misc_feature 1..24: note = Synthetic Construct
  source 1..24: mol_type = other DNA
gccttgaccacccatctagagtaa

SEQ ID NO: 15656 - DNA, 27 bp, synthetic construct
  misc_feature 1..27: note = Synthetic Construct
  source 1..27: mol_type = other DNA
catagttgtgtcttcattaggctgagt

SEQ ID NO: 15657 - DNA, 21 bp, synthetic construct
  misc_feature 1..21: note = Synthetic Construct
  source 1..21: mol_type = other DNA
tggcacctttaacccctctgt

SEQ ID NO: 15658 - DNA, 22 bp, synthetic construct
  misc_feature 1..22: note = Synthetic Construct
  source 1..22: mol_type = other DNA
aggcgtaaacacagtcaggaaa

SEQ ID NO: 15659 - DNA, 20 bp, synthetic construct
  misc_feature 1..20: note = Synthetic Construct
  source 1..20: mol_type = other DNA
ggcccaacagcccagaagat

SEQ ID NO: 15660 - DNA, 22 bp, synthetic construct
  misc_feature 1..22: note = Synthetic Construct
  source 1..22: mol_type = other DNA
ccctgtgagctgggccattttt

SEQ ID NO: 15661 - DNA, 22 bp, synthetic construct
  misc_feature 1..22: note = Synthetic Construct
  source 1..22: mol_type = other DNA
cgggagtctgacacatggaact

SEQ ID NO: 15662 - DNA, 26 bp, synthetic construct
  misc_feature 1..26: note = Synthetic Construct
  source 1..26: mol_type = other DNA
cctgaggtgaatgtactttgcaggtt

SEQ ID NO: 15663 - DNA, 19 bp, synthetic construct
  misc_feature 1..19: note = Synthetic Construct
  source 1..19: mol_type = other DNA
tggccagaactgggccata

SEQ ID NO: 15664 - DNA, 23 bp, synthetic construct
  misc_feature 1..23: note = Synthetic Construct
  source 1..23: mol_type = other DNA
ctgtctgcaagtaccacgttttc

SEQ ID NO: 15665 - DNA, 22 bp, synthetic construct
  misc_feature 1..22: note = Synthetic Construct
  source 1..22: mol_type = other DNA
ccagtttcctgctcctgacaag

SEQ ID NO: 15666 - DNA, 22 bp, synthetic construct
  misc_feature 1..22: note = Synthetic Construct
  source 1..22: mol_type = other DNA
attcttggccacaccaagctat

SEQ ID NO: 15667 - DNA, 25 bp, synthetic construct
  misc_feature 1..25: note = Synthetic Construct
  source 1..25: mol_type = other DNA
ctgcgatgtgtggtgaattttcttc

SEQ ID NO: 15668 - DNA, 21 bp, synthetic construct
  misc_feature 1..21: note = Synthetic Construct
  source 1..21: mol_type = other DNA
cctgggtctgatgctgcaatg

SEQ ID NO: 15669 - DNA, 22 bp, synthetic construct
  misc_feature 1..22: note = Synthetic Construct
  source 1..22: mol_type = other DNA
acgagagacccacggttcctaa

SEQ ID NO: 15670 - DNA, 23 bp, synthetic construct
  misc_feature 1..23: note = Synthetic Construct
  source 1..23: mol_type = other DNA
ggggccagatagtggagacattg

SEQ ID NO: 15671 - DNA, 22 bp, synthetic construct
  misc_feature 1..22: note = Synthetic Construct
  source 1..22: mol_type = other DNA
ccaggccagaagcattatcagt

SEQ ID NO: 15672 - DNA, 21 bp, synthetic construct
  misc_feature 1..21: note = Synthetic Construct
  source 1..21: mol_type = other DNA
acacacgccctctgacaccat

SEQ ID NO: 15673 - DNA, 25 bp, synthetic construct
  misc_feature 1..25: note = Synthetic Construct
  source 1..25: mol_type = other DNA
gctcagtctccagcaattagtcctt

SEQ ID NO: 15674 - DNA, 23 bp, synthetic construct
  misc_feature 1..23: note = Synthetic Construct
  source 1..23: mol_type = other DNA
ccaccttctggttgggaatgttt

SEQ ID NO: 15675 - DNA, 20 bp, synthetic construct
  misc_feature 1..20: note = Synthetic Construct
  source 1..20: mol_type = other DNA
agaccaccacccttgagact

SEQ ID NO: 15676 - DNA, 24 bp, synthetic construct
  misc_feature 1..24: note = Synthetic Construct
  source 1..24: mol_type = other DNA
ccacagtgcagttgtgcctaaaac

SEQ ID NO: 15677 - DNA, 22 bp, synthetic construct
  misc_feature 1..22: note = Synthetic Construct
  source 1..22: mol_type = other DNA
tccacccctgcagactaagcat

SEQ ID NO: 15678 - DNA, 20 bp, synthetic construct
  misc_feature 1..20: note = Synthetic Construct
  source 1..20: mol_type = other DNA
cttgccactccctgaacact

SEQ ID NO: 15679 - DNA, 22 bp, synthetic construct
  misc_feature 1..22: note = Synthetic Construct
  source 1..22: mol_type = other DNA
cgcacaatgggaggaaacaaaa

SEQ ID NO: 15680 - DNA, 22 bp, synthetic construct
  misc_feature 1..22: note = Synthetic Construct
  source 1..22: mol_type = other DNA
gcccaggaccaaactgtgaagt

SEQ ID NO: 15681 - DNA, 24 bp, synthetic construct
  misc_feature 1..24: note = Synthetic Construct
  source 1..24: mol_type = other DNA
gacctacctaagcccttctctttg

SEQ ID NO: 15682 - DNA, 22 bp, synthetic construct
  misc_feature 1..22: note = Synthetic Construct
  source 1..22: mol_type = other DNA
ggaggaactggacaggcattag

SEQ ID NO: 15683 - DNA, 23 bp, synthetic construct
  misc_feature 1..23: note = Synthetic Construct
  source 1..23: mol_type = other DNA
tggtagggagttgggtggtgaag

SEQ ID NO: 15684 - DNA, 21 bp, synthetic construct
  misc_feature 1..21: note = Synthetic Construct
  source 1..21: mol_type = other DNA
gctgcagtggaaagacgtaca

SEQ ID NO: 15685 - DNA, 26 bp, synthetic construct
  misc_feature 1..26: note = Synthetic Construct
  source 1..26: mol_type = other DNA
ccctgctacctgtgttcttccattac

SEQ ID NO: 15686 - DNA, 23 bp, synthetic construct
  misc_feature 1..23: note = Synthetic Construct
  source 1..23: mol_type = other DNA
ggtggcaccactttgaccaatac

SEQ ID NO: 15687 - DNA, 25 bp, synthetic construct
  misc_feature 1..25: note = Synthetic Construct
  source 1..25: mol_type = other DNA
tgggatttctcgttatcccatttct

SEQ ID NO: 15688 - DNA, 19 bp, synthetic construct
  misc_feature 1..19: note = Synthetic Construct
  source 1..19: mol_type = other DNA
gccgctgctgacagctaca

SEQ ID NO: 15689 - DNA, 20 bp, synthetic construct
  misc_feature 1..20: note = Synthetic Construct
  source 1..20: mol_type = other DNA
aagggcccctgcctgaggat

SEQ ID NO: 15690 - DNA, 25 bp, synthetic construct
  misc_feature 1..25: note = Synthetic Construct
  source 1..25: mol_type = other DNA
ggtacaaaagtgggcttctaagcta

SEQ ID NO: 15691 - DNA, 24 bp, synthetic construct
  misc_feature 1..24: note = Synthetic Construct
  source 1..24: mol_type = other DNA
ggccacttaaaatgctcaggctat

SEQ ID NO: 15692 - DNA, 24 bp, synthetic construct
  misc_feature 1..24: note = Synthetic Construct
  source 1..24: mol_type = other DNA
ctgctctgaggctgtagggaatca

SEQ ID NO: 15693 - DNA, 25 bp, synthetic construct
  misc_feature 1..25: note = Synthetic Construct
  source 1..25: mol_type = other DNA
gttgtgaagttacacctctctggtt

SEQ ID NO: 15694 - DNA, 20 bp, synthetic construct
  misc_feature 1..20: note = Synthetic Construct
  source 1..20: mol_type = other DNA
catgtcctgcctccaagcaa

SEQ ID NO: 15695 - DNA, 23 bp, synthetic construct
  misc_feature 1..23: note = Synthetic Construct
  source 1..23: mol_type = other DNA
agcctgaatgcaccaatgtatga

SEQ ID NO: 15696 - DNA, 22 bp, synthetic construct
  misc_feature 1..22: note = Synthetic Construct
  source 1..22: mol_type = other DNA
ggtctggctcacagtgaatctt

SEQ ID NO: 15697 - DNA, 23 bp, synthetic construct
  misc_feature 1..23: note = Synthetic Construct
  source 1..23: mol_type = other DNA
caccttctccttctgtgggtaca

SEQ ID NO: 15698 - DNA, 22 bp, synthetic construct
  misc_feature 1..22: note = Synthetic Construct
  source 1..22: mol_type = other DNA
gagaggggtaagtggagcagta

SEQ ID NO: 15699 - DNA, 22 bp, synthetic construct
  misc_feature 1..22: note = Synthetic Construct
  source 1..22: mol_type = other DNA
gggacctaaccatctccagact

SEQ ID NO: 15700 - DNA, 22 bp, synthetic construct
  misc_feature 1..22: note = Synthetic Construct
  source 1..22: mol_type = other DNA
cagctggggtctttcattcaca

SEQ ID NO: 15701 - DNA, 26 bp, synthetic construct
  misc_feature 1..26: note = Synthetic Construct
  source 1..26: mol_type = other DNA
gagctgagaccctttaactttactga

SEQ ID NO: 15702 - DNA, 25 bp, synthetic construct
  misc_feature 1..25: note = Synthetic Construct
  source 1..25: mol_type = other DNA
ccccaagataacctctccctctatc

SEQ ID NO: 15703 - DNA, 22 bp, synthetic construct
  misc_feature 1..22: note = Synthetic Construct
  source 1..22: mol_type = other DNA
tggcaaagtgaagggtgacatc

SEQ ID NO: 15704 - DNA, 22 bp, synthetic construct
  misc_feature 1..22: note = Synthetic Construct
  source 1..22: mol_type = other DNA
gcaggcaaaacacagaggtgat

SEQ ID NO: 15705 - DNA, 23 bp, synthetic construct
  misc_feature 1..23: note = Synthetic Construct
  source 1..23: mol_type = other DNA
aaacttgccaagacatcctcctt

SEQ ID NO: 15706 - DNA, 20 bp, synthetic construct
  misc_feature 1..20: note = Synthetic Construct
  source 1..20: mol_type = other DNA
gtcgggcaagagctttcact

SEQ ID NO: 15707 - DNA, 22 bp, synthetic construct
  misc_feature 1..22: note = Synthetic Construct
  source 1..22: mol_type = other DNA
tctgcttgcggtctctgctttc

SEQ ID NO: 15708 - DNA, 22 bp, synthetic construct
  misc_feature 1..22: note = Synthetic Construct
  source 1..22: mol_type = other DNA
gccccaactgtctttgttcttg

SEQ ID NO: 15709 - DNA, 24 bp, synthetic construct
  misc_feature 1..24: note = Synthetic Construct
  source 1..24: mol_type = other DNA
ccattccctctgagccaactacta

SEQ ID NO: 15710 - DNA, 22 bp, synthetic construct
  misc_feature 1..22: note = Synthetic Construct
  source 1..22: mol_type = other DNA
agagttcgatgcaaagccttct

SEQ ID NO: 15711 - DNA, 22 bp, synthetic construct
  misc_feature 1..22: note = Synthetic Construct
  source 1..22: mol_type = other DNA
tcactgtctctcctccctttca

SEQ ID NO: 15712 - DNA, 25 bp, synthetic construct
  misc_feature 1..25: note = Synthetic Construct
  source 1..25: mol_type = other DNA
ggcacagtgagaaggtagctgtttg

SEQ ID NO: 15713 - DNA, 27 bp, synthetic construct
  misc_feature 1..27: note = Synthetic Construct
  source 1..27: mol_type = other DNA
cagaacatatatccctgctctctcttt

SEQ ID NO: 15714 - DNA, 21 bp, synthetic construct
  misc_feature 1..21: note = Synthetic Construct
  source 1..21: mol_type = other DNA
tgagcagatggagctgtttgt

SEQ ID NO: 15715 - DNA, 22 bp, synthetic construct
  misc_feature 1..22: note = Synthetic Construct
  source 1..22: mol_type = other DNA
gcagccccgatagagattgact

SEQ ID NO: 15716 - DNA, 22 bp, synthetic construct
  misc_feature 1..22: note = Synthetic Construct
  source 1..22: mol_type = other DNA
ggggcctttttgtggggttaaa

SEQ ID NO: 15717 - DNA, 23 bp, synthetic construct
  misc_feature 1..23: note = Synthetic Construct
  source 1..23: mol_type = other DNA
accccaatccctgctaatactga

SEQ ID NO: 15718 - DNA, 21 bp, synthetic construct
  misc_feature 1..21: note = Synthetic Construct
  source 1..21: mol_type = other DNA
aagttgggctccctgggaaag

SEQ ID NO: 15719 - DNA, 23 bp, synthetic construct
  misc_feature 1..23: note = Synthetic Construct
  source 1..23: mol_type = other DNA
gcttcctcccaatattcccttca

SEQ ID NO: 15720 - DNA, 19 bp, synthetic construct
  misc_feature 1..19: note = Synthetic Construct
  source 1..19: mol_type = other DNA
accgggcaaccagccctat

SEQ ID NO: 15721 - DNA, 23 bp, synthetic construct
  misc_feature 1..23: note = Synthetic Construct
  source 1..23: mol_type = other DNA
aaaaccagcgtaatgaggactga

SEQ ID NO: 15722 - DNA, 21 bp, synthetic construct
  misc_feature 1..21: note = Synthetic Construct
  source 1..21: mol_type = other DNA
tggcagcatctctacctcaga

SEQ ID NO: 15723 - DNA, 24 bp, synthetic construct
  misc_feature 1..24: note = Synthetic Construct
  source 1..24: mol_type = other DNA
gccctggataggaatggttaggaa

SEQ ID NO: 15724 - DNA, 24 bp, synthetic construct
  misc_feature 1..24: note = Synthetic Construct
  source 1..24: mol_type = other DNA
cttggactgaaaggaagacactct

SEQ ID NO: 15725 - DNA, 21 bp, synthetic construct
  misc_feature 1..21: note = Synthetic Construct
  source 1..21: mol_type = other DNA
tctctgccggcgatgtctcta

SEQ ID NO: 15726 - DNA, 25 bp, synthetic construct
  misc_feature 1..25: note = Synthetic Construct
  source 1..25: mol_type = other DNA
cactgctcgggatgtaaagctattg

SEQ ID NO: 15727 - DNA, 22 bp, synthetic construct
  misc_feature 1..22: note = Synthetic Construct
  source 1..22: mol_type = other DNA
cagtggcctaaggtggaggtaa

SEQ ID NO: 15728 - DNA, 21 bp, synthetic construct
  misc_feature 1..21: note = Synthetic Construct
  source 1..21: mol_type = other DNA
agggcgcccagagatgaaaag

SEQ ID NO: 15729 - DNA, 23 bp, synthetic construct
  misc_feature 1..23: note = Synthetic Construct
  source 1..23: mol_type = other DNA
atcttggaccacaaacctcaagt

SEQ ID NO: 15730 - DNA, 23 bp, synthetic construct
  misc_feature 1..23: note = Synthetic Construct
  source 1..23: mol_type = other DNA
gttgtccttctccggttgcattc

SEQ ID NO: 15731 - DNA, 19 bp, synthetic construct
  misc_feature 1..19: note = Synthetic Construct
  source 1..19: mol_type = other DNA
gagcccaagggcaccaagt

SEQ ID NO: 15732 - DNA, 26 bp, synthetic construct
  misc_feature 1..26: note = Synthetic Construct
  source 1..26: mol_type = other DNA
gcaatcgactgaggtacttgggtaag

SEQ ID NO: 15733 - DNA, 24 bp, synthetic construct
  misc_feature 1..24: note = Synthetic Construct
  source 1..24: mol_type = other DNA
cgaggaggttactctgaccacact

SEQ ID NO: 15734 - DNA, 23 bp, synthetic construct
  misc_feature 1..23: note = Synthetic Construct
  source 1..23: mol_type = other DNA
ctaagacccaggacggagtcaga

SEQ ID NO: 15735 - DNA, 24 bp, synthetic construct
  misc_feature 1..24: note = Synthetic Construct
  source 1..24: mol_type = other DNA
gaacctgaaaaacagggtgtggat

SEQ ID NO: 15736 - DNA, 19 bp, synthetic construct
  misc_feature 1..19: note = Synthetic Construct
  source 1..19: mol_type = other DNA
aaggggtgcgtgagcaagt

SEQ ID NO: 15737 - DNA, 23 bp, synthetic construct
  misc_feature 1..23: note = Synthetic Construct
  source 1..23: mol_type = other DNA
acaggctttctacaacaggttca

SEQ ID NO: 15738 - DNA, 19 bp, synthetic construct
  misc_feature 1..19: note = Synthetic Construct
  source 1..19: mol_type = other DNA
ggggagcagtgtggacttg

SEQ ID NO: 15739 - DNA, 26 bp, synthetic construct
  misc_feature 1..26: note = Synthetic Construct
  source 1..26: mol_type = other DNA
gaggaagaatctatctgtaggcacaa

SEQ ID NO: 15740 - DNA, 23 bp, synthetic construct
  misc_feature 1..23: note = Synthetic Construct
  source 1..23: mol_type = other DNA
gcccaagaacaggccactctatg

SEQ ID NO: 15741 - DNA, 23 bp, synthetic construct
  misc_feature 1..23: note = Synthetic Construct
  source 1..23: mol_type = other DNA
cagagccacacgtcttgatttga

SEQ ID NO: 15742 - DNA, 20 bp, synthetic construct
  misc_feature 1..20: note = Synthetic Construct
  source 1..20: mol_type = other DNA
ggccaccaaggctgtgaaac

SEQ ID NO: 15743 - DNA, 20 bp, synthetic construct
  misc_feature 1..20: note = Synthetic Construct
  source 1..20: mol_type = other DNA
aatggtgccgtcacctgaga

SEQ ID NO: 15744 - DNA, 22 bp, synthetic construct
  misc_feature 1..22: note = Synthetic Construct
  source 1..22: mol_type = other DNA
gttcggaggtttgccagctttg

SEQ ID NO: 15745 - DNA, 25 bp, synthetic construct
  misc_feature 1..25: note = Synthetic Construct
  source 1..25: mol_type = other DNA
ctgggttcaggagcaactaagaaac

SEQ ID NO: 15746 - DNA, 21 bp, synthetic construct
  misc_feature 1..21: note = Synthetic Construct
  source 1..21: mol_type = other DNA
tctgtgttcccctccgtcttt

SEQ ID NO: 15747 - DNA, 22 bp, synthetic construct
  misc_feature 1..22: note = Synthetic Construct
  source 1..22: mol_type = other DNA
agccaccctctcccaagacaaa

SEQ ID NO: 15748 - DNA, 22 bp, synthetic construct
  misc_feature 1..22: note = Synthetic Construct
  source 1..22: mol_type = other DNA
cacagctctcatcacctacgaa

SEQ ID NO: 15749 - DNA, 20 bp, synthetic construct
  misc_feature 1..20: note = Synthetic Construct
  source 1..20: mol_type = other DNA
agggagctgcaggttcatgt

SEQ ID NO: 15750 - DNA, 24 bp, synthetic construct
  misc_feature 1..24: note = Synthetic Construct
  source 1..24: mol_type = other DNA
cctgcgaataacacgtttctgtag

SEQ ID NO: 15751 - DNA, 24 bp, synthetic construct
  misc_feature 1..24: note = Synthetic Construct
  source 1..24: mol_type = other DNA
ttccaatcccaaagcatctcttct

SEQ ID NO: 15752 - DNA, 22 bp, synthetic construct
  misc_feature 1..22: note = Synthetic Construct
  source 1..22: mol_type = other DNA
gccccgaattacagcttgttac

SEQ ID NO: 15753 - DNA, 21 bp, synthetic construct
  misc_feature 1..21: note = Synthetic Construct
  source 1..21: mol_type = other DNA
accaatcccgaggtgcctaag

SEQ ID NO: 15754 - DNA, 27 bp, synthetic construct
  misc_feature 1..27: note = Synthetic Construct
  source 1..27: mol_type = other DNA
cacactttatggaaatgcagagactga

SEQ ID NO: 15755 - DNA, 23 bp, synthetic construct
  misc_feature 1..23: note = Synthetic Construct
  source 1..23: mol_type = other DNA
agtgcctgctttgcatctacata

SEQ ID NO: 15756 - DNA, 25 bp, synthetic construct
  misc_feature 1..25: note = Synthetic Construct
  source 1..25: mol_type = other DNA
aagtatcggcgaaaatccctaatct

SEQ ID NO: 15757 - DNA, 23 bp, synthetic construct
  misc_feature 1..23: note = Synthetic Construct
  source 1..23: mol_type = other DNA
aagcactggatttcactgagaca

SEQ ID NO: 15758 - DNA, 22 bp, synthetic construct
  misc_feature 1..22: note = Synthetic Construct
  source 1..22: mol_type = other DNA
ggcagagaagccacatccaact

SEQ ID NO: 15759 - DNA, 20 bp, synthetic construct
  misc_feature 1..20: note = Synthetic Construct
  source 1..20: mol_type = other DNA
gccgaggaaaagctgacagt

SEQ ID NO: 15760 - DNA, 26 bp, synthetic construct
  misc_feature 1..26: note = Synthetic Construct
  source 1..26: mol_type = other DNA
cttctcaacctcagtactgtgctact

SEQ ID NO: 15761 - DNA, 22 bp, synthetic construct
  misc_feature 1..22: note = Synthetic Construct
  source 1..22: mol_type = other DNA
aggaagctaaactgcagagcat

SEQ ID NO: 15762 - DNA, 24 bp, synthetic construct
  misc_feature 1..24: note = Synthetic Construct
  source 1..24: mol_type = other DNA
cagtgaaacgatgaggcattgtga

SEQ ID NO: 15763 - DNA, 21 bp, synthetic construct
  misc_feature 1..21: note = Synthetic Construct
  source 1..21: mol_type = other DNA
tgtcatcaaccggccattcaa

SEQ ID NO: 15764 - DNA, 20 bp, synthetic construct
  misc_feature 1..20: note = Synthetic Construct
  source 1..20: mol_type = other DNA
ggcactgtagcttcccaagt

SEQ ID NO: 15765 - DNA, 26 bp, synthetic construct
  misc_feature 1..26: note = Synthetic Construct
  source 1..26: mol_type = other DNA
ggtgaaagtccagctaggagtaaatg

SEQ ID NO: 15766 - DNA, 21 bp, synthetic construct
  misc_feature 1..21: note = Synthetic Construct
  source 1..21: mol_type = other DNA
tcttgggccacctctgttact

SEQ ID NO: 15767 - DNA, 21 bp, synthetic construct
  misc_feature 1..21: note = Synthetic Construct
  source 1..21: mol_type = other DNA
ggacactggttcatggcattg

SEQ ID NO: 15768 - DNA, 22 bp, synthetic construct
  misc_feature 1..22: note = Synthetic Construct
  source 1..22: mol_type = other DNA
tttctctgctgtctccaagcaa

SEQ ID NO: 15769 - DNA, 21 bp, synthetic construct
  misc_feature 1..21: note = Synthetic Construct
  source 1..21: mol_type = other DNA
gtggataccccttgccgctta

SEQ ID NO: 15770 - DNA, 23 bp, synthetic construct
  misc_feature 1..23: note = Synthetic Construct
  source 1..23: mol_type = other DNA
ctagaaatcacgcggcatacaca

SEQ ID NO: 15771 - DNA, 24 bp, synthetic construct
  misc_feature 1..24: note = Synthetic Construct
  source 1..24: mol_type = other DNA
gccatgtaccgagaaccatctttg

SEQ ID NO: 15772 - DNA, 21 bp, synthetic construct
  misc_feature 1..21: note = Synthetic Construct
  source 1..21: mol_type = other DNA
gcgacccaaaggagtttgtct

SEQ ID NO: 15773 - DNA, 20 bp, synthetic construct
  misc_feature 1..20: note = Synthetic Construct
  source 1..20: mol_type = other DNA
acaagccccgagggatatga

SEQ ID NO: 15774 - DNA, 20 bp, synthetic construct
  misc_feature 1..20: note = Synthetic Construct
  source 1..20: mol_type = other DNA
atgcggggagtgaggaagtt

SEQ ID NO: 15775 - DNA, 21 bp, synthetic construct
  misc_feature 1..21: note = Synthetic Construct
  source 1..21: mol_type = other DNA
caagccccagctttgggaaga

SEQ ID NO: 15776 - DNA, 22 bp, synthetic construct
  misc_feature 1..22: note = Synthetic Construct
  source 1..22: mol_type = other DNA
ggctgtggggatatggggaaac

SEQ ID NO: 15777 - DNA, 22 bp, synthetic construct
  misc_feature 1..22: note = Synthetic Construct
  source 1..22: mol_type = other DNA
gaatggggttgcctggtcatct

SEQ ID NO: 15778 - DNA, 22 bp, synthetic construct
  misc_feature 1..22: note = Synthetic Construct
  source 1..22: mol_type = other DNA
gacgtggtaagtcccaggaagt

SEQ ID NO: 15779 - DNA, 22 bp, synthetic construct
  misc_feature 1..22: note = Synthetic Construct
  source 1..22: mol_type = other DNA
gagaaagtctggcgtcttcaca

SEQ ID NO: 15780 - DNA, 22 bp, synthetic construct
  misc_feature 1..22: note = Synthetic Construct
  source 1..22: mol_type = other DNA
catctctgcggctgcatctttg

SEQ ID NO: 15781 - DNA, 24 bp, synthetic construct
  misc_feature 1..24: note = Synthetic Construct
  source 1..24: mol_type = other DNA
ccttctatcctagcaagtgccaat

SEQ ID NO: 15782 - DNA, 25 bp, synthetic construct
  misc_feature 1..25: note = Synthetic Construct
  source 1..25: mol_type = other DNA
gggttcacagcttttagacgcatca

SEQ ID NO: 15783 - DNA, 20 bp, synthetic construct
  misc_feature 1..20: note = Synthetic Construct
  source 1..20: mol_type = other DNA
ggggagttgggaggatctga

SEQ ID NO: 15784 - DNA, 27 bp, synthetic construct
  misc_feature 1..27: note = Synthetic Construct
  source 1..27: mol_type = other DNA
gcccaatcagacaatgatccagagcta

SEQ ID NO: 15785 - DNA, 23 bp, synthetic construct
  misc_feature 1..23: note = Synthetic Construct
  source 1..23: mol_type = other DNA
tccccgcagaacgtctatttaac

SEQ ID NO: 15786 - DNA, 24 bp, synthetic construct
  misc_feature 1..24: note = Synthetic Construct
  source 1..24: mol_type = other DNA
tgtgcccaggctttattgatttct

SEQ ID NO: 15787 - DNA, 24 bp, synthetic construct
  misc_feature 1..24: note = Synthetic Construct
  source 1..24: mol_type = other DNA
caccttttccaagaagtgttgctt

SEQ ID NO: 15788 - DNA, 22 bp, synthetic construct
  misc_feature 1..22: note = Synthetic Construct
  source 1..22: mol_type = other DNA
tgcacgtggaggtctacagaga

SEQ ID NO: 15789 - DNA, 20 bp, synthetic construct
  misc_feature 1..20: note = Synthetic Construct
  source 1..20: mol_type = other DNA
agcagccacctgcgtacaaa

SEQ ID NO: 15790 - DNA, 19 bp, synthetic construct
  misc_feature 1..19: note = Synthetic Construct
  source 1..19: mol_type = other DNA
acgcaggcggctggatgtt

SEQ ID NO: 15791 - DNA, 20 bp, synthetic construct
  misc_feature 1..20: note = Synthetic Construct
  source 1..20: mol_type = other DNA
gagcactgtgtgccacctat

SEQ ID NO: 15792 - DNA, 20 bp, synthetic construct
  misc_feature 1..20: note = Synthetic Construct
  source 1..20: mol_type = other DNA
ctgttaggcggtgcttggat

SEQ ID NO: 15793 - DNA, 23 bp, synthetic construct
  misc_feature 1..23: note = Synthetic Construct
  source 1..23: mol_type = other DNA
ccgctccccagattcaacagttc

SEQ ID NO: 15794 - DNA, 21 bp, synthetic construct
  misc_feature 1..21: note = Synthetic Construct
  source 1..21: mol_type = other DNA
cgtgcagcgttttggatctgt

SEQ ID NO: 15795 - DNA, 25 bp, synthetic construct
  misc_feature 1..25: note = Synthetic Construct
  source 1..25: mol_type = other DNA
gtaaagattggggacttggggatta

SEQ ID NO: 15796 - DNA, 19 bp, synthetic construct
  misc_feature 1..19: note = Synthetic Construct
  source 1..19: mol_type = other DNA
tccaccgccctcctcactt

SEQ ID NO: 15797 - DNA, 24 bp, synthetic construct
  misc_feature 1..24: note = Synthetic Construct
  source 1..24: mol_type = other DNA
cagtcatcaagcctaactgagcat

SEQ ID NO: 15798 - DNA, 20 bp, synthetic construct
  misc_feature 1..20: note = Synthetic Construct
  source 1..20: mol_type = other DNA
cgcagtggccaatccacctt

SEQ ID NO: 15799 - DNA, 24 bp, synthetic construct
  misc_feature 1..24: note = Synthetic Construct
  source 1..24: mol_type = other DNA
ccctgtgactttgggtagcttttg

SEQ ID NO: 15800 - DNA, 23 bp, synthetic construct
  misc_feature 1..23: note = Synthetic Construct
  source 1..23: mol_type = other DNA
ggtgcattcacaggtgagtcatt

SEQ ID NO: 15801 - DNA, 22 bp, synthetic construct
  misc_feature 1..22: note = Synthetic Construct
  source 1..22: mol_type = other DNA
ccctccacacctggttgtcata

SEQ ID NO: 15802 - DNA, 23 bp, synthetic construct
  misc_feature 1..23: note = Synthetic Construct
  source 1..23: mol_type = other DNA
aagtagggaggtgtgagagacat

SEQ ID NO: 15803 - DNA, 22 bp, synthetic construct
  misc_feature 1..22: note = Synthetic Construct
  source 1..22: mol_type = other DNA
tccccactcctttgacctgaga

SEQ ID NO: 15804 - DNA, 18 bp, synthetic construct
  misc_feature 1..18: note = Synthetic Construct
  source 1..18: mol_type = other DNA
gctgccggctacgaaaga

SEQ ID NO: 15805 - DNA, 24 bp, synthetic construct
  misc_feature 1..24: note = Synthetic Construct
  source 1..24: mol_type = other DNA
gcagaggtatttcagacccgctat

SEQ ID NO: 15806 - DNA, 20 bp, synthetic construct
  misc_feature 1..20: note = Synthetic Construct
  source 1..20: mol_type = other DNA
gatttgcccggccctctact

SEQ ID NO: 15807 - DNA, 24 bp, synthetic construct
  misc_feature 1..24: note = Synthetic Construct
  source 1..24: mol_type = other DNA
tgcacttccttactctccttgaac

SEQ ID NO: 15808 - DNA, 22 bp, synthetic construct
  misc_feature 1..22: note = Synthetic Construct
  source 1..22: mol_type = other DNA
cattggtgggtatgggtgttct

SEQ ID NO: 15809 - DNA, 27 bp, synthetic construct
  misc_feature 1..27: note = Synthetic Construct
  source 1..27: mol_type = other DNA
ggaactcaaagcatagcctcctcattt

SEQ ID NO: 15810 - DNA, 22 bp, synthetic construct
  misc_feature 1..22: note = Synthetic Construct
  source 1..22: mol_type = other DNA
tgggcttcagagacaagcctat

SEQ ID NO: 15811 - DNA, 22 bp, synthetic construct
  misc_feature 1..22: note = Synthetic Construct
  source 1..22: mol_type = other DNA
cctggagcaaacccgtttgtga

SEQ ID NO: 15812 - DNA, 24 bp, synthetic construct
  misc_feature 1..24: note = Synthetic Construct
  source 1..24: mol_type = other DNA
gcaagcactaccacttcccaaaag

SEQ ID NO: 15813 - DNA, 26 bp, synthetic construct
  misc_feature 1..26: note = Synthetic Construct
  source 1..26: mol_type = other DNA
ggaataatgcccgtggaccttaagaa

SEQ ID NO: 15814 - DNA, 22 bp, synthetic construct
  misc_feature 1..22: note = Synthetic Construct
  source 1..22: mol_type = other DNA
cactgcagcctcaacctcttca

SEQ ID NO: 15815 - DNA, 21 bp, synthetic construct
  misc_feature 1..21: note = Synthetic Construct
  source 1..21: mol_type = other DNA
gcaaagctcctactgctcact

SEQ ID NO: 15816 - DNA, 22 bp, synthetic construct
  misc_feature 1..22: note = Synthetic Construct
  source 1..22: mol_type = other DNA
tccaatccaaggttggctgaat

SEQ ID NO: 15817 - DNA, 22 bp, synthetic construct
  misc_feature 1..22: note = Synthetic Construct
  source 1..22: mol_type = other DNA
cctctgttggtgaggtgctaag

SEQ ID NO: 15818 - DNA, 20 bp, synthetic construct
  misc_feature 1..20: note = Synthetic Construct
  source 1..20: mol_type = other DNA
gctgacagtggctcctgaga

SEQ ID NO: 15819 - DNA, 22 bp, synthetic construct
  misc_feature 1..22: note = Synthetic Construct
  source 1..22: mol_type = other DNA
tggccttccatgctcaaagaac

SEQ ID NO: 15820 - DNA, 20 bp, synthetic construct
  misc_feature 1..20: note = Synthetic Construct
  source 1..20: mol_type = other DNA
acacgtgcatgcgacactca

SEQ ID NO: 15821 - DNA, 24 bp, synthetic construct
  misc_feature 1..24: note = Synthetic Construct
  source 1..24: mol_type = other DNA
cagtttcagtcctctgctggactt

SEQ ID NO: 15822 - DNA, 24 bp, synthetic construct
  misc_feature 1..24: note = Synthetic Construct
  source 1..24: mol_type = other DNA
tggtcatatcgcttctcctctttg

SEQ ID NO: 15823 - DNA, 20 bp, synthetic construct
  misc_feature 1..20: note = Synthetic Construct
  source 1..20: mol_type = other DNA
acaggcaccgagaggatgaa

SEQ ID NO: 15824 - DNA, 25 bp, synthetic construct
  misc_feature 1..25: note = Synthetic Construct
  source 1..25: mol_type = other DNA
caccaagccgatgaaattgatcttg

SEQ ID NO: 15825 - DNA, 22 bp, synthetic construct
  misc_feature 1..22: note = Synthetic Construct
  source 1..22: mol_type = other DNA
gacctgcaagatgcccagtaag

SEQ ID NO: 15826 - DNA, 22 bp, synthetic construct
  misc_feature 1..22: note = Synthetic Construct
  source 1..22: mol_type = other DNA
cccagcacccttgcctgattta

SEQ ID NO: 15827 - DNA, 24 bp, synthetic construct
  misc_feature 1..24: note = Synthetic Construct
  source 1..24: mol_type = other DNA
gcctccttctgttgactattctgt

SEQ ID NO: 15828 - DNA, 21 bp, synthetic construct
  misc_feature 1..21: note = Synthetic Construct
  source 1..21: mol_type = other DNA
gcttgggcaggcatttctctt

SEQ ID NO: 15829 - DNA, 20 bp, synthetic construct
  misc_feature 1..20: note = Synthetic Construct
  source 1..20: mol_type = other DNA
agaccgtcagcaggatcaca

SEQ ID NO: 15830 - DNA, 23 bp, synthetic construct
  misc_feature 1..23: note = Synthetic Construct
  source 1..23: mol_type = other DNA
cctcgttgagtagtttggcattg

SEQ ID NO: 15831 - DNA, 24 bp, synthetic construct
  misc_feature 1..24: note = Synthetic Construct
  source 1..24: mol_type = other DNA
gagagctgcaagtcatcctcattc

SEQ ID NO: 15832 - DNA, 22 bp, synthetic construct
  misc_feature 1..22: note = Synthetic Construct
  source 1..22: mol_type = other DNA
agggaaatccagccttctcctt

SEQ ID NO: 15833 - DNA, 22 bp, synthetic construct
  misc_feature 1..22: note = Synthetic Construct
  source 1..22: mol_type = other DNA
tggcttatgctctgagggtcta

SEQ ID NO: 15834 - DNA, 24 bp, synthetic construct
  misc_feature 1..24: note = Synthetic Construct
  source 1..24: mol_type = other DNA
ggggtgccgtagtgatcagtagat

SEQ ID NO: 15835 - DNA, 20 bp, synthetic construct
  misc_feature 1..20: note = Synthetic Construct
  source 1..20: mol_type = other DNA
agagcctggcactgggtatt

SEQ ID NO: 15836 - DNA, 23 bp, synthetic construct
  misc_feature 1..23: note = Synthetic Construct
  source 1..23: mol_type = other DNA
gtgagcttggctcaaatccatga

SEQ ID NO: 15837 - DNA, 24 bp, synthetic construct
  misc_feature 1..24: note = Synthetic Construct
  source 1..24: mol_type = other DNA
cagtttcctctggcacctttgttc

SEQ ID NO: 15838 - DNA, 23 bp, synthetic construct
  misc_feature 1..23: note = Synthetic Construct
  source 1..23: mol_type = other DNA
gacgtaaagctgggaaaccttct

SEQ ID NO: 15839 - DNA, 19 bp, synthetic construct
  misc_feature 1..19: note = Synthetic Construct
  source 1..19: mol_type = other DNA
cacatcaccggacgccttt

SEQ ID NO: 15840 - DNA, 25 bp, synthetic construct
  misc_feature 1..25: note = Synthetic Construct
  source 1..25: mol_type = other DNA
ccttgacagcaaattcaggacaact

SEQ ID NO: 15841 - DNA, 24 bp, synthetic construct
  misc_feature 1..24: note = Synthetic Construct
  source 1..24: mol_type = other DNA
ggtttggcacaggatgaagcaaga

SEQ ID NO: 15842 - DNA, 23 bp, synthetic construct
  misc_feature 1..23: note = Synthetic Construct
  source 1..23: mol_type = other DNA
ccacaggccctcataagcctcta

SEQ ID NO: 15843 - DNA, 22 bp, synthetic construct
  misc_feature 1..22: note = Synthetic Construct
  source 1..22: mol_type = other DNA
ccagggcaaaacagaggtccat

SEQ ID NO: 15844 - DNA, 21 bp, synthetic construct
  misc_feature 1..21: note = Synthetic Construct
  source 1..21: mol_type = other DNA
gggcgtctacgatcactgaaa

SEQ ID NO: 15845 - DNA, 19 bp, synthetic construct
  misc_feature 1..19: note = Synthetic Construct
  source 1..19: mol_type = other DNA
tgctgcccacctggcattt

SEQ ID NO: 15846 - DNA, 21 bp, synthetic construct
  misc_feature 1..21: note = Synthetic Construct
  source 1..21: mol_type = other DNA
tgcgcacatgactcctctagt

SEQ ID NO: 15847 - DNA, 25 bp, synthetic construct
  misc_feature 1..25: note = Synthetic Construct
  source 1..25: mol_type = other DNA
gcagatggaatcagcatctctcgat

SEQ ID NO: 15848 - DNA, 22 bp, synthetic construct
  misc_feature 1..22: note = Synthetic Construct
  source 1..22: mol_type = other DNA
gctgggctatgtggcttcagat

SEQ ID NO: 15849 - DNA, 22 bp, synthetic construct
  misc_feature 1..22: note = Synthetic Construct
  source 1..22: mol_type = other DNA
tgtgcttggcttaggctagagt

SEQ ID NO: 15850 - DNA, 23 bp, synthetic construct
  misc_feature 1..23: note = Synthetic Construct
  source 1..23: mol_type = other DNA
aggcagggactggaggtagaaag

SEQ ID NO: 15851 - DNA, 22 bp, synthetic construct
  misc_feature 1..22: note = Synthetic Construct
  source 1..22: mol_type = other DNA
ggactctgtctcagtggaggtt

SEQ ID NO: 15852 - DNA, 19 bp, synthetic construct
  misc_feature 1..19: note = Synthetic Construct
  source 1..19: mol_type = other DNA
tggtgcggtcacccgtgtt

SEQ ID NO: 15853 - DNA, 22 bp, synthetic construct
  misc_feature 1..22: note = Synthetic Construct
  source 1..22: mol_type = other DNA
ggccctatcccttgagagttgt

SEQ ID NO: 15854 - DNA, 21 bp, synthetic construct
  misc_feature 1..21: note = Synthetic Construct
  source 1..21: mol_type = other DNA
atgcccttgagggaggtgttg

SEQ ID NO: 15855 - DNA, 24 bp, synthetic construct
  misc_feature 1..24: note = Synthetic Construct
  source 1..24: mol_type = other DNA
cctcagaacgatgagggaatgaac

SEQ ID NO: 15856 - DNA, 22 bp, synthetic construct
  misc_feature 1..22: note = Synthetic Construct
  source 1..22: mol_type = other DNA
ggccacaagaatcccaatctca

SEQ ID NO: 15857 - DNA, 24 bp, synthetic construct
  misc_feature 1..24: note = Synthetic Construct
  source 1..24: mol_type = other DNA
aagttcgaggctcactacttttct

SEQ ID NO: 15858 - DNA, 24 bp, synthetic construct
  misc_feature 1..24: note = Synthetic Construct
  source 1..24: mol_type = other DNA
ggggatctggggagtatctggtat

SEQ ID NO: 15859 - DNA, 24 bp, synthetic construct
  misc_feature 1..24: note = Synthetic Construct
  source 1..24: mol_type = other DNA
gggtaaggcagagatgtgaactgt

SEQ ID NO: 15860 - DNA, 20 bp, synthetic construct
  misc_feature 1..20: note = Synthetic Construct
  source 1..20: mol_type = other DNA
ccgcttccttgcctgggaat

SEQ ID NO: 15861 - DNA, 22 bp, synthetic construct
  misc_feature 1..22: note = Synthetic Construct
  source 1..22: mol_type = other DNA
cccattgaggagggctttttga

SEQ ID NO: 15862 - DNA, 24 bp, synthetic construct
  misc_feature 1..24: note = Synthetic Construct
  source 1..24: mol_type = other DNA
gacaggacagcagtgtcaatggtt

SEQ ID NO: 15863 - DNA, 25 bp, synthetic construct
  misc_feature 1..25: note = Synthetic Construct
  source 1..25: mol_type = other DNA
gctcttttggtacccggaactctac

SEQ ID NO: 15864 - DNA, 20 bp, synthetic construct
  misc_feature 1..20: note = Synthetic Construct
  source 1..20: mol_type = other DNA
ctcacagcctgacagctgaa

SEQ ID NO: 15865 - DNA, 24 bp, synthetic construct
  misc_feature 1..24: note = Synthetic Construct
  source 1..24: mol_type = other DNA
gagcaggtcagtctccagatcctt

SEQ ID NO: 15866 - DNA, 22 bp, synthetic construct
  misc_feature 1..22: note = Synthetic Construct
  source 1..22: mol_type = other DNA
ggcttgtcctgaatgccaggta

SEQ ID NO: 15867 - DNA, 21 bp, synthetic construct
  misc_feature 1..21: note = Synthetic Construct
  source 1..21: mol_type = other DNA
ccaccctgagctcttcctgtt

SEQ ID NO: 15868 - DNA, 23 bp, synthetic construct
  misc_feature 1..23: note = Synthetic Construct
  source 1..23: mol_type = other DNA
gggctttctcagacttcagagtt

SEQ ID NO: 15869 - DNA, 24 bp, synthetic construct
  misc_feature 1..24: note = Synthetic Construct
  source 1..24: mol_type = other DNA
gacccatgaagggaggacactttg

SEQ ID NO: 15870 - DNA, 21 bp, synthetic construct
  misc_feature 1..21: note = Synthetic Construct
  source 1..21: mol_type = other DNA
tgagcacagcttcagaccaat

SEQ ID NO: 15871 - DNA, 23 bp, synthetic construct
  misc_feature 1..23: note = Synthetic Construct
  source 1..23: mol_type = other DNA
ggaagcatggtgaactgcacatt

SEQ ID NO: 15872 - DNA, 22 bp, synthetic construct
  misc_feature 1..22: note = Synthetic Construct
  source 1..22: mol_type = other DNA
ctggaggtctctccactgcttt

SEQ ID NO: 15873 - DNA, 25 bp, synthetic construct
  misc_feature 1..25: note = Synthetic Construct
  source 1..25: mol_type = other DNA
ttgggtaatgctcgctatgtctaat

SEQ ID NO: 15874 - DNA, 24 bp, synthetic construct
  misc_feature 1..24: note = Synthetic Construct
  source 1..24: mol_type = other DNA
ctcctgtgaatctcatccctttca

SEQ ID NO: 15875 - DNA, 21 bp, synthetic construct
  misc_feature 1..21: note = Synthetic Construct
  source 1..21: mol_type = other DNA
cccagggaatacagccagcat

SEQ ID NO: 15876 - DNA, 24 bp, synthetic construct
  misc_feature 1..24: note = Synthetic Construct
  source 1..24: mol_type = other DNA
catatgcccttatgcctggattct

SEQ ID NO: 15877 - DNA, 24 bp, synthetic construct
  misc_feature 1..24: note = Synthetic Construct
  source 1..24: mol_type = other DNA
gctgaagccaagggaagaggagaa

SEQ ID NO: 15878 - DNA, 21 bp, synthetic construct
  misc_feature 1..21: note = Synthetic Construct
  source 1..21: mol_type = other DNA
agccagtagctgccctgagaa

SEQ ID NO: 15879 - DNA, 24 bp, synthetic construct
  misc_feature 1..24: note = Synthetic Construct
  source 1..24: mol_type = other DNA
ccagaacctggccatctcttccat

SEQ ID NO: 15880 - DNA, 23 bp, synthetic construct
  misc_feature 1..23: note = Synthetic Construct
  source 1..23: mol_type = other DNA
cccgataagcgtctgatggaaac

SEQ ID NO: 15881 - DNA, 24 bp, synthetic construct
  misc_feature 1..24: note = Synthetic Construct
  source 1..24: mol_type = other DNA
ccttgaggcaaacacactgctact

SEQ ID NO: 15882 - DNA, 22 bp, synthetic construct
  misc_feature 1..22: note = Synthetic Construct
  source 1..22: mol_type = other DNA
tccaggcttcatggcactccta

SEQ ID NO: 15883 - DNA, 26 bp, synthetic construct
  misc_feature 1..26: note = Synthetic Construct
  source 1..26: mol_type = other DNA
cagagccccgttactctttcttgtag

SEQ ID NO: 15884 - DNA, 22 bp, synthetic construct
  misc_feature 1..22: note = Synthetic Construct
  source 1..22: mol_type = other DNA
ggggaagggagattggtagaga

SEQ ID NO: 15885 - DNA, 24 bp, synthetic construct
  misc_feature 1..24: note = Synthetic Construct
  source 1..24: mol_type = other DNA
ccgagcctttgtttcactctgttc

SEQ ID NO: 15886 - DNA, 24 bp, synthetic construct
  misc_feature 1..24: note = Synthetic Construct
  source 1..24: mol_type = other DNA
gggtttgtcttaccttcagcttct

SEQ ID NO: 15887 - DNA, 25 bp, synthetic construct
  misc_feature 1..25: note = Synthetic Construct
  source 1..25: mol_type = other DNA
tcagccagcaatgttaaaagacaag

SEQ ID NO: 15888 - DNA, 25 bp, synthetic construct
  misc_feature 1..25: note = Synthetic Construct
  source 1..25: mol_type = other DNA
ggtatcgttctaagcagggaaaaga

SEQ ID NO: 15889 - DNA, 21 bp, synthetic construct
  misc_feature 1..21: note = Synthetic Construct
  source 1..21: mol_type = other DNA
gcaggcctaacttggagaact

SEQ ID NO: 15890 - DNA, 22 bp, synthetic construct
  misc_feature 1..22: note = Synthetic Construct
  source 1..22: mol_type = other DNA
aggacagcaggtcaggaacctt

SEQ ID NO: 15891 - DNA, 24 bp, synthetic construct
  misc_feature 1..24: note = Synthetic Construct
  source 1..24: mol_type = other DNA
ccaggtgatctgccaacctattct

SEQ ID NO: 15892 - DNA, 25 bp, synthetic construct
  misc_feature 1..25: note = Synthetic Construct
  source 1..25: mol_type = other DNA
gacttctgttacatgcccctcactt

SEQ ID NO: 15893 - DNA, 25 bp, synthetic construct
  misc_feature 1..25: note = Synthetic Construct
  source 1..25: mol_type = other DNA
ggcaggaaacctgtagatgggagta

SEQ ID NO: 15894 - DNA, 25 bp, synthetic construct
  misc_feature 1..25: note = Synthetic Construct
  source 1..25: mol_type = other DNA
gctggggaagagtctgtagacttag

SEQ ID NO: 15895 - DNA, 25 bp, synthetic construct
  misc_feature 1..25: note = Synthetic Construct
  source 1..25: mol_type = other DNA
gcataatgaagccattcccaacctt

SEQ ID NO: 15896 - DNA, 24 bp, synthetic construct
  misc_feature 1..24: note = Synthetic Construct
  source 1..24: mol_type = other DNA
ccaggaccacagttggaatcctat

SEQ ID NO: 15897 - DNA, 20 bp, synthetic construct
  misc_feature 1..20: note = Synthetic Construct
  source 1..20: mol_type = other DNA
aggagtggcacctcccaaga

SEQ ID NO: 15898 - DNA, 24 bp, synthetic construct
  misc_feature 1..24: note = Synthetic Construct
  source 1..24: mol_type = other DNA
gtactaagacgaagcgaggtccat

SEQ ID NO: 15899 - DNA, 24 bp, synthetic construct
  misc_feature 1..24: note = Synthetic Construct
  source 1..24: mol_type = other DNA
gtgcttggaaatgggctaaattgt

SEQ ID NO: 15900 - DNA, 21 bp, synthetic construct
  misc_feature 1..21: note = Synthetic Construct
  source 1..21: mol_type = other DNA
agggtcgggctgctgatgtta

SEQ ID NO: 15901 - DNA, 26 bp, synthetic construct
  misc_feature 1..26: note = Synthetic Construct
  source 1..26: mol_type = other DNA
gggaattgccctgagcaaatactaac

SEQ ID NO: 15902 - DNA, 20 bp, synthetic construct
  misc_feature 1..20: note = Synthetic Construct
  source 1..20: mol_type = other DNA
gccagctcaaaggccataca

SEQ ID NO: 15903 - DNA, 25 bp, synthetic construct
  misc_feature 1..25: note = Synthetic Construct
  source 1..25: mol_type = other DNA
ggagtttcttggcaaaggagctatg

SEQ ID NO: 15904 - DNA, 20 bp, synthetic construct
  misc_feature 1..20: note = Synthetic Construct
  source 1..20: mol_type = other DNA
cgtggccaggacctttcaca

SEQ ID NO: 15905 - DNA, 23 bp, synthetic construct
  misc_feature 1..23: note = Synthetic Construct
  source 1..23: mol_type = other DNA
accgaggtttaaagaaggcaagt

SEQ ID NO: 15906 - DNA, 21 bp, synthetic construct
  misc_feature 1..21: note = Synthetic Construct
  source 1..21: mol_type = other DNA
aaggcaggaatgttgcagcta

SEQ ID NO: 15907 - DNA, 20 bp, synthetic construct
  misc_feature 1..20: note = Synthetic Construct
  source 1..20: mol_type = other DNA
gccgagaaatgcggccaaga

SEQ ID NO: 15908 - DNA, 22 bp, synthetic construct
  misc_feature 1..22: note = Synthetic Construct
  source 1..22: mol_type = other DNA
aggaggggtacagatgcccaaa

SEQ ID NO: 15909 - DNA, 20 bp, synthetic construct
  misc_feature 1..20: note = Synthetic Construct
  source 1..20: mol_type = other DNA
ccccgctgtttcccttcatt

SEQ ID NO: 15910 - DNA, 23 bp, synthetic construct
  misc_feature 1..23: note = Synthetic Construct
  source 1..23: mol_type = other DNA
acactgtccttgactcctttgtt

SEQ ID NO: 15911 - DNA, 26 bp, synthetic construct
  misc_feature 1..26: note = Synthetic Construct
  source 1..26: mol_type = other DNA
ggtgactaagcagcaattccctttac

SEQ ID NO: 15912 - DNA, 27 bp, synthetic construct
  misc_feature 1..27: note = Synthetic Construct
  source 1..27: mol_type = other DNA
gtgtcctacttcaggaaggaatgttca

SEQ ID NO: 15913 - DNA, 23 bp, synthetic construct
  misc_feature 1..23: note = Synthetic Construct
  source 1..23: mol_type = other DNA
gttgccagcacagtcaagctttt

SEQ ID NO: 15914 - DNA, 20 bp, synthetic construct
  misc_feature 1..20: note = Synthetic Construct
  source 1..20: mol_type = other DNA
atgcccatggagacgcatgt

SEQ ID NO: 15915 - DNA, 24 bp, synthetic construct
  misc_feature 1..24: note = Synthetic Construct
  source 1..24: mol_type = other DNA
gcccagaacccactgaaattattc

SEQ ID NO: 15916 - DNA, 22 bp, synthetic construct
  misc_feature 1..22: note = Synthetic Construct
  source 1..22: mol_type = other DNA
gaggggttgatgagagcaaagt

SEQ ID NO: 15917 - DNA, 27 bp, synthetic construct
  misc_feature 1..27: note = Synthetic Construct
  source 1..27: mol_type = other DNA
gccggcattaaaagtccatatctaagt

SEQ ID NO: 15918 - DNA, 26 bp, synthetic construct
  misc_feature 1..26: note = Synthetic Construct
  source 1..26: mol_type = other DNA
ctgtgcaaacatcaagggattagaag

SEQ ID NO: 15919 - DNA, 22 bp, synthetic construct
  misc_feature 1..22: note = Synthetic Construct
  source 1..22: mol_type = other DNA
cagcaagctcagctggggaaaa

SEQ ID NO: 15920 - DNA, 23 bp, synthetic construct
  misc_feature 1..23: note = Synthetic Construct
  source 1..23: mol_type = other DNA
catgtctctgggaagttgcatgt

SEQ ID NO: 15921 - DNA, 22 bp, synthetic construct
  misc_feature 1..22: note = Synthetic Construct
  source 1..22: mol_type = other DNA
ctctgcaaacccaggcaggtat

SEQ ID NO: 15922 - DNA, 21 bp, synthetic construct
  misc_feature 1..21: note = Synthetic Construct
  source 1..21: mol_type = other DNA
aggaggttggtgaggcagact

SEQ ID NO: 15923 - DNA, 21 bp, synthetic construct
  misc_feature 1..21: note = Synthetic Construct
  source 1..21: mol_type = other DNA
tctgcccttcgcatagacctt

SEQ ID NO: 15924 - DNA, 22 bp, synthetic construct
  misc_feature 1..22: note = Synthetic Construct
  source 1..22: mol_type = other DNA
caccttgattggcaggttgact

SEQ ID NO: 15925 - DNA, 20 bp, synthetic construct
  misc_feature 1..20: note = Synthetic Construct
  source 1..20: mol_type = other DNA
cagtgcgttaggccctgaga

SEQ ID NO: 15926 - DNA, 23 bp, synthetic construct
  misc_feature 1..23: note = Synthetic Construct
  source 1..23: mol_type = other DNA
gctctccacattgattggcttca

SEQ ID NO: 15927 - DNA, 22 bp, synthetic construct
  misc_feature 1..22: note = Synthetic Construct
  source 1..22: mol_type = other DNA
ggcatggtgaccaatgggttgt

SEQ ID NO: 15928 - DNA, 24 bp, synthetic construct
  misc_feature 1..24: note = Synthetic Construct
  source 1..24: mol_type = other DNA
gctcctctcatcatttcggtatca

SEQ ID NO: 15929 - DNA, 22 bp, synthetic construct
  misc_feature 1..22: note = Synthetic Construct
  source 1..22: mol_type = other DNA
ggcctcaggctaagttctttct

SEQ ID NO: 15930 - DNA, 19 bp, synthetic construct
  misc_feature 1..19: note = Synthetic Construct
  source 1..19: mol_type = other DNA
acagcagtgttgccaccat

SEQ ID NO: 15931 - DNA, 24 bp, synthetic construct
  misc_feature 1..24: note = Synthetic Construct
  source 1..24: mol_type = other DNA
ctgtgttaaccgtgtgatgactct

SEQ ID NO: 15932 - DNA, 24 bp, synthetic construct
  misc_feature 1..24: note = Synthetic Construct
  source 1..24: mol_type = other DNA
ccatcaagatggctcctcgcattt

SEQ ID NO: 15933 - DNA, 24 bp, synthetic construct
  misc_feature 1..24: note = Synthetic Construct
  source 1..24: mol_type = other DNA
ccactctgtctgaaacgtgttact

SEQ ID NO: 15934 - DNA, 29 bp, synthetic construct
  misc_feature 1..29: note = Synthetic Construct
  source 1..29: mol_type = other DNA
gggcttgaaatgcaatatccctttcttga

SEQ ID NO: 15935 - DNA, 24 bp, synthetic construct
  misc_feature 1..24: note = Synthetic Construct
  source 1..24: mol_type = other DNA
cctcacgaattcacaaggagacta

SEQ ID NO: 15936 - DNA, 23 bp, synthetic construct
  misc_feature 1..23: note = Synthetic Construct
  source 1..23: mol_type = other DNA
ggcttaggtcaatgccatcaaga

SEQ ID NO: 15937 - DNA, 22 bp, synthetic construct
  misc_feature 1..22: note = Synthetic Construct
  source 1..22: mol_type = other DNA
cattcagcaccccacacacatt

SEQ ID NO: 15938 - DNA, 21 bp, synthetic construct
  misc_feature 1..21: note = Synthetic Construct
  source 1..21: mol_type = other DNA
tggggtcaggggaatgtggat

SEQ ID NO: 15939 - DNA, 22 bp, synthetic construct
  misc_feature 1..22: note = Synthetic Construct
  source 1..22: mol_type = other DNA
ctctcccttgtgggttgtgctt

SEQ ID NO: 15940 - DNA, 21 bp, synthetic construct
  misc_feature 1..21: note = Synthetic Construct
  source 1..21: mol_type = other DNA
ccccgtgttcttcccttcagt

SEQ ID NO: 15941 - DNA, 21 bp, synthetic construct
  misc_feature 1..21: note = Synthetic Construct
  source 1..21: mol_type = other DNA
gcaggtggcgttagagcacat

SEQ ID NO: 15942 - DNA, 23 bp, synthetic construct
  misc_feature 1..23: note = Synthetic Construct
  source 1..23: mol_type = other DNA
accagctgccaaaacattaggat

SEQ ID NO: 15943 - DNA, 24 bp, synthetic construct
  misc_feature 1..24: note = Synthetic Construct
  source 1..24: mol_type = other DNA
agtttggaagctttctgggataca

SEQ ID NO: 15944 - DNA, 23 bp, synthetic construct
  misc_feature 1..23: note = Synthetic Construct
  source 1..23: mol_type = other DNA
cagaatcaccacgtaaggcagat

SEQ ID NO: 15945 - DNA, 18 bp, synthetic construct
  misc_feature 1..18: note = Synthetic Construct
  source 1..18: mol_type = other DNA
tgggtgccgcacatcaag

SEQ ID NO: 15946 - DNA, 24 bp, synthetic construct
  misc_feature 1..24: note = Synthetic Construct
  source 1..24: mol_type = other DNA
ccatgtactgagagcctgacctaa

SEQ ID NO: 15947 - DNA, 20 bp, synthetic construct
  misc_feature 1..20: note = Synthetic Construct
  source 1..20: mol_type = other DNA
aggacctggaagagccacaa

SEQ ID NO: 15948 - DNA, 25 bp, synthetic construct
  misc_feature 1..25: note = Synthetic Construct
  source 1..25: mol_type = other DNA
gaacccaagagagacattagcaaca

SEQ ID NO: 15949 - DNA, 22 bp, synthetic construct
  misc_feature 1..22: note = Synthetic Construct
  source 1..22: mol_type = other DNA
tctgcagttggggtggagatgt

SEQ ID NO: 15950 - DNA, 21 bp, synthetic construct
  misc_feature 1..21: note = Synthetic Construct
  source 1..21: mol_type = other DNA
gcctgggccagctgttaagat

SEQ ID NO: 15951 - DNA, 23 bp, synthetic construct
  misc_feature 1..23: note = Synthetic Construct
  source 1..23: mol_type = other DNA
ctacactgctcgctctgaaaatg

SEQ ID NO: 15952 - DNA, 20 bp, synthetic construct
  misc_feature 1..20: note = Synthetic Construct
  source 1..20: mol_type = other DNA
aagcctgaacggagccctaa

SEQ ID NO: 15953 - DNA, 23 bp, synthetic construct
  misc_feature 1..23: note = Synthetic Construct
  source 1..23: mol_type = other DNA
ggaggctgtaagcaaaccaaatc

SEQ ID NO: 15954 - DNA, 23 bp, synthetic construct
  misc_feature 1..23: note = Synthetic Construct
  source 1..23: mol_type = other DNA
ctaccagcagttcatggttcaga

SEQ ID NO: 15955 - DNA, 22 bp, synthetic construct
  misc_feature 1..22: note = Synthetic Construct
  source 1..22: mol_type = other DNA
gcttttgcacttggctccttgt

SEQ ID NO: 15956 - DNA, 21 bp, synthetic construct
  misc_feature 1..21: note = Synthetic Construct
  source 1..21: mol_type = other DNA
aagctgggtggcctctgatag

SEQ ID NO: 15957 - DNA, 22 bp, synthetic construct
  misc_feature 1..22: note = Synthetic Construct
  source 1..22: mol_type = other DNA
tgaggacccgactccttgatag

SEQ ID NO: 15958 - DNA, 22 bp, synthetic construct
  misc_feature 1..22: note = Synthetic Construct
  source 1..22: mol_type = other DNA
ctctcccaaagcagtggctgtt

SEQ ID NO: 15959 - DNA, 23 bp, synthetic construct
  misc_feature 1..23: note = Synthetic Construct
  source 1..23: mol_type = other DNA
tctgcgagaattagcaagggatt

SEQ ID NO: 15960 - DNA, 20 bp, synthetic construct
  misc_feature 1..20: note = Synthetic Construct
  source 1..20: mol_type = other DNA
gggtccctgggtgcatttta

SEQ ID NO: 15961 - DNA, 21 bp, synthetic construct
  misc_feature 1..21: note = Synthetic Construct
  source 1..21: mol_type = other DNA
ggcctccaagctctgaagcat

SEQ ID NO: 15962 - DNA, 22 bp, synthetic construct
  misc_feature 1..22: note = Synthetic Construct
  source 1..22: mol_type = other DNA
ggactgtgacccaccaagagat

SEQ ID NO: 15963 - DNA, 20 bp, synthetic construct
  misc_feature 1..20: note = Synthetic Construct
  source 1..20: mol_type = other DNA
agcgcctctgcatgcttttc

SEQ ID NO: 15964 - DNA, 23 bp, synthetic construct
  misc_feature 1..23: note = Synthetic Construct
  source 1..23: mol_type = other DNA
cttggccctgaaaggaagataca

SEQ ID NO: 15965 - DNA, 22 bp, synthetic construct
  misc_feature 1..22: note = Synthetic Construct
  source 1..22: mol_type = other DNA
tgaggaactgttggaggcaaat

SEQ ID NO: 15966 - DNA, 24 bp, synthetic construct
  misc_feature 1..24: note = Synthetic Construct
  source 1..24: mol_type = other DNA
ctggcccttgtgagcttgtctaag

SEQ ID NO: 15967 - DNA, 23 bp, synthetic construct
  misc_feature 1..23: note = Synthetic Construct
  source 1..23: mol_type = other DNA
ggcttcctcacacaaagccttca

SEQ ID NO: 15968 - DNA, 21 bp, synthetic construct
  misc_feature 1..21: note = Synthetic Construct
  source 1..21: mol_type = other DNA
gcaagcaagggaagggcatga

SEQ ID NO: 15969 - DNA, 26 bp, synthetic construct
  misc_feature 1..26: note = Synthetic Construct
  source 1..26: mol_type = other DNA
tctggtaggacttcgtaaactgtaag

SEQ ID NO: 15970 - DNA, 26 bp, synthetic construct
  misc_feature 1..26: note = Synthetic Construct
  source 1..26: mol_type = other DNA
ggtggatcagtcctcaaaacctcaag

SEQ ID NO: 15971 - DNA, 25 bp, synthetic construct
  misc_feature 1..25: note = Synthetic Construct
  source 1..25: mol_type = other DNA
ccaaatccatcacttgctcctgcat

SEQ ID NO: 15972 - DNA, 21 bp, synthetic construct
  misc_feature 1..21: note = Synthetic Construct
  source 1..21: mol_type = other DNA
gctgaagagtggggttcagtt

SEQ ID NO: 15973 - DNA, 20 bp, synthetic construct
  misc_feature 1..20: note = Synthetic Construct
  source 1..20: mol_type = other DNA
cgtggagagaacgccaccat

SEQ ID NO: 15974 - DNA, 24 bp, synthetic construct
  misc_feature 1..24: note = Synthetic Construct
  source 1..24: mol_type = other DNA
ccaccatcttggctcttgttttct

SEQ ID NO: 15975 - DNA, 23 bp, synthetic construct
  misc_feature 1..23: note = Synthetic Construct
  source 1..23: mol_type = other DNA
ccccagaaggtgactccagaaac

SEQ ID NO: 15976 - DNA, 27 bp, synthetic construct
  misc_feature 1..27: note = Synthetic Construct
  source 1..27: mol_type = other DNA
ctctgtcctcatctcactgtttatctt

SEQ ID NO: 15977 - DNA, 22 bp, synthetic construct
  misc_feature 1..22: note = Synthetic Construct
  source 1..22: mol_type = other DNA
cagcctttcaccctgtgactct

SEQ ID NO: 15978 - DNA, 23 bp, synthetic construct
  misc_feature 1..23: note = Synthetic Construct
  source 1..23: mol_type = other DNA
ccttgtggaacacagagactcat

SEQ ID NO: 15979 - DNA, 19 bp, synthetic construct
  misc_feature 1..19: note = Synthetic Construct
  source 1..19: mol_type = other DNA
cgcacagacacctgcaatg

SEQ ID NO: 15980 - DNA, 23 bp, synthetic construct
  misc_feature 1..23: note = Synthetic Construct
  source 1..23: mol_type = other DNA
gtgccctatcttccaacttctgt

SEQ ID NO: 15981 - DNA, 22 bp, synthetic construct
  misc_feature 1..22: note = Synthetic Construct
  source 1..22: mol_type = other DNA
acaccactgtggatctggaaga

SEQ ID NO: 15982 - DNA, 20 bp, synthetic construct
  misc_feature 1..20: note = Synthetic Construct
  source 1..20: mol_type = other DNA
aaccacctgctgcctctttt

SEQ ID NO: 15983 - DNA, 21 bp, synthetic construct
  misc_feature 1..21: note = Synthetic Construct
  source 1..21: mol_type = other DNA
ggctgccttggaaatctctct

SEQ ID NO: 15984 - DNA, 24 bp, synthetic construct
  misc_feature 1..24: note = Synthetic Construct
  source 1..24: mol_type = other DNA
acgtacctaaaacccactgctaga

SEQ ID NO: 15985 - DNA, 23 bp, synthetic construct
  misc_feature 1..23: note = Synthetic Construct
  source 1..23: mol_type = other DNA
agactgctgctgagtttttgagt

SEQ ID NO: 15986 - DNA, 25 bp, synthetic construct
  misc_feature 1..25: note = Synthetic Construct
  source 1..25: mol_type = other DNA
gtgagctggattgtgtgctatggta

SEQ ID NO: 15987 - DNA, 24 bp, synthetic construct
  misc_feature 1..24: note = Synthetic Construct
  source 1..24: mol_type = other DNA
ggccacatttcccaccaatattct

SEQ ID NO: 15988 - DNA, 22 bp, synthetic construct
  misc_feature 1..22: note = Synthetic Construct
  source 1..22: mol_type = other DNA
gttagcacgaggggatcttgtt

SEQ ID NO: 15989 - DNA, 24 bp, synthetic construct
  misc_feature 1..24: note = Synthetic Construct
  source 1..24: mol_type = other DNA
ggtgtaaagcaaggacaacagttc

SEQ ID NO: 15990 - DNA, 20 bp, synthetic construct
  misc_feature 1..20: note = Synthetic Construct
  source 1..20: mol_type = other DNA
aggccacccatggtttcaca

SEQ ID NO: 15991 - DNA, 20 bp, synthetic construct
  misc_feature 1..20: note = Synthetic Construct
  source 1..20: mol_type = other DNA
gtgccgcgtagggactgata

SEQ ID NO: 15992 - DNA, 22 bp, synthetic construct
  misc_feature 1..22: note = Synthetic Construct
  source 1..22: mol_type = other DNA
cggtagacggtgtgatgtgtga

SEQ ID NO: 15993 - DNA, 20 bp, synthetic construct
  misc_feature 1..20: note = Synthetic Construct
  source 1..20: mol_type = other DNA
ccatgtgggaccacctgctt

SEQ ID NO: 15994 - DNA, 23 bp, synthetic construct
  misc_feature 1..23: note = Synthetic Construct
  source 1..23: mol_type = other DNA
gaagcaccaacagcagtttcagt

SEQ ID NO: 15995 - DNA, 23 bp, synthetic construct
  misc_feature 1..23: note = Synthetic Construct
  source 1..23: mol_type = other DNA
ctcaagggtaggactgtctgtga

SEQ ID NO: 15996 - DNA, 22 bp, synthetic construct
  misc_feature 1..22: note = Synthetic Construct
  source 1..22: mol_type = other DNA
ccagtggacacactgcttcttg

SEQ ID NO: 15997 - DNA, 22 bp, synthetic construct
  misc_feature 1..22: note = Synthetic Construct
  source 1..22: mol_type = other DNA
ctcctcaaaggcggtgatggtt

SEQ ID NO: 15998 - DNA, 22 bp, synthetic construct
  misc_feature 1..22: note = Synthetic Construct
  source 1..22: mol_type = other DNA
cctgagccacaaagagccttac

SEQ ID NO: 15999 - DNA, 21 bp, synthetic construct
  misc_feature 1..21: note = Synthetic Construct
  source 1..21: mol_type = other DNA
cagcccctccattttgctgat

SEQ ID NO: 16000 - DNA, 22 bp, synthetic construct
  misc_feature 1..22: note = Synthetic Construct
  source 1..22: mol_type = other DNA
ggcaggaattgtgagctgtagt

SEQ ID NO: 16001 - DNA, 20 bp, synthetic construct
  misc_feature 1..20: note = Synthetic Construct
  source 1..20: mol_type = other DNA
ggacgcaagggaagctgtga

SEQ ID NO: 16002 - DNA, 24 bp, synthetic construct
  misc_feature 1..24: note = Synthetic Construct
  source 1..24: mol_type = other DNA
ggcttcctttgaaactccctgaga

SEQ ID NO: 16003 - DNA, 25 bp, synthetic construct
  misc_feature 1..25: note = Synthetic Construct
  source 1..25: mol_type = other DNA
cagtggcacaatcatagctcccttt

SEQ ID NO: 16004 - DNA, 24 bp, synthetic construct
  misc_feature 1..24: note = Synthetic Construct
  source 1..24: mol_type = other DNA
ctggctaaaccgataggttcttct

SEQ ID NO: 16005 - DNA, 22 bp, synthetic construct
  misc_feature 1..22: note = Synthetic Construct
  source 1..22: mol_type = other DNA
cagcagcattcacgacatccat

SEQ ID NO: 16006 - DNA, 25 bp, synthetic construct
  misc_feature 1..25: note = Synthetic Construct
  source 1..25: mol_type = other DNA
cactgaatgcggtgtttgattaaga

SEQ ID NO: 16007 - DNA, 24 bp, synthetic construct
  misc_feature 1..24: note = Synthetic Construct
  source 1..24: mol_type = other DNA
ggctggggtatacagaaggcatga

SEQ ID NO: 16008 - DNA, 23 bp, synthetic construct
  misc_feature 1..23: note = Synthetic Construct
  source 1..23: mol_type = other DNA
gctctctcccaaacactgctttc

SEQ ID NO: 16009 - DNA, 24 bp, synthetic construct
  misc_feature 1..24: note = Synthetic Construct
  source 1..24: mol_type = other DNA
ccctgtttgtcttggctctatgaa

SEQ ID NO: 16010 - DNA, 24 bp, synthetic construct
  misc_feature 1..24: note = Synthetic Construct
  source 1..24: mol_type = other DNA
aggaagaccctgcatttacattga

SEQ ID NO: 16011 - DNA, 23 bp, synthetic construct
  misc_feature 1..23: note = Synthetic Construct
  source 1..23: mol_type = other DNA
agtcaagctgggagatgaggata

SEQ ID NO: 16012 - DNA, 23 bp, synthetic construct
  misc_feature 1..23: note = Synthetic Construct
  source 1..23: mol_type = other DNA
cagtgtctactgctccagtgctt

SEQ ID NO: 16013 - DNA, 22 bp, synthetic construct
  misc_feature 1..22: note = Synthetic Construct
  source 1..22: mol_type = other DNA
gggagagggttggactcaaaag

SEQ ID NO: 16014 - DNA, 26 bp, synthetic construct
  misc_feature 1..26: note = Synthetic Construct
  source 1..26: mol_type = other DNA
gcgtagtgtgtgtgaaagactcagat

SEQ ID NO: 16015 - DNA, 22 bp, synthetic construct
  misc_feature 1..22: note = Synthetic Construct
  source 1..22: mol_type = other DNA
ccatggcagcttactcccaatc

SEQ ID NO: 16016 - DNA, 21 bp, synthetic construct
  misc_feature 1..21: note = Synthetic Construct
  source 1..21: mol_type = other DNA
agccacagccttggtctcaca

SEQ ID NO: 16017 - DNA, 24 bp, synthetic construct
  misc_feature 1..24: note = Synthetic Construct
  source 1..24: mol_type = other DNA
caccacacatctcctaagcatgta

SEQ ID NO: 16018 - DNA, 24 bp, synthetic construct
  misc_feature 1..24: note = Synthetic Construct
  source 1..24: mol_type = other DNA
gtagctgagacatggtgtccaaac

SEQ ID NO: 16019 - DNA, 23 bp, synthetic construct
  misc_feature 1..23: note = Synthetic Construct
  source 1..23: mol_type = other DNA
cctcctgaagacagagtccaact

SEQ ID NO: 16020 - DNA, 25 bp, synthetic construct
  misc_feature 1..25: note = Synthetic Construct
  source 1..25: mol_type = other DNA
ccctggaaactataaatggctgcta

SEQ ID NO: 16021 - DNA, 20 bp, synthetic construct
  misc_feature 1..20: note = Synthetic Construct
  source 1..20: mol_type = other DNA
tgacttcctggccagtccat

SEQ ID NO: 16022 - DNA, 22 bp, synthetic construct
  misc_feature 1..22: note = Synthetic Construct
  source 1..22: mol_type = other DNA
ctgtctgaccagacctcagact

SEQ ID NO: 16023 - DNA, 23 bp, synthetic construct
  misc_feature 1..23: note = Synthetic Construct
  source 1..23: mol_type = other DNA
ggccagagaacatgtctgtcatc

SEQ ID NO: 16024 - DNA, 22 bp, synthetic construct
  misc_feature 1..22: note = Synthetic Construct
  source 1..22: mol_type = other DNA
gccttatcttcgcccctctttg

SEQ ID NO: 16025 - DNA, 24 bp, synthetic construct
  misc_feature 1..24: note = Synthetic Construct
  source 1..24: mol_type = other DNA
gctgagaggttttcacacggatac

SEQ ID NO: 16026 - DNA, 26 bp, synthetic construct
  misc_feature 1..26: note = Synthetic Construct
  source 1..26: mol_type = other DNA
cccaacttgttcaactctaagtgtct

SEQ ID NO: 16027 - DNA, 21 bp, synthetic construct
  misc_feature 1..21: note = Synthetic Construct
  source 1..21: mol_type = other DNA
tgagggtgtccaggcagtttg

SEQ ID NO: 16028 - DNA, 26 bp, synthetic construct
  misc_feature 1..26: note = Synthetic Construct
  source 1..26: mol_type = other DNA
gcttagccagtccttcattctacaac

SEQ ID NO: 16029 - DNA, 22 bp, synthetic construct
  misc_feature 1..22: note = Synthetic Construct
  source 1..22: mol_type = other DNA
ggcctttggccttcctcatcat

SEQ ID NO: 16030 - DNA, 20 bp, synthetic construct
  misc_feature 1..20: note = Synthetic Construct
  source 1..20: mol_type = other DNA
aggcctttggtgtcctggaa

SEQ ID NO: 16031 - DNA, 27 bp, synthetic construct
  misc_feature 1..27: note = Synthetic Construct
  source 1..27: mol_type = other DNA
gcatggggatataacgtgttcagtttg

SEQ ID NO: 16032 - DNA, 24 bp, synthetic construct
  misc_feature 1..24: note = Synthetic Construct
  source 1..24: mol_type = other DNA
ctcctcaaagccactgccttgaaa

SEQ ID NO: 16033 - DNA, 23 bp, synthetic construct
  misc_feature 1..23: note = Synthetic Construct
  source 1..23: mol_type = other DNA
gccttgtgggtcaaagaaagcat

SEQ ID NO: 16034 - DNA, 20 bp, synthetic construct
  misc_feature 1..20: note = Synthetic Construct
  source 1..20: mol_type = other DNA
ccaggctggaatccctgtgt

SEQ ID NO: 16035 - DNA, 23 bp, synthetic construct
  misc_feature 1..23: note = Synthetic Construct
  source 1..23: mol_type = other DNA
gcgacacgaaaatacagcaaaac

SEQ ID NO: 16036 - DNA, 24 bp, synthetic construct
  misc_feature 1..24: note = Synthetic Construct
  source 1..24: mol_type = other DNA
ggcagactgaaaaggagatacaga

SEQ ID NO: 16037 - DNA, 23 bp, synthetic construct
  misc_feature 1..23: note = Synthetic Construct
  source 1..23: mol_type = other DNA
ccctgtgtcttctgaagctgatg

SEQ ID NO: 16038 - DNA, 27 bp, synthetic construct
  misc_feature 1..27: note = Synthetic Construct
  source 1..27: mol_type = other DNA
gtctcttttcccctagaaaaggttact

SEQ ID NO: 16039 - DNA, 25 bp, synthetic construct
  misc_feature 1..25: note = Synthetic Construct
  source 1..25: mol_type = other DNA
ggcaggcagcttttcaaaatgaagt

SEQ ID NO: 16040 - DNA, 24 bp, synthetic construct
  misc_feature 1..24: note = Synthetic Construct
  source 1..24: mol_type = other DNA
cacacgtgatttatgggagacaag

SEQ ID NO: 16041 - DNA, 23 bp, synthetic construct
  misc_feature 1..23: note = Synthetic Construct
  source 1..23: mol_type = other DNA
caggtcacttcttccaggtcctt

SEQ ID NO: 16042 - DNA, 23 bp, synthetic construct
  misc_feature 1..23: note = Synthetic Construct
  source 1..23: mol_type = other DNA
gggagaaaggagcaggctaattg

SEQ ID NO: 16043 - DNA, 20 bp, synthetic construct
  misc_feature 1..20: note = Synthetic Construct
  source 1..20: mol_type = other DNA
ggggactcaggcttctgtga

SEQ ID NO: 16044 - DNA, 24 bp, synthetic construct
  misc_feature 1..24: note = Synthetic Construct
  source 1..24: mol_type = other DNA
gtgtaccctcggctatgttttact

SEQ ID NO: 16045 - DNA, 20 bp, synthetic construct
  misc_feature 1..20: note = Synthetic Construct
  source 1..20: mol_type = other DNA
agagaggccagcagctccaa

SEQ ID NO: 16046 - DNA, 21 bp, synthetic construct
  misc_feature 1..21: note = Synthetic Construct
  source 1..21: mol_type = other DNA
acaaaagcctcctcgggtact

SEQ ID NO: 16047 - DNA, 22 bp, synthetic construct
  misc_feature 1..22: note = Synthetic Construct
  source 1..22: mol_type = other DNA
ggccacaagcattgtaggtgtt

SEQ ID NO: 16048 - DNA, 25 bp, synthetic construct
  misc_feature 1..25: note = Synthetic Construct
  source 1..25: mol_type = other DNA
cagctctgccaaaaggatctctcta

SEQ ID NO: 16049 - DNA, 22 bp, synthetic construct
  misc_feature 1..22: note = Synthetic Construct
  source 1..22: mol_type = other DNA
gcttgcaatgccctccccttat

SEQ ID NO: 16050 - DNA, 21 bp, synthetic construct
  misc_feature 1..21: note = Synthetic Construct
  source 1..21: mol_type = other DNA
cccacaacacccaggttctga

SEQ ID NO: 16051 - DNA, 23 bp, synthetic construct
  misc_feature 1..23: note = Synthetic Construct
  source 1..23: mol_type = other DNA
tggtgggctcagtaagttcaaag

SEQ ID NO: 16052 - DNA, 24 bp, synthetic construct
  misc_feature 1..24: note = Synthetic Construct
  source 1..24: mol_type = other DNA
ccacacctctccttggattctaac

SEQ ID NO: 16053 - DNA, 20 bp, synthetic construct
  misc_feature 1..20: note = Synthetic Construct
  source 1..20: mol_type = other DNA
tggtaggccccagaaagcta

SEQ ID NO: 16054 - DNA, 25 bp, synthetic construct
  misc_feature 1..25: note = Synthetic Construct
  source 1..25: mol_type = other DNA
ctcaagctgctaagtgttaggtttc

SEQ ID NO: 16055 - DNA, 26 bp, synthetic construct
  misc_feature 1..26: note = Synthetic Construct
  source 1..26: mol_type = other DNA
gaccacaggtttccatctacattact

SEQ ID NO: 16056 - DNA, 23 bp, synthetic construct
  misc_feature 1..23: note = Synthetic Construct
  source 1..23: mol_type = other DNA
catcatgtcgcagctgcattttc

SEQ ID NO: 16057 - DNA, 26 bp, synthetic construct
  misc_feature 1..26: note = Synthetic Construct
  source 1..26: mol_type = other DNA
caccaactctgctttcagacagaatc

SEQ ID NO: 16058 - DNA, 25 bp, synthetic construct
  misc_feature 1..25: note = Synthetic Construct
  source 1..25: mol_type = other DNA
gggcaacaggagattagtagctatg

SEQ ID NO: 16059 - DNA, 20 bp, synthetic construct
  misc_feature 1..20: note = Synthetic Construct
  source 1..20: mol_type = other DNA
aagaacctgggcccctgatg

SEQ ID NO: 16060 - DNA, 23 bp, synthetic construct
  misc_feature 1..23: note = Synthetic Construct
  source 1..23: mol_type = other DNA
gggacaataaggaggaagagcaa

SEQ ID NO: 16061 - DNA, 21 bp, synthetic construct
  misc_feature 1..21: note = Synthetic Construct
  source 1..21: mol_type = other DNA
accatgcttcagtgtgcaaga

SEQ ID NO: 16062 - DNA, 22 bp, synthetic construct
  misc_feature 1..22: note = Synthetic Construct
  source 1..22: mol_type = other DNA
ggtaggtgcgtagaaacgttca

SEQ ID NO: 16063 - DNA, 20 bp, synthetic construct
  misc_feature 1..20: note = Synthetic Construct
  source 1..20: mol_type = other DNA
acacctgtgactggctgagt

SEQ ID NO: 16064 - DNA, 24 bp, synthetic construct
  misc_feature 1..24: note = Synthetic Construct
  source 1..24: mol_type = other DNA
ccctggtgctagtttcttacaaca

SEQ ID NO: 16065 - DNA, 23 bp, synthetic construct
  misc_feature 1..23: note = Synthetic Construct
  source 1..23: mol_type = other DNA
gtggacctggatgacctgtcttg

SEQ ID NO: 16066 - DNA, 21 bp, synthetic construct
  misc_feature 1..21: note = Synthetic Construct
  source 1..21: mol_type = other DNA
cgccatgtttcaggccacctt

SEQ ID NO: 16067 - DNA, 22 bp, synthetic construct
  misc_feature 1..22: note = Synthetic Construct
  source 1..22: mol_type = other DNA
cagagcagttccaggcttcaca

SEQ ID NO: 16068 - DNA, 24 bp, synthetic construct
  misc_feature 1..24: note = Synthetic Construct
  source 1..24: mol_type = other DNA
cggggtaaagtctcagggaagtga

SEQ ID NO: 16069 - DNA, 21 bp, synthetic construct
  misc_feature 1..21: note = Synthetic Construct
  source 1..21: mol_type = other DNA
ggcacttggcatgtgtgattt

SEQ ID NO: 16070 - DNA, 23 bp, synthetic construct
  misc_feature 1..23: note = Synthetic Construct
  source 1..23: mol_type = other DNA
ccagggagaagaaacccatcctt

SEQ ID NO: 16071 - DNA, 22 bp, synthetic construct
  misc_feature 1..22: note = Synthetic Construct
  source 1..22: mol_type = other DNA
tccaaggggccttcaggtttct

SEQ ID NO: 16072 - DNA, 23 bp, synthetic construct
  misc_feature 1..23: note = Synthetic Construct
  source 1..23: mol_type = other DNA
tcactgggctcaggtggagtaag

SEQ ID NO: 16073 - DNA, 20 bp, synthetic construct
  misc_feature 1..20: note = Synthetic Construct
  source 1..20: mol_type = other DNA
aggggcttcatgaccggttt

SEQ ID NO: 16074 - DNA, 25 bp, synthetic construct
  misc_feature 1..25: note = Synthetic Construct
  source 1..25: mol_type = other DNA
ggcaaagtccttacgaagtgagatg

SEQ ID NO: 16075 - DNA, 25 bp, synthetic construct
  misc_feature 1..25: note = Synthetic Construct
  source 1..25: mol_type = other DNA
gctaactcccctagacaggaaaaag

SEQ ID NO: 16076 - DNA, 19 bp, synthetic construct
  misc_feature 1..19: note = Synthetic Construct
  source 1..19: mol_type = other DNA
gccagtgcccactgaggaa

SEQ ID NO: 16077 - DNA, 23 bp, synthetic construct
  misc_feature 1..23: note = Synthetic Construct
  source 1..23: mol_type = other DNA
gtctacacacacgcctcaatagt

SEQ ID NO: 16078 - DNA, 24 bp, synthetic construct
  misc_feature 1..24: note = Synthetic Construct
  source 1..24: mol_type = other DNA
gggagaaggcgcctctatttctga

SEQ ID NO: 16079 - DNA, 23 bp, synthetic construct
  misc_feature 1..23: note = Synthetic Construct
  source 1..23: mol_type = other DNA
tccctcaaaacccacgtatttgt

SEQ ID NO: 16080 - DNA, 21 bp, synthetic construct
  misc_feature 1..21: note = Synthetic Construct
  source 1..21: mol_type = other DNA
cacagccctgctttaggaaga

SEQ ID NO: 16081 - DNA, 23 bp, synthetic construct
  misc_feature 1..23: note = Synthetic Construct
  source 1..23: mol_type = other DNA
tttgagcccaggaggtcgagtct

SEQ ID NO: 16082 - DNA, 22 bp, synthetic construct
  misc_feature 1..22: note = Synthetic Construct
  source 1..22: mol_type = other DNA
tccctacacactcccatgaaga

SEQ ID NO: 16083 - DNA, 21 bp, synthetic construct
  misc_feature 1..21: note = Synthetic Construct
  source 1..21: mol_type = other DNA
acccagactggcctccaattc

SEQ ID NO: 16084 - DNA, 20 bp, synthetic construct
  misc_feature 1..20: note = Synthetic Construct
  source 1..20: mol_type = other DNA
gtggcctcgaggaagcataa

SEQ ID NO: 16085 - DNA, 26 bp, synthetic construct
  misc_feature 1..26: note = Synthetic Construct
  source 1..26: mol_type = other DNA
gtgcatgagtttcacatgtctctctt

SEQ ID NO: 16086 - DNA, 20 bp, synthetic construct
  misc_feature 1..20: note = Synthetic Construct
  source 1..20: mol_type = other DNA
tgtggggctgtaggacacaa

SEQ ID NO: 16087 - DNA, 23 bp, synthetic construct
  misc_feature 1..23: note = Synthetic Construct
  source 1..23: mol_type = other DNA
ggggtcaactcctatcacctttc

SEQ ID NO: 16088 - DNA, 22 bp, synthetic construct
  misc_feature 1..22: note = Synthetic Construct
  source 1..22: mol_type = other DNA
gtggcaggggtctttgtacttc

SEQ ID NO: 16089 - DNA, 23 bp, synthetic construct
  misc_feature 1..23: note = Synthetic Construct
  source 1..23: mol_type = other DNA
ggcagagacgctacagtaacgaa

SEQ ID NO: 16090 - DNA, 22 bp, synthetic construct
  misc_feature 1..22: note = Synthetic Construct
  source 1..22: mol_type = other DNA
gagaccctttccttctgcttga

SEQ ID NO: 16091 - DNA, 23 bp, synthetic construct
  misc_feature 1..23: note = Synthetic Construct
  source 1..23: mol_type = other DNA
gaacagcacaaggtgggacaaac

SEQ ID NO: 16092 - DNA, 25 bp, synthetic construct
  misc_feature 1..25: note = Synthetic Construct
  source 1..25: mol_type = other DNA
ctgtttgtaaggtctctgggtatga

SEQ ID NO: 16093 - DNA, 22 bp, synthetic construct
  misc_feature 1..22: note = Synthetic Construct
  source 1..22: mol_type = other DNA
caccatcagagctggggtcttt

SEQ ID NO: 16094 - DNA, 23 bp, synthetic construct
  misc_feature 1..23: note = Synthetic Construct
  source 1..23: mol_type = other DNA
ggatgtgaaagctggagcactgt

SEQ ID NO: 16095 - DNA, 28 bp, synthetic construct
  misc_feature 1..28: note = Synthetic Construct
  source 1..28: mol_type = other DNA
gacatctgtgtgcttgttaagggaatga

SEQ ID NO: 16096 - DNA, 24 bp, synthetic construct
  misc_feature 1..24: note = Synthetic Construct
  source 1..24: mol_type = other DNA
tccaagttcagtgccagttctatc

SEQ ID NO: 16097 - DNA, 20 bp, synthetic construct
  misc_feature 1..20: note = Synthetic Construct
  source 1..20: mol_type = other DNA
tgccttggcccttgcctttt

SEQ ID NO: 16098 - DNA, 23 bp, synthetic construct
  misc_feature 1..23: note = Synthetic Construct
  source 1..23: mol_type = other DNA
caaagggaagacacgaactcctt

SEQ ID NO: 16099 - DNA, 23 bp, synthetic construct
  misc_feature 1..23: note = Synthetic Construct
  source 1..23: mol_type = other DNA
cgatgtggcggtatacagtgttg

SEQ ID NO: 16100 - DNA, 21 bp, synthetic construct
  misc_feature 1..21: note = Synthetic Construct
  source 1..21: mol_type = other DNA
cgcttcactggccagaacttg

SEQ ID NO: 16101 - DNA, 23 bp, synthetic construct
  misc_feature 1..23: note = Synthetic Construct
  source 1..23: mol_type = other DNA
gcatttgttcattgtgcgtgtgt

SEQ ID NO: 16102 - DNA, 26 bp, synthetic construct
  misc_feature 1..26: note = Synthetic Construct
  source 1..26: mol_type = other DNA
agggatagaattgctgaccagataga

SEQ ID NO: 16103 - DNA, 22 bp, synthetic construct
  misc_feature 1..22: note = Synthetic Construct
  source 1..22: mol_type = other DNA
cgagccggacagcagttcatta

SEQ ID NO: 16104 - DNA, 20 bp, synthetic construct
  misc_feature 1..20: note = Synthetic Construct
  source 1..20: mol_type = other DNA
cgtgaactgccctcctcaga

SEQ ID NO: 16105 - DNA, 24 bp, synthetic construct
  misc_feature 1..24: note = Synthetic Construct
  source 1..24: mol_type = other DNA
gcagctgaggagttcagggttcaa

SEQ ID NO: 16106 - DNA, 23 bp, synthetic construct
  misc_feature 1..23: note = Synthetic Construct
  source 1..23: mol_type = other DNA
caggcttggaaactcagggactt

SEQ ID NO: 16107 - DNA, 20 bp, synthetic construct
  misc_feature 1..20: note = Synthetic Construct
  source 1..20: mol_type = other DNA
cccacatgggagaccgctaa

SEQ ID NO: 16108 - DNA, 25 bp, synthetic construct
  misc_feature 1..25: note = Synthetic Construct
  source 1..25: mol_type = other DNA
gctgtggttttatgctcccctaaac

SEQ ID NO: 16109 - DNA, 20 bp, synthetic construct
  misc_feature 1..20: note = Synthetic Construct
  source 1..20: mol_type = other DNA
accgcctggttcctgattct

SEQ ID NO: 16110 - DNA, 24 bp, synthetic construct
  misc_feature 1..24: note = Synthetic Construct
  source 1..24: mol_type = other DNA
caggggaggcctagagttaagttc

SEQ ID NO: 16111 - DNA, 21 bp, synthetic construct
  misc_feature 1..21: note = Synthetic Construct
  source 1..21: mol_type = other DNA
ggggctctccctctcgatgta

SEQ ID NO: 16112 - DNA, 23 bp, synthetic construct
  misc_feature 1..23: note = Synthetic Construct
  source 1..23: mol_type = other DNA
cgggccacctggagaaagaatag

SEQ ID NO: 16113 - DNA, 19 bp, synthetic construct
  misc_feature 1..19: note = Synthetic Construct
  source 1..19: mol_type = other DNA
atgggtggcttcggctcaa

SEQ ID NO: 16114 - DNA, 26 bp, synthetic construct
  misc_feature 1..26: note = Synthetic Construct
  source 1..26: mol_type = other DNA
gccaagtttttcagagagcagcagat

SEQ ID NO: 16115 - DNA, 20 bp, synthetic construct
  misc_feature 1..20: note = Synthetic Construct
  source 1..20: mol_type = other DNA
ccctcgctcaccttctcttc

SEQ ID NO: 16116 - DNA, 20 bp, synthetic construct
  misc_feature 1..20: note = Synthetic Construct
  source 1..20: mol_type = other DNA
tgacactgaccggtgtggat

SEQ ID NO: 16117 - DNA, 24 bp, synthetic construct
  misc_feature 1..24: note = Synthetic Construct
  source 1..24: mol_type = other DNA
cctatcccattcctcacagccatt

SEQ ID NO: 16118 - DNA, 24 bp, synthetic construct
  misc_feature 1..24: note = Synthetic Construct
  source 1..24: mol_type = other DNA
tggctggaagctaattttggtttg

SEQ ID NO: 16119 - DNA, 23 bp, synthetic construct
  misc_feature 1..23: note = Synthetic Construct
  source 1..23: mol_type = other DNA
gaggccacctacggtattcaaac

SEQ ID NO: 16120 - DNA, 23 bp, synthetic construct
  misc_feature 1..23: note = Synthetic Construct
  source 1..23: mol_type = other DNA
gactccagaacagaagggtcttg

SEQ ID NO: 16121 - DNA, 21 bp, synthetic construct
  misc_feature 1..21: note = Synthetic Construct
  source 1..21: mol_type = other DNA
agaagcctcccctccctctgt

SEQ ID NO: 16122 - DNA, 23 bp, synthetic construct
  misc_feature 1..23: note = Synthetic Construct
  source 1..23: mol_type = other DNA
gtggctagagctttgagcctatg

SEQ ID NO: 16123 - DNA, 21 bp, synthetic construct
  misc_feature 1..21: note = Synthetic Construct
  source 1..21: mol_type = other DNA
ccagctggcctgacactcaaa

SEQ ID NO: 16124 - DNA, 22 bp, synthetic construct
  misc_feature 1..22: note = Synthetic Construct
  source 1..22: mol_type = other DNA
gtcctggctggctaaaggttgt

SEQ ID NO: 16125 - DNA, 21 bp, synthetic construct
  misc_feature 1..21: note = Synthetic Construct
  source 1..21: mol_type = other DNA
gggcttcccaaacacacaatc

SEQ ID NO: 16126 - DNA, 25 bp, synthetic construct
  misc_feature 1..25: note = Synthetic Construct
  source 1..25: mol_type = other DNA
acaacagattacaggagcacagtta

SEQ ID NO: 16127 - DNA, 22 bp, synthetic construct
  misc_feature 1..22: note = Synthetic Construct
  source 1..22: mol_type = other DNA
ggtggatgaatgccctgtcaac

SEQ ID NO: 16128 - DNA, 20 bp, synthetic construct
  misc_feature 1..20: note = Synthetic Construct
  source 1..20: mol_type = other DNA
tgtgggcccctggagctact

SEQ ID NO: 16129 - DNA, 24 bp, synthetic construct
  misc_feature 1..24: note = Synthetic Construct
  source 1..24: mol_type = other DNA
gcgtccgtgtcactaattttcttg

SEQ ID NO: 16130 - DNA, 22 bp, synthetic construct
  misc_feature 1..22: note = Synthetic Construct
  source 1..22: mol_type = other DNA
tgcccctcctgaaaccacattc

SEQ ID NO: 16131 - DNA, 25 bp, synthetic construct
  misc_feature 1..25: note = Synthetic Construct
  source 1..25: mol_type = other DNA
catggctggaatgagtcaagtgcta

SEQ ID NO: 16132 - DNA, 25 bp, synthetic construct
  misc_feature 1..25: note = Synthetic Construct
  source 1..25: mol_type = other DNA
tgactcctgggaagctagacttaaa

SEQ ID NO: 16133 - DNA, 24 bp, synthetic construct
  misc_feature 1..24: note = Synthetic Construct
  source 1..24: mol_type = other DNA
tctgattatgaacccaaggctgtt

SEQ ID NO: 16134 - DNA, 24 bp, synthetic construct
  misc_feature 1..24: note = Synthetic Construct
  source 1..24: mol_type = other DNA
ctccctgtctgcatctttccttat

SEQ ID NO: 16135 - DNA, 22 bp, synthetic construct
  misc_feature 1..22: note = Synthetic Construct
  source 1..22: mol_type = other DNA
tgagtgaccatccactgacaag

SEQ ID NO: 16136 - DNA, 24 bp, synthetic construct
  misc_feature 1..24: note = Synthetic Construct
  source 1..24: mol_type = other DNA
gaagtctccatgtagccactgaat

SEQ ID NO: 16137 - DNA, 22 bp, synthetic construct
  misc_feature 1..22: note = Synthetic Construct
  source 1..22: mol_type = other DNA
gctctgtgctttgggagactgt

SEQ ID NO: 16138 - DNA, 22 bp, synthetic construct
  misc_feature 1..22: note = Synthetic Construct
  source 1..22: mol_type = other DNA
gccaggaagcatccatcagaca

SEQ ID NO: 16139 - DNA, 25 bp, synthetic construct
  misc_feature 1..25: note = Synthetic Construct
  source 1..25: mol_type = other DNA
gccactggaaaacctgcatgaatga

SEQ ID NO: 16140 - DNA, 22 bp, synthetic construct
  misc_feature 1..22: note = Synthetic Construct
  source 1..22: mol_type = other DNA
gcgaggactagcttgcctcttt

SEQ ID NO: 16141 - DNA, 21 bp, synthetic construct
  misc_feature 1..21: note = Synthetic Construct
  source 1..21: mol_type = other DNA
actgctgtgttgctagcactt

SEQ ID NO: 16142 - DNA, 20 bp, synthetic construct
  misc_feature 1..20: note = Synthetic Construct
  source 1..20: mol_type = other DNA
acaaggcatcgccacaccat

SEQ ID NO: 16143 - DNA, 22 bp, synthetic construct
  misc_feature 1..22: note = Synthetic Construct
  source 1..22: mol_type = other DNA
gcctacattcctccatcagctt

SEQ ID NO: 16144 - DNA, 20 bp, synthetic construct
  misc_feature 1..20: note = Synthetic Construct
  source 1..20: mol_type = other DNA
acaatccaccccggtcttct

SEQ ID NO: 16145 - DNA, 27 bp, synthetic construct
  misc_feature 1..27: note = Synthetic Construct
  source 1..27: mol_type = other DNA
gtagcaactctgcaatagtctttcctt

SEQ ID NO: 16146 - DNA, 24 bp, synthetic construct
  misc_feature 1..24: note = Synthetic Construct
  source 1..24: mol_type = other DNA
cctttcactgcttgctgtgggata

SEQ ID NO: 16147 - DNA, 23 bp, synthetic construct
  misc_feature 1..23: note = Synthetic Construct
  source 1..23: mol_type = other DNA
cggcctgcagaatccacactatt

SEQ ID NO: 16148 - DNA, 22 bp, synthetic construct
  misc_feature 1..22: note = Synthetic Construct
  source 1..22: mol_type = other DNA
ggccttagtcattgcgccaaac

SEQ ID NO: 16149 - DNA, 22 bp, synthetic construct
  misc_feature 1..22: note = Synthetic Construct
  source 1..22: mol_type = other DNA
tgtgtcgaccctttcctcaaac

SEQ ID NO: 16150 - DNA, 20 bp, synthetic construct
  misc_feature 1..20: note = Synthetic Construct
  source 1..20: mol_type = other DNA
tgcaactgggaaggcgaaag

SEQ ID NO: 16151 - DNA, 21 bp, synthetic construct
  misc_feature 1..21: note = Synthetic Construct
  source 1..21: mol_type = other DNA
ggcaatggcactactggtaca

SEQ ID NO: 16152 - DNA, 21 bp, synthetic construct
  misc_feature 1..21: note = Synthetic Construct
  source 1..21: mol_type = other DNA
gccacaagctgtgagctgtct

SEQ ID NO: 16153 - DNA, 20 bp, synthetic construct
  misc_feature 1..20: note = Synthetic Construct
  source 1..20: mol_type = other DNA
tggcggggatggggatctca

SEQ ID NO: 16154 - DNA, 25 bp, synthetic construct
  misc_feature 1..25: note = Synthetic Construct
  source 1..25: mol_type = other DNA
gggacccttctcaactctactctct

SEQ ID NO: 16155 - DNA, 22 bp, synthetic construct
  misc_feature 1..22: note = Synthetic Construct
  source 1..22: mol_type = other DNA
gctcctgggaagacatatgcaa

SEQ ID NO: 16156 - DNA, 23 bp, synthetic construct
  misc_feature 1..23: note = Synthetic Construct
  source 1..23: mol_type = other DNA
ttctggctccactactgtgttac

SEQ ID NO: 16157 - DNA, 23 bp, synthetic construct
  misc_feature 1..23: note = Synthetic Construct
  source 1..23: mol_type = other DNA
gggagacactgaaaagcaagact

SEQ ID NO: 16158 - DNA, 26 bp, synthetic construct
  misc_feature 1..26: note = Synthetic Construct
  source 1..26: mol_type = other DNA
acaggaaacccagagagttgtaatag

SEQ ID NO: 16159 - DNA, 22 bp, synthetic construct
  misc_feature 1..22: note = Synthetic Construct
  source 1..22: mol_type = other DNA
gtgccctgtgtcacaaaagcaa

SEQ ID NO: 16160 - DNA, 23 bp, synthetic construct
  misc_feature 1..23: note = Synthetic Construct
  source 1..23: mol_type = other DNA
gcctgtctctttccaaggcctaa

SEQ ID NO: 16161 - DNA, 21 bp, synthetic construct
  misc_feature 1..21: note = Synthetic Construct
  source 1..21: mol_type = other DNA
tgccccagatctgtccaatga

SEQ ID NO: 16162 - DNA, 23 bp, synthetic construct
  misc_feature 1..23: note = Synthetic Construct
  source 1..23: mol_type = other DNA
ttgagctgagagacaaacgctta

SEQ ID NO: 16163 - DNA, 20 bp, synthetic construct
  misc_feature 1..20: note = Synthetic Construct
  source 1..20: mol_type = other DNA
cccagagccacacgctcaaa

SEQ ID NO: 16164 - DNA, 22 bp, synthetic construct
  misc_feature 1..22: note = Synthetic Construct
  source 1..22: mol_type = other DNA
tggttgccttcccaaattcgta

SEQ ID NO: 16165 - DNA, 22 bp, synthetic construct
  misc_feature 1..22: note = Synthetic Construct
  source 1..22: mol_type = other DNA
tgccttttcgtgcaaagctaac

SEQ ID NO: 16166 - DNA, 21 bp, synthetic construct
  misc_feature 1..21: note = Synthetic Construct
  source 1..21: mol_type = other DNA
gtgaagggaaggggcaactgt

SEQ ID NO: 16167 - DNA, 25 bp, synthetic construct
  misc_feature 1..25: note = Synthetic Construct
  source 1..25: mol_type = other DNA
ctgcaatcacagaaccagtcctaga

SEQ ID NO: 16168 - DNA, 21 bp, synthetic construct
  misc_feature 1..21: note = Synthetic Construct
  source 1..21: mol_type = other DNA
cccagctcctttccctcacat

SEQ ID NO: 16169 - DNA, 23 bp, synthetic construct
  misc_feature 1..23: note = Synthetic Construct
  source 1..23: mol_type = other DNA
gcttgtcaccatggcagatcctt

SEQ ID NO: 16170 - DNA, 20 bp, synthetic construct
  misc_feature 1..20: note = Synthetic Construct
  source 1..20: mol_type = other DNA
ggaatggagccgtgtgtcat

SEQ ID NO: 16171 - DNA, 23 bp, synthetic construct
  misc_feature 1..23: note = Synthetic Construct
  source 1..23: mol_type = other DNA
cccctaactatggagagccagaa

SEQ ID NO: 16172 - DNA, 21 bp, synthetic construct
  misc_feature 1..21: note = Synthetic Construct
  source 1..21: mol_type = other DNA
gcaggacattgccagggcttt

SEQ ID NO: 16173 - DNA, 22 bp, synthetic construct
  misc_feature 1..22: note = Synthetic Construct
  source 1..22: mol_type = other DNA
gtgggtaagctgtgctgtgttg

SEQ ID NO: 16174 - DNA, 21 bp, synthetic construct
  misc_feature 1..21: note = Synthetic Construct
  source 1..21: mol_type = other DNA
aggcaccctgaggtgggttag

SEQ ID NO: 16175 - DNA, 20 bp, synthetic construct
  misc_feature 1..20: note = Synthetic Construct
  source 1..20: mol_type = other DNA
ggagtgttggcacctgttca

SEQ ID NO: 16176 - DNA, 22 bp, synthetic construct
  misc_feature 1..22: note = Synthetic Construct
  source 1..22: mol_type = other DNA
gggtgaaccagcaagctccaaa

SEQ ID NO: 16177 - DNA, 25 bp, synthetic construct
  misc_feature 1..25: note = Synthetic Construct
  source 1..25: mol_type = other DNA
caacaacactggcagaagaaatgta

SEQ ID NO: 16178 - DNA, 23 bp, synthetic construct
  misc_feature 1..23: note = Synthetic Construct
  source 1..23: mol_type = other DNA
gggaatggaactcaaccatggaa

SEQ ID NO: 16179 - DNA, 24 bp, synthetic construct
  misc_feature 1..24: note = Synthetic Construct
  source 1..24: mol_type = other DNA
ggatttcctccgagatgcatgtga

SEQ ID NO: 16180 - DNA, 22 bp, synthetic construct
  misc_feature 1..22: note = Synthetic Construct
  source 1..22: mol_type = other DNA
aactggcatggtgagctgtatt

SEQ ID NO: 16181 - DNA, 24 bp, synthetic construct
  misc_feature 1..24: note = Synthetic Construct
  source 1..24: mol_type = other DNA
ctccgtcacctctgtctgtaaagt

SEQ ID NO: 16182 - DNA, 21 bp, synthetic construct
  misc_feature 1..21: note = Synthetic Construct
  source 1..21: mol_type = other DNA
caggcagtgacaactcagtct

SEQ ID NO: 16183 - DNA, 20 bp, synthetic construct
  misc_feature 1..20: note = Synthetic Construct
  source 1..20: mol_type = other DNA
cctggccttagaggcagcat

SEQ ID NO: 16184 - DNA, 20 bp, synthetic construct
  misc_feature 1..20: note = Synthetic Construct
  source 1..20: mol_type = other DNA
tctccccttagggcgtttgt

SEQ ID NO: 16185 - DNA, 22 bp, synthetic construct
  misc_feature 1..22: note = Synthetic Construct
  source 1..22: mol_type = other DNA
acagacccagactcagtgatga

SEQ ID NO: 16186 - DNA, 21 bp, synthetic construct
  misc_feature 1..21: note = Synthetic Construct
  source 1..21: mol_type = other DNA
tgccatggaagatgtgcgatt

SEQ ID NO: 16187 - DNA, 23 bp, synthetic construct
  misc_feature 1..23: note = Synthetic Construct
  source 1..23: mol_type = other DNA
ccagacactgagttagtcacgtt

SEQ ID NO: 16188 - DNA, 23 bp, synthetic construct
  misc_feature 1..23: note = Synthetic Construct
  source 1..23: mol_type = other DNA
ccagtgcagttatctggcacaca

SEQ ID NO: 16189 - DNA, 20 bp, synthetic construct
  misc_feature 1..20: note = Synthetic Construct
  source 1..20: mol_type = other DNA
tctggaaagccgaccactgt

SEQ ID NO: 16190 - DNA, 21 bp, synthetic construct
  misc_feature 1..21: note = Synthetic Construct
  source 1..21: mol_type = other DNA
tgctccttcatgccacctaga

SEQ ID NO: 16191 - DNA, 21 bp, synthetic construct
  misc_feature 1..21: note = Synthetic Construct
  source 1..21: mol_type = other DNA
agcagctgccaaaccaagtaa

SEQ ID NO: 16192 - DNA, 22 bp, synthetic construct
  misc_feature 1..22: note = Synthetic Construct
  source 1..22: mol_type = other DNA
gggctagtgtccataggctcaa

SEQ ID NO: 16193 - DNA, 20 bp, synthetic construct
  misc_feature 1..20: note = Synthetic Construct
  source 1..20: mol_type = other DNA
ctgggcctgatgggacttga

SEQ ID NO: 16194 - DNA, 25 bp, synthetic construct
  misc_feature 1..25: note = Synthetic Construct
  source 1..25: mol_type = other DNA
actggtgtgttaaaagggagtttgt

SEQ ID NO: 16195 - DNA, 25 bp, synthetic construct
  misc_feature 1..25: note = Synthetic Construct
  source 1..25: mol_type = other DNA
ggtcttgtcaggagtttgagcctat

SEQ ID NO: 16196 - DNA, 25 bp, synthetic construct
  misc_feature 1..25: note = Synthetic Construct
  source 1..25: mol_type = other DNA
cttaaaaccctttgccttcttgcta

SEQ ID NO: 16197 - DNA, 22 bp, synthetic construct
  misc_feature 1..22: note = Synthetic Construct
  source 1..22: mol_type = other DNA
agtgggaaagacctcggtgaca

SEQ ID NO: 16198 - DNA, 23 bp, synthetic construct
  misc_feature 1..23: note = Synthetic Construct
  source 1..23: mol_type = other DNA
ggaggtcaatgtcaggggtcaga

SEQ ID NO: 16199 - DNA, 21 bp, synthetic construct
  misc_feature 1..21: note = Synthetic Construct
  source 1..21: mol_type = other DNA
cccacaggacagggactatgt

SEQ ID NO: 16200 - DNA, 22 bp, synthetic construct
  misc_feature 1..22: note = Synthetic Construct
  source 1..22: mol_type = other DNA
gaccccagaaagagccaagtct

SEQ ID NO: 16201 - DNA, 25 bp, synthetic construct
  misc_feature 1..25: note = Synthetic Construct
  source 1..25: mol_type = other DNA
gagaggttttgatctctcggagttg

SEQ ID NO: 16202 - DNA, 24 bp, synthetic construct
  misc_feature 1..24: note = Synthetic Construct
  source 1..24: mol_type = other DNA
caattaagagggctcctggaaact

SEQ ID NO: 16203 - DNA, 21 bp, synthetic construct
  misc_feature 1..21: note = Synthetic Construct
  source 1..21: mol_type = other DNA
caacagcagggttcacacaac

SEQ ID NO: 16204 - DNA, 24 bp, synthetic construct
  misc_feature 1..24: note = Synthetic Construct
  source 1..24: mol_type = other DNA
attggcatggaagtctatggaaca

SEQ ID NO: 16205 - DNA, 24 bp, synthetic construct
  misc_feature 1..24: note = Synthetic Construct
  source 1..24: mol_type = other DNA
ggcagcagtgataagaacggattg

SEQ ID NO: 16206 - DNA, 24 bp, synthetic construct
  misc_feature 1..24: note = Synthetic Construct
  source 1..24: mol_type = other DNA
cgtgggtctgaaacaggaacattg

SEQ ID NO: 16207 - DNA, 22 bp, synthetic construct
  misc_feature 1..22: note = Synthetic Construct
  source 1..22: mol_type = other DNA
caggcaatgtggttttggctta

SEQ ID NO: 16208 - DNA, 23 bp, synthetic construct
  misc_feature 1..23: note = Synthetic Construct
  source 1..23: mol_type = other DNA
gcccctccttcattcactcaact

SEQ ID NO: 16209 - DNA, 23 bp, synthetic construct
  misc_feature 1..23: note = Synthetic Construct
  source 1..23: mol_type = other DNA
gattgggactgtgcctctcaaag

SEQ ID NO: 16210 - DNA, 26 bp, synthetic construct
  misc_feature 1..26: note = Synthetic Construct
  source 1..26: mol_type = other DNA
catcatctcttgcctgggttattgta

SEQ ID NO: 16211 - DNA, 23 bp, synthetic construct
  misc_feature 1..23: note = Synthetic Construct
  source 1..23: mol_type = other DNA
gcactagaagtgaccttgactgt

SEQ ID NO: 16212 - DNA, 22 bp, synthetic construct
  misc_feature 1..22: note = Synthetic Construct
  source 1..22: mol_type = other DNA
ggcctctttagcagcccttatc

SEQ ID NO: 16213 - DNA, 24 bp, synthetic construct
  misc_feature 1..24: note = Synthetic Construct
  source 1..24: mol_type = other DNA
gccctgcctctaaacaaccacata

SEQ ID NO: 16214 - DNA, 22 bp, synthetic construct
  misc_feature 1..22: note = Synthetic Construct
  source 1..22: mol_type = other DNA
cccactgtgctcagctctgttt

SEQ ID NO: 16215 - DNA, 23 bp, synthetic construct
  misc_feature 1..23: note = Synthetic Construct
  source 1..23: mol_type = other DNA
cttgccagttcacctgactgtat

SEQ ID NO: 16216 - DNA, 22 bp, synthetic construct
  misc_feature 1..22: note = Synthetic Construct
  source 1..22: mol_type = other DNA
cagcccaaacctggtagccaat

SEQ ID NO: 16217 - DNA, 24 bp, synthetic construct
  misc_feature 1..24: note = Synthetic Construct
  source 1..24: mol_type = other DNA
actgtcggtcaggatcattttgaa

SEQ ID NO: 16218 - DNA, 23 bp, synthetic construct
  misc_feature 1..23: note = Synthetic Construct
  source 1..23: mol_type = other DNA
ccactggtctctcactcttcact

SEQ ID NO: 16219 - DNA, 21 bp, synthetic construct
  misc_feature 1..21: note = Synthetic Construct
  source 1..21: mol_type = other DNA
gcatgcaaaggtccacaacat

SEQ ID NO: 16220 - DNA, 22 bp, synthetic construct
  misc_feature 1..22: note = Synthetic Construct
  source 1..22: mol_type = other DNA
ggggcagggagatgaagaaact

SEQ ID NO: 16221 - DNA, 24 bp, synthetic construct
  misc_feature 1..24: note = Synthetic Construct
  source 1..24: mol_type = other DNA
cgatgactgaacctgaaaggtgat

SEQ ID NO: 16222 - DNA, 20 bp, synthetic construct
  misc_feature 1..20: note = Synthetic Construct
  source 1..20: mol_type = other DNA
gggaggactgctggaggaat

SEQ ID NO: 16223 - DNA, 20 bp, synthetic construct
  misc_feature 1..20: note = Synthetic Construct
  source 1..20: mol_type = other DNA
taccccagcgtggagacagt

SEQ ID NO: 16224 - DNA, 22 bp, synthetic construct
  misc_feature 1..22: note = Synthetic Construct
  source 1..22: mol_type = other DNA
taggtagggccacgaggagtag

SEQ ID NO: 16225 - DNA, 20 bp, synthetic construct
  misc_feature 1..20: note = Synthetic Construct
  source 1..20: mol_type = other DNA
gactgtgggactctgtgcaa

SEQ ID NO: 16226 - DNA, 23 bp, synthetic construct
  misc_feature 1..23: note = Synthetic Construct
  source 1..23: mol_type = other DNA
gacaccatcgggagacagattac

SEQ ID NO: 16227 - DNA, 26 bp, synthetic construct
  misc_feature 1..26: note = Synthetic Construct
  source 1..26: mol_type = other DNA
ccagcatacttgtgacctgagagttc

SEQ ID NO: 16228 - DNA, 26 bp, synthetic construct
  misc_feature 1..26: note = Synthetic Construct
  source 1..26: mol_type = other DNA
ctgtatagggctctggggttataaag

SEQ ID NO: 16229 - DNA, 22 bp, synthetic construct
  misc_feature 1..22: note = Synthetic Construct
  source 1..22: mol_type = other DNA
cctgtgcaagttcccagagaga

SEQ ID NO: 16230 - DNA, 24 bp, synthetic construct
  misc_feature 1..24: note = Synthetic Construct
  source 1..24: mol_type = other DNA
cagagcttgtacttggaccgatgt

SEQ ID NO: 16231 - DNA, 23 bp, synthetic construct
  misc_feature 1..23: note = Synthetic Construct
  source 1..23: mol_type = other DNA
gttgattttggtgggcttcagtt

SEQ ID NO: 16232 - DNA, 23 bp, synthetic construct
  misc_feature 1..23: note = Synthetic Construct
  source 1..23: mol_type = other DNA
gcatctgcaactgtgtgatcttg

SEQ ID NO: 16233 - DNA, 22 bp, synthetic construct
  misc_feature 1..22: note = Synthetic Construct
  source 1..22: mol_type = other DNA
cagcctagaagcccagtccatt

SEQ ID NO: 16234 - DNA, 19 bp, synthetic construct
  misc_feature 1..19: note = Synthetic Construct
  source 1..19: mol_type = other DNA
agcacttggcactgtgtgt

SEQ ID NO: 16235 - DNA, 21 bp, synthetic construct
  misc_feature 1..21: note = Synthetic Construct
  source 1..21: mol_type = other DNA
cctgccctttgctgatgaaac

SEQ ID NO: 16236 - DNA, 20 bp, synthetic construct
  misc_feature 1..20: note = Synthetic Construct
  source 1..20: mol_type = other DNA
agcgatgcggggaagacttt

SEQ ID NO: 16237 - DNA, 24 bp, synthetic construct
  misc_feature 1..24: note = Synthetic Construct
  source 1..24: mol_type = other DNA
cctcagagcatttgaggaacagaa

SEQ ID NO: 16238 - DNA, 23 bp, synthetic construct
  misc_feature 1..23: note = Synthetic Construct
  source 1..23: mol_type = other DNA
aacgtcatctccaccaatgaact

SEQ ID NO: 16239 - DNA, 23 bp, synthetic construct
  misc_feature 1..23: note = Synthetic Construct
  source 1..23: mol_type = other DNA
ggttgtcagcactctggacaaaa

SEQ ID NO: 16240 - DNA, 25 bp, synthetic construct
  misc_feature 1..25: note = Synthetic Construct
  source 1..25: mol_type = other DNA
ctggggtgtattttagcttcagagt

SEQ ID NO: 16241 - DNA, 20 bp, synthetic construct
  misc_feature 1..20: note = Synthetic Construct
  source 1..20: mol_type = other DNA
gcccctcaggttgtgtttct

SEQ ID NO: 16242 - DNA, 23 bp, synthetic construct
  misc_feature 1..23: note = Synthetic Construct
  source 1..23: mol_type = other DNA
ctcttctgaactccacactcaca

SEQ ID NO: 16243 - DNA, 22 bp, synthetic construct
  misc_feature 1..22: note = Synthetic Construct
  source 1..22: mol_type = other DNA
gggagaggcgtattctgtgatg

SEQ ID NO: 16244 - DNA, 23 bp, synthetic construct
  misc_feature 1..23: note = Synthetic Construct
  source 1..23: mol_type = other DNA
agtaagccagatgcccaatttgt

SEQ ID NO: 16245 - DNA, 19 bp, synthetic construct
  misc_feature 1..19: note = Synthetic Construct
  source 1..19: mol_type = other DNA
ccttgtccaggccatgtgt

SEQ ID NO: 16246 - DNA, 29 bp, synthetic construct
  misc_feature 1..29: note = Synthetic Construct
  source 1..29: mol_type = other DNA
ggtaatatccagtccatccttacttctgt

SEQ ID NO: 16247 - DNA, 24 bp, synthetic construct
  misc_feature 1..24: note = Synthetic Construct
  source 1..24: mol_type = other DNA
gggattcaggctcctttcatcttg

SEQ ID NO: 16248 - DNA, 19 bp, synthetic construct
  misc_feature 1..19: note = Synthetic Construct
  source 1..19: mol_type = other DNA
ggggaggcagacctggtta

SEQ ID NO: 16249 - DNA, 25 bp, synthetic construct
  misc_feature 1..25: note = Synthetic Construct
  source 1..25: mol_type = other DNA
gctgaacggttccttatctttcatc

SEQ ID NO: 16250 - DNA, 24 bp, synthetic construct
  misc_feature 1..24: note = Synthetic Construct
  source 1..24: mol_type = other DNA
gagagtttggcgcagaggagtaag

SEQ ID NO: 16251 - DNA, 22 bp, synthetic construct
  misc_feature 1..22: note = Synthetic Construct
  source 1..22: mol_type = other DNA
tcctatccctcccctaccactt

SEQ ID NO: 16252 - DNA, 25 bp, synthetic construct
  misc_feature 1..25: note = Synthetic Construct
  source 1..25: mol_type = other DNA
cgtgatctgactctggaatgacctt

SEQ ID NO: 16253 - DNA, 23 bp, synthetic construct
  misc_feature 1..23: note = Synthetic Construct
  source 1..23: mol_type = other DNA
ggtacctcccagatgtccatttc

SEQ ID NO: 16254 - DNA, 25 bp, synthetic construct
  misc_feature 1..25: note = Synthetic Construct
  source 1..25: mol_type = other DNA
gttatggtgggaagagtggagtatg

SEQ ID NO: 16255 - DNA, 22 bp, synthetic construct
  misc_feature 1..22: note = Synthetic Construct
  source 1..22: mol_type = other DNA
ctggctcaagctcccttgtgaa

SEQ ID NO: 16256 - DNA, 22 bp, synthetic construct
  misc_feature 1..22: note = Synthetic Construct
  source 1..22: mol_type = other DNA
gcaagatgtgcccaccacacaa

SEQ ID NO: 16257 - DNA, 23 bp, synthetic construct
  misc_feature 1..23: note = Synthetic Construct
  source 1..23: mol_type = other DNA
ggcagggaggtaccatcttcttg

SEQ ID NO: 16258 - DNA, 22 bp, synthetic construct
  misc_feature 1..22: note = Synthetic Construct
  source 1..22: mol_type = other DNA
cctccactactggtcctaccaa

SEQ ID NO: 16259 - DNA, 24 bp, synthetic construct
  misc_feature 1..24: note = Synthetic Construct
  source 1..24: mol_type = other DNA
gaggagaggacaccagacttgttg

SEQ ID NO: 16260 - DNA, 21 bp, synthetic construct
  misc_feature 1..21: note = Synthetic Construct
  source 1..21: mol_type = other DNA
ggccattgcacttgctacttc

SEQ ID NO: 16261 - DNA, 26 bp, synthetic construct
  misc_feature 1..26: note = Synthetic Construct
  source 1..26: mol_type = other DNA
ggacaccctccactggtaacactaag

SEQ ID NO: 16262 - DNA, 23 bp, synthetic construct
  misc_feature 1..23: note = Synthetic Construct
  source 1..23: mol_type = other DNA
cagcccctggctttatgttcact

SEQ ID NO: 16263 - DNA, 22 bp, synthetic construct
  misc_feature 1..22: note = Synthetic Construct
  source 1..22: mol_type = other DNA
gctcattcctggcatcccttgt

SEQ ID NO: 16264 - DNA, 23 bp, synthetic construct
  misc_feature 1..23: note = Synthetic Construct
  source 1..23: mol_type = other DNA
ctcagagggcctgatctcaatgt

SEQ ID NO: 16265 - DNA, 23 bp, synthetic construct
  misc_feature 1..23: note = Synthetic Construct
  source 1..23: mol_type = other DNA
gtgggatagatccctgcagattc

SEQ ID NO: 16266 - DNA, 24 bp, synthetic construct
  misc_feature 1..24: note = Synthetic Construct
  source 1..24: mol_type = other DNA
tcttctcgaaagcatgcctaatct

SEQ ID NO: 16267 - DNA, 25 bp, synthetic construct
  misc_feature 1..25: note = Synthetic Construct
  source 1..25: mol_type = other DNA
cccgaatcccacctttgagggttta

SEQ ID NO: 16268 - DNA, 22 bp, synthetic construct
  misc_feature 1..22: note = Synthetic Construct
  source 1..22: mol_type = other DNA
tagcaggggactgggcattcaa

SEQ ID NO: 16269 - DNA, 25 bp, synthetic construct
  misc_feature 1..25: note = Synthetic Construct
  source 1..25: mol_type = other DNA
gggatagaggtcagacacagcagtt

SEQ ID NO: 16270 - DNA, 18 bp, synthetic construct
  misc_feature 1..18: note = Synthetic Construct
  source 1..18: mol_type = other DNA
ttgggcggtttgctgtgt

SEQ ID NO: 16271 - DNA, 24 bp, synthetic construct
  misc_feature 1..24: note = Synthetic Construct
  source 1..24: mol_type = other DNA
gcaggaaccataccaactgctctt

SEQ ID NO: 16272 - DNA, 22 bp, synthetic construct
  misc_feature 1..22: note = Synthetic Construct
  source 1..22: mol_type = other DNA
gccctagctccatctgtccaat

SEQ ID NO: 16273 - DNA, 22 bp, synthetic construct
  misc_feature 1..22: note = Synthetic Construct
  source 1..22: mol_type = other DNA
gcagcctttgccttttgctaac

SEQ ID NO: 16274 - DNA, 24 bp, synthetic construct
  misc_feature 1..24: note = Synthetic Construct
  source 1..24: mol_type = other DNA
gatgacactggggtcgtgtgatag

SEQ ID NO: 16275 - DNA, 23 bp, synthetic construct
  misc_feature 1..23: note = Synthetic Construct
  source 1..23: mol_type = other DNA
ctcccctgcatctaggtgtttac

SEQ ID NO: 16276 - DNA, 23 bp, synthetic construct
  misc_feature 1..23: note = Synthetic Construct
  source 1..23: mol_type = other DNA
gtgcaagacaaccactggtgaga

SEQ ID NO: 16277 - DNA, 23 bp, synthetic construct
  misc_feature 1..23: note = Synthetic Construct
  source 1..23: mol_type = other DNA
cctgttgcctctggaaactatct

SEQ ID NO: 16278 - DNA, 20 bp, synthetic construct
  misc_feature 1..20: note = Synthetic Construct
  source 1..20: mol_type = other DNA
tccccagctccagggaagaa

SEQ ID NO: 16279 - DNA, 21 bp, synthetic construct
  misc_feature 1..21: note = Synthetic Construct
  source 1..21: mol_type = other DNA
ttctgggagtgagaccgtttg

SEQ ID NO: 16280 - DNA, 24 bp, synthetic construct
  misc_feature 1..24: note = Synthetic Construct
  source 1..24: mol_type = other DNA
ccggctctaaatcctggcattttc

SEQ ID NO: 16281 - DNA, 24 bp, synthetic construct
  misc_feature 1..24: note = Synthetic Construct
  source 1..24: mol_type = other DNA
ccctgctaggaacagtctgatgaa

SEQ ID NO: 16282 - DNA, 22 bp, synthetic construct
  misc_feature 1..22: note = Synthetic Construct
  source 1..22: mol_type = other DNA
atctgggcctcctaaggtcttc

SEQ ID NO: 16283 - DNA, 22 bp, synthetic construct
  misc_feature 1..22: note = Synthetic Construct
  source 1..22: mol_type = other DNA
attggcagcacgaacccagaca

SEQ ID NO: 16284 - DNA, 22 bp, synthetic construct
  misc_feature 1..22: note = Synthetic Construct
  source 1..22: mol_type = other DNA
agaacaggccctagagctggaa

SEQ ID NO: 16285 - DNA, 24 bp, synthetic construct
  misc_feature 1..24: note = Synthetic Construct
  source 1..24: mol_type = other DNA
gtccagcccttcactagatgttag

SEQ ID NO: 16286 - DNA, 20 bp, synthetic construct
  misc_feature 1..20: note = Synthetic Construct
  source 1..20: mol_type = other DNA
ttgttggagggcgagcagtt

SEQ ID NO: 16287 - DNA, 27 bp, synthetic construct
  misc_feature 1..27: note = Synthetic Construct
  source 1..27: mol_type = other DNA
ggagtttctcattttcttccaggcaat

SEQ ID NO: 16288 - DNA, 23 bp, synthetic construct
  misc_feature 1..23: note = Synthetic Construct
  source 1..23: mol_type = other DNA
gaccttggcaaagtgacctcatc

SEQ ID NO: 16289 - DNA, 21 bp, synthetic construct
  misc_feature 1..21: note = Synthetic Construct
  source 1..21: mol_type = other DNA
gccttctggagtggacaggaa

SEQ ID NO: 16290 - DNA, 24 bp, synthetic construct
  misc_feature 1..24: note = Synthetic Construct
  source 1..24: mol_type = other DNA
gagtaggaggtgaggtgtgctgat

SEQ ID NO: 16291 - DNA, 21 bp, synthetic construct
  misc_feature 1..21: note = Synthetic Construct
  source 1..21: mol_type = other DNA
gggatggaaggctggggaatg

SEQ ID NO: 16292 - DNA, 23 bp, synthetic construct
  misc_feature 1..23: note = Synthetic Construct
  source 1..23: mol_type = other DNA
tctgtagcagcagcaaattgaga

SEQ ID NO: 16293 - DNA, 19 bp, synthetic construct
  misc_feature 1..19: note = Synthetic Construct
  source 1..19: mol_type = other DNA
tgctccctctgggaagcat

SEQ ID NO: 16294 - DNA, 23 bp, synthetic construct
  misc_feature 1..23: note = Synthetic Construct
  source 1..23: mol_type = other DNA
acaaagtggagaatgggctgaac

SEQ ID NO: 16295 - DNA, 18 bp, synthetic construct
  misc_feature 1..18: note = Synthetic Construct
  source 1..18: mol_type = other DNA
tgcccgcagcagcttcat

SEQ ID NO: 16296 - DNA, 23 bp, synthetic construct
  misc_feature 1..23: note = Synthetic Construct
  source 1..23: mol_type = other DNA
ccttcttcctgctacgaccttct

SEQ ID NO: 16297 - DNA, 25 bp, synthetic construct
  misc_feature 1..25: note = Synthetic Construct
  source 1..25: mol_type = other DNA
gcccacactcttaacctctgcacta

SEQ ID NO: 16298 - DNA, 23 bp, synthetic construct
  misc_feature 1..23: note = Synthetic Construct
  source 1..23: mol_type = other DNA
cgttgtgggacaaggtctaaaca

SEQ ID NO: 16299 - DNA, 20 bp, synthetic construct
  misc_feature 1..20: note = Synthetic Construct
  source 1..20: mol_type = other DNA
ccagggttgaagcaggttgt

SEQ ID NO: 16300 - DNA, 21 bp, synthetic construct
  misc_feature 1..21: note = Synthetic Construct
  source 1..21: mol_type = other DNA
ggttgagcactgttccacaca

SEQ ID NO: 16301 - DNA, 22 bp, synthetic construct
  misc_feature 1..22: note = Synthetic Construct
  source 1..22: mol_type = other DNA
ctggactcaggcagtgctttgt

SEQ ID NO: 16302 - DNA, 27 bp, synthetic construct
  misc_feature 1..27: note = Synthetic Construct
  source 1..27: mol_type = other DNA
ctgtgtcccaatttcccatttcagttc

SEQ ID NO: 16303 - DNA, 24 bp, synthetic construct
  misc_feature 1..24: note = Synthetic Construct
  source 1..24: mol_type = other DNA
gtcctctgtagctcagacactgtt

SEQ ID NO: 16304 - DNA, 25 bp, synthetic construct
  misc_feature 1..25: note = Synthetic Construct
  source 1..25: mol_type = other DNA
ggtggtttgctaaagaccacctgta

SEQ ID NO: 16305 - DNA, 21 bp, synthetic construct
  misc_feature 1..21: note = Synthetic Construct
  source 1..21: mol_type = other DNA
tgcccacacctactgccatac

SEQ ID NO: 16306 - DNA, 23 bp, synthetic construct
  misc_feature 1..23: note = Synthetic Construct
  source 1..23: mol_type = other DNA
ctctgtctcccagtggtcagtct

SEQ ID NO: 16307 - DNA, 25 bp, synthetic construct
  misc_feature 1..25: note = Synthetic Construct
  source 1..25: mol_type = other DNA
tttgaaagcaggaaccaagagagta

SEQ ID NO: 16308 - DNA, 22 bp, synthetic construct
  misc_feature 1..22: note = Synthetic Construct
  source 1..22: mol_type = other DNA
ccccaggcaattgggacaaact

SEQ ID NO: 16309 - DNA, 20 bp, synthetic construct
  misc_feature 1..20: note = Synthetic Construct
  source 1..20: mol_type = other DNA
cccctgagtcacaccagttg

SEQ ID NO: 16310 - DNA, 23 bp, synthetic construct
  misc_feature 1..23: note = Synthetic Construct
  source 1..23: mol_type = other DNA
acacacatctgtctgtgtgatga

SEQ ID NO: 16311 - DNA, 22 bp, synthetic construct
  misc_feature 1..22: note = Synthetic Construct
  source 1..22: mol_type = other DNA
cccttggcccctatgacatcaa

SEQ ID NO: 16312 - DNA, 20 bp, synthetic construct
  misc_feature 1..20: note = Synthetic Construct
  source 1..20: mol_type = other DNA
gggcctcccattgccaactt

SEQ ID NO: 16313 - DNA, 24 bp, synthetic construct
  misc_feature 1..24: note = Synthetic Construct
  source 1..24: mol_type = other DNA
ctgttagtggctttgctgtttcaa

SEQ ID NO: 16314 - DNA, 23 bp, synthetic construct
  misc_feature 1..23: note = Synthetic Construct
  source 1..23: mol_type = other DNA
gggaggcaggaattactccaact

SEQ ID NO: 16315 - DNA, 23 bp, synthetic construct
  misc_feature 1..23: note = Synthetic Construct
  source 1..23: mol_type = other DNA
gtcgtttggaaactggcttctga

SEQ ID NO: 16316 - DNA, 26 bp, synthetic construct
  misc_feature 1..26: note = Synthetic Construct
  source 1..26: mol_type = other DNA
cagaaagagagaggtttgtcctcttg

SEQ ID NO: 16317 - DNA, 24 bp, synthetic construct
  misc_feature 1..24: note = Synthetic Construct
  source 1..24: mol_type = other DNA
caacaccacctctccataccttga

SEQ ID NO: 16318 - DNA, 20 bp, synthetic construct
  misc_feature 1..20: note = Synthetic Construct
  source 1..20: mol_type = other DNA
tgcagcaagtgcgtgcattc

SEQ ID NO: 16319 - DNA, 24 bp, synthetic construct
  misc_feature 1..24: note = Synthetic Construct
  source 1..24: mol_type = other DNA
gctgggccatagctctatgttttc

SEQ ID NO: 16320 - DNA, 22 bp, synthetic construct
  misc_feature 1..22: note = Synthetic Construct
  source 1..22: mol_type = other DNA
gttccacctctccctgcaaagt

SEQ ID NO: 16321 - DNA, 26 bp, synthetic construct
  misc_feature 1..26: note = Synthetic Construct
  source 1..26: mol_type = other DNA
gactttgggaacacagagaaatggtt

SEQ ID NO: 16322 - DNA, 23 bp, synthetic construct
  misc_feature 1..23: note = Synthetic Construct
  source 1..23: mol_type = other DNA
ggaagcgggtgaatagactgaag

SEQ ID NO: 16323 - DNA, 22 bp, synthetic construct
  misc_feature 1..22: note = Synthetic Construct
  source 1..22: mol_type = other DNA
gccctgctgtagtgccttagtt

SEQ ID NO: 16324 - DNA, 19 bp, synthetic construct
  misc_feature 1..19: note = Synthetic Construct
  source 1..19: mol_type = other DNA
ttcaggcccggctatctgt

SEQ ID NO: 16325 - DNA, 22 bp, synthetic construct
  misc_feature 1..22: note = Synthetic Construct
  source 1..22: mol_type = other DNA
ggtgtgcttgtgcttggagaga

SEQ ID NO: 16326 - DNA, 20 bp, synthetic construct
  misc_feature 1..20: note = Synthetic Construct
  source 1..20: mol_type = other DNA
ccccagcgcaacctggtaat

SEQ ID NO: 16327 - DNA, 22 bp, synthetic construct
  misc_feature 1..22: note = Synthetic Construct
  source 1..22: mol_type = other DNA
ctcccacttcctgtcctactga

SEQ ID NO: 16328 - DNA, 24 bp, synthetic construct
  misc_feature 1..24: note = Synthetic Construct
  source 1..24: mol_type = other DNA
ctcctctcctccatttagctcttc

SEQ ID NO: 16329 - DNA, 19 bp, synthetic construct
  misc_feature 1..19: note = Synthetic Construct
  source 1..19: mol_type = other DNA
cagttgcctgcaccaccta

SEQ ID NO: 16330 - DNA, 23 bp, synthetic construct
  misc_feature 1..23: note = Synthetic Construct
  source 1..23: mol_type = other DNA
ggttccaagtgattgtggagtca

SEQ ID NO: 16331 - DNA, 21 bp, synthetic construct
  misc_feature 1..21: note = Synthetic Construct
  source 1..21: mol_type = other DNA
ccctggtccaatgctcctcaa

SEQ ID NO: 16332 - DNA, 20 bp, synthetic construct
  misc_feature 1..20: note = Synthetic Construct
  source 1..20: mol_type = other DNA
acgtcacagcacgagaaagt

SEQ ID NO: 16333 - DNA, 26 bp, synthetic construct
  misc_feature 1..26: note = Synthetic Construct
  source 1..26: mol_type = other DNA
cagaatcacacaagtgggagatgaca

SEQ ID NO: 16334 - DNA, 20 bp, synthetic construct
  misc_feature 1..20: note = Synthetic Construct
  source 1..20: mol_type = other DNA
ccctggactcttgggcaaat

SEQ ID NO: 16335 - DNA, 24 bp, synthetic construct
  misc_feature 1..24: note = Synthetic Construct
  source 1..24: mol_type = other DNA
ccagccccaaactaagaaactgta

SEQ ID NO: 16336 - DNA, 26 bp, synthetic construct
  misc_feature 1..26: note = Synthetic Construct
  source 1..26: mol_type = other DNA
gaccacacaccattgacatatgagat

SEQ ID NO: 16337 - DNA, 22 bp, synthetic construct
  misc_feature 1..22: note = Synthetic Construct
  source 1..22: mol_type = other DNA
agtggttagagcccagcactga

SEQ ID NO: 16338 - DNA, 19 bp, synthetic construct
  misc_feature 1..19: note = Synthetic Construct
  source 1..19: mol_type = other DNA
cctccgtgtaggccagcat

SEQ ID NO: 16339 - DNA, 21 bp, synthetic construct
  misc_feature 1..21: note = Synthetic Construct
  source 1..21: mol_type = other DNA
ccacagcatctctgggactca

SEQ ID NO: 16340 - DNA, 23 bp, synthetic construct
  misc_feature 1..23: note = Synthetic Construct
  source 1..23: mol_type = other DNA
ggaagccaagaggccaaaacgta

SEQ ID NO: 16341 - DNA, 24 bp, synthetic construct
  misc_feature 1..24: note = Synthetic Construct
  source 1..24: mol_type = other DNA
acttctcgatctctgggtctttct

SEQ ID NO: 16342 - DNA, 25 bp, synthetic construct
  misc_feature 1..25: note = Synthetic Construct
  source 1..25: mol_type = other DNA
gcacaacatcttgcatcctgcgtat

SEQ ID NO: 16343 - DNA, 22 bp, synthetic construct
  misc_feature 1..22: note = Synthetic Construct
  source 1..22: mol_type = other DNA
gctttgggtgggtcatttcctt

SEQ ID NO: 16344 - DNA, 22 bp, synthetic construct
  misc_feature 1..22: note = Synthetic Construct
  source 1..22: mol_type = other DNA
gcggaaatccgtgaccacaaca

SEQ ID NO: 16345 - DNA, 22 bp, synthetic construct
  misc_feature 1..22: note = Synthetic Construct
  source 1..22: mol_type = other DNA
agtttcaccctccaccccattc

SEQ ID NO: 16346 - DNA, 18 bp, synthetic construct
  misc_feature 1..18: note = Synthetic Construct
  source 1..18: mol_type = other DNA
tgctgagcccgtttgtgt

SEQ ID NO: 16347 - DNA, 20 bp, synthetic construct
  misc_feature 1..20: note = Synthetic Construct
  source 1..20: mol_type = other DNA
aggcagcggaatggctcttg

SEQ ID NO: 16348 - DNA, 21 bp, synthetic construct
  misc_feature 1..21: note = Synthetic Construct
  source 1..21: mol_type = other DNA
tggtcttccactgcacaaaca

SEQ ID NO: 16349 - DNA, 20 bp, synthetic construct
  misc_feature 1..20: note = Synthetic Construct
  source 1..20: mol_type = other DNA
aatcgagcccagcagctaca

SEQ ID NO: 16350 - DNA, 24 bp, synthetic construct
  misc_feature 1..24: note = Synthetic Construct
  source 1..24: mol_type = other DNA
cccgcttgaaacctaagcatgaga

SEQ ID NO: 16351 - DNA, 22 bp, synthetic construct
  misc_feature 1..22: note = Synthetic Construct
  source 1..22: mol_type = other DNA
tccagctctgacacttggtaac

SEQ ID NO: 16352 - DNA, 25 bp, synthetic construct
  misc_feature 1..25: note = Synthetic Construct
  source 1..25: mol_type = other DNA
gaggctggacgacttgaaatactca

SEQ ID NO: 16353 - DNA, 21 bp, synthetic construct
  misc_feature 1..21: note = Synthetic Construct
  source 1..21: mol_type = other DNA
tctgctgagtgtctcctccat

SEQ ID NO: 16354 - DNA, 23 bp, synthetic construct
  misc_feature 1..23: note = Synthetic Construct
  source 1..23: mol_type = other DNA
ggccaagtacctgcttacctaac

SEQ ID NO: 16355 - DNA, 24 bp, synthetic construct
  misc_feature 1..24: note = Synthetic Construct
  source 1..24: mol_type = other DNA
ccaccgtgctttggatagataaga

SEQ ID NO: 16356 - DNA, 20 bp, synthetic construct
  misc_feature 1..20: note = Synthetic Construct
  source 1..20: mol_type = other DNA
cgctgttgtggagtgagtgt

SEQ ID NO: 16357 - DNA, 22 bp, synthetic construct
  misc_feature 1..22: note = Synthetic Construct
  source 1..22: mol_type = other DNA
tccccaaccctttccttctcat

SEQ ID NO: 16358 - DNA, 21 bp, synthetic construct
  misc_feature 1..21: note = Synthetic Construct
  source 1..21: mol_type = other DNA
tggctcatcccactcccaaac

SEQ ID NO: 16359 - DNA, 22 bp, synthetic construct
  misc_feature 1..22: note = Synthetic Construct
  source 1..22: mol_type = other DNA
gcagctgcctcggaataagcaa

SEQ ID NO: 16360 - DNA, 22 bp, synthetic construct
  misc_feature 1..22: note = Synthetic Construct
  source 1..22: mol_type = other DNA
ggtcttcgtctgctccggtatt

SEQ ID NO: 16361 - DNA, 25 bp, synthetic construct
  misc_feature 1..25: note = Synthetic Construct
  source 1..25: mol_type = other DNA
ctccccatgtttgggttaactcctt

SEQ ID NO: 16362 - DNA, 24 bp, synthetic construct
  misc_feature 1..24: note = Synthetic Construct
  source 1..24: mol_type = other DNA
gtcctgctttcatgtcccctttag

SEQ ID NO: 16363 - DNA, 21 bp, synthetic construct
  misc_feature 1..21: note = Synthetic Construct
  source 1..21: mol_type = other DNA
ccagagccgcctgaatctcat

SEQ ID NO: 16364 - DNA, 24 bp, synthetic construct
  misc_feature 1..24: note = Synthetic Construct
  source 1..24: mol_type = other DNA
tgaaggccccaatctagtcttagt

SEQ ID NO: 16365 - DNA, 20 bp, synthetic construct
  misc_feature 1..20: note = Synthetic Construct
  source 1..20: mol_type = other DNA
tcagccccggctccagtctt

SEQ ID NO: 16366 - DNA, 24 bp, synthetic construct
  misc_feature 1..24: note = Synthetic Construct
  source 1..24: mol_type = other DNA
caggtctcaccaatgccatcaagt

SEQ ID NO: 16367 - DNA, 21 bp, synthetic construct
  misc_feature 1..21: note = Synthetic Construct
  source 1..21: mol_type = other DNA
agcctcctcttagtggtggaa

SEQ ID NO: 16368 - DNA, 21 bp, synthetic construct
  misc_feature 1..21: note = Synthetic Construct
  source 1..21: mol_type = other DNA
ggccaaacgaaagaggactga

SEQ ID NO: 16369 - DNA, 20 bp, synthetic construct
  misc_feature 1..20: note = Synthetic Construct
  source 1..20: mol_type = other DNA
tgcttgaggctgcacgtagt

SEQ ID NO: 16370 - DNA, 22 bp, synthetic construct
  misc_feature 1..22: note = Synthetic Construct
  source 1..22: mol_type = other DNA
cagggaaaagcccaccttcgat

SEQ ID NO: 16371 - DNA, 24 bp, synthetic construct
  misc_feature 1..24: note = Synthetic Construct
  source 1..24: mol_type = other DNA
ggatacatccccagggagttgaca

SEQ ID NO: 16372 - DNA, 26 bp, synthetic construct
  misc_feature 1..26: note = Synthetic Construct
  source 1..26: mol_type = other DNA
gaggaaaactgctgacttatgggtaa

SEQ ID NO: 16373 - DNA, 27 bp, synthetic construct
  misc_feature 1..27: note = Synthetic Construct
  source 1..27: mol_type = other DNA
gagtgagacacccacttcttttacttg

SEQ ID NO: 16374 - DNA, 20 bp, synthetic construct
  misc_feature 1..20: note = Synthetic Construct
  source 1..20: mol_type = other DNA
tgccatcagcctcagtgaac

SEQ ID NO: 16375 - DNA, 24 bp, synthetic construct
  misc_feature 1..24: note = Synthetic Construct
  source 1..24: mol_type = other DNA
gagtcgaacacagcgctgaaaaac

SEQ ID NO: 16376 - DNA, 22 bp, synthetic construct
  misc_feature 1..22: note = Synthetic Construct
  source 1..22: mol_type = other DNA
ggccttgacacagtccagatga

SEQ ID NO: 16377 - DNA, 20 bp, synthetic construct
  misc_feature 1..20: note = Synthetic Construct
  source 1..20: mol_type = other DNA
caactgaccgcagacgtgtt

SEQ ID NO: 16378 - DNA, 20 bp, synthetic construct
  misc_feature 1..20: note = Synthetic Construct
  source 1..20: mol_type = other DNA
cgcaacttcccaacctcctt

SEQ ID NO: 16379 - DNA, 20 bp, synthetic construct
  misc_feature 1..20: note = Synthetic Construct
  source 1..20: mol_type = other DNA
aagtggacggctgtgactga

SEQ ID NO: 16380 - DNA, 19 bp, synthetic construct
  misc_feature 1..19: note = Synthetic Construct
  source 1..19: mol_type = other DNA
tcagtgccccttccccaat

SEQ ID NO: 16381 - DNA, 23 bp, synthetic construct
  misc_feature 1..23: note = Synthetic Construct
  source 1..23: mol_type = other DNA
gggtctacacctgcaaggactga

SEQ ID NO: 16382 - DNA, 22 bp, synthetic construct
  misc_feature 1..22: note = Synthetic Construct
  source 1..22: mol_type = other DNA
cacacaacacttccgcccacat

SEQ ID NO: 16383 - DNA, 22 bp, synthetic construct
  misc_feature 1..22: note = Synthetic Construct
  source 1..22: mol_type = other DNA
caagcaatatccccagccactt

SEQ ID NO: 16384 - DNA, 23 bp, synthetic construct
  misc_feature 1..23: note = Synthetic Construct
  source 1..23: mol_type = other DNA
ctctgcactgaggactggtttca

SEQ ID NO: 16385 - DNA, 22 bp, synthetic construct
  misc_feature 1..22: note = Synthetic Construct
  source 1..22: mol_type = other DNA
tgcctgacatgtaggaggttct

SEQ ID NO: 16386 - DNA, 20 bp, synthetic construct
  misc_feature 1..20: note = Synthetic Construct
  source 1..20: mol_type = other DNA
cagagtctgggcacctcgtt

SEQ ID NO: 16387 - DNA, 23 bp, synthetic construct
  misc_feature 1..23: note = Synthetic Construct
  source 1..23: mol_type = other DNA
actccgcagggagccttatctac

SEQ ID NO: 16388 - DNA, 26 bp, synthetic construct
  misc_feature 1..26: note = Synthetic Construct
  source 1..26: mol_type = other DNA
gaaggttccttgacataacaggtttc

SEQ ID NO: 16389 - DNA, 24 bp, synthetic construct
  misc_feature 1..24: note = Synthetic Construct
  source 1..24: mol_type = other DNA
ccctctgtgtctttcgtgctactt

SEQ ID NO: 16390 - DNA, 23 bp, synthetic construct
  misc_feature 1..23: note = Synthetic Construct
  source 1..23: mol_type = other DNA
ccctgaattctcccttgcctaac

SEQ ID NO: 16391 - DNA, 22 bp, synthetic construct
  misc_feature 1..22: note = Synthetic Construct
  source 1..22: mol_type = other DNA
gccccaaagtggcagagttttg

SEQ ID NO: 16392 - DNA, 22 bp, synthetic construct
  misc_feature 1..22: note = Synthetic Construct
  source 1..22: mol_type = other DNA
gccggactgagaaatgcctgaa

SEQ ID NO: 16393 - DNA, 23 bp, synthetic construct
  misc_feature 1..23: note = Synthetic Construct
  source 1..23: mol_type = other DNA
ggatgcctacgtttctggtgaga

SEQ ID NO: 16394 - DNA, 20 bp, synthetic construct
  misc_feature 1..20: note = Synthetic Construct
  source 1..20: mol_type = other DNA
ggcgtcctagagggacgtaa

SEQ ID NO: 16395 - DNA, 23 bp, synthetic construct
  misc_feature 1..23: note = Synthetic Construct
  source 1..23: mol_type = other DNA
gctgctggaattggaccttttac

SEQ ID NO: 16396 - DNA, 21 bp, synthetic construct
  misc_feature 1..21: note = Synthetic Construct
  source 1..21: mol_type = other DNA
tggtggtcatccccactttct

SEQ ID NO: 16397 - DNA, 25 bp, synthetic construct
  misc_feature 1..25: note = Synthetic Construct
  source 1..25: mol_type = other DNA
ctcgatgcttgtggttttactgttc

SEQ ID NO: 16398 - DNA, 26 bp, synthetic construct
  misc_feature 1..26: note = Synthetic Construct
  source 1..26: mol_type = other DNA
tcgggagttaaccccaaatagtaaac

SEQ ID NO: 16399 - DNA, 23 bp, synthetic construct
  misc_feature 1..23: note = Synthetic Construct
  source 1..23: mol_type = other DNA
cctccactgggtgaagtttgaag

SEQ ID NO: 16400 - DNA, 19 bp, synthetic construct
  misc_feature 1..19: note = Synthetic Construct
  source 1..19: mol_type = other DNA
tcggctctcagggcgtatc

SEQ ID NO: 16401 - DNA, 21 bp, synthetic construct
  misc_feature 1..21: note = Synthetic Construct
  source 1..21: mol_type = other DNA
aggaaggaccccatggctcta

SEQ ID NO: 16402 - DNA, 25 bp, synthetic construct
  misc_feature 1..25: note = Synthetic Construct
  source 1..25: mol_type = other DNA
tcgtgtttgattgacccatgttact

SEQ ID NO: 16403 - DNA, 27 bp, synthetic construct
  misc_feature 1..27: note = Synthetic Construct
  source 1..27: mol_type = other DNA
gggaccaagtcaaaccaagagtctttc

SEQ ID NO: 16404 - DNA, 26 bp, synthetic construct
  misc_feature 1..26: note = Synthetic Construct
  source 1..26: mol_type = other DNA
gctatggaaagttttctggtggagtt

SEQ ID NO: 16405 - DNA, 26 bp, synthetic construct
  misc_feature 1..26: note = Synthetic Construct
  source 1..26: mol_type = other DNA
cctcagagacagatgccattgaatta

SEQ ID NO: 16406 - DNA, 23 bp, synthetic construct
  misc_feature 1..23: note = Synthetic Construct
  source 1..23: mol_type = other DNA
cttctggaggacttgggttgaga

SEQ ID NO: 16407 - DNA, 24 bp, synthetic construct
  misc_feature 1..24: note = Synthetic Construct
  source 1..24: mol_type = other DNA
ccctttcttggccagactaacagt

SEQ ID NO: 16408 - DNA, 23 bp, synthetic construct
  misc_feature 1..23: note = Synthetic Construct
  source 1..23: mol_type = other DNA
gcaaggtgctgaagctattcaag

SEQ ID NO: 16409 - DNA, 22 bp, synthetic construct
  misc_feature 1..22: note = Synthetic Construct
  source 1..22: mol_type = other DNA
accagcagcagaggaggatgta

SEQ ID NO: 16410 - DNA, 24 bp, synthetic construct
  misc_feature 1..24: note = Synthetic Construct
  source 1..24: mol_type = other DNA
gccccttgagagtcttgcaggaaa

SEQ ID NO: 16411 - DNA, 23 bp, synthetic construct
  misc_feature 1..23: note = Synthetic Construct
  source 1..23: mol_type = other DNA
tccgtgtgtagtctctccagtag

SEQ ID NO: 16412 - DNA, 21 bp, synthetic construct
  misc_feature 1..21: note = Synthetic Construct
  source 1..21: mol_type = other DNA
cactttgccagtcccgtctaa

SEQ ID NO: 16413 - DNA, 23 bp, synthetic construct
  misc_feature 1..23: note = Synthetic Construct
  source 1..23: mol_type = other DNA
ggtggttgggagtcacctactga

SEQ ID NO: 16414 - DNA, 19 bp, synthetic construct
  misc_feature 1..19: note = Synthetic Construct
  source 1..19: mol_type = other DNA
agccttggccgtgggagat

SEQ ID NO: 16415 - DNA, 21 bp, synthetic construct
  misc_feature 1..21: note = Synthetic Construct
  source 1..21: mol_type = other DNA
acatacctttgcgagctggtt

SEQ ID NO: 16416 - DNA, 23 bp, synthetic construct
  misc_feature 1..23: note = Synthetic Construct
  source 1..23: mol_type = other DNA
ggcttagaccaggagtggaatga

SEQ ID NO: 16417 - DNA, 24 bp, synthetic construct
  misc_feature 1..24: note = Synthetic Construct
  source 1..24: mol_type = other DNA
cgggataggagactttggttggtt

SEQ ID NO: 16418 - DNA, 23 bp, synthetic construct
  misc_feature 1..23: note = Synthetic Construct
  source 1..23: mol_type = other DNA
ctggagccatcactgataccttt

SEQ ID NO: 16419 - DNA, 22 bp, synthetic construct
  misc_feature 1..22: note = Synthetic Construct
  source 1..22: mol_type = other DNA
cctgctgtgaaaggtggtgaga

SEQ ID NO: 16420 - DNA, 25 bp, synthetic construct
  misc_feature 1..25: note = Synthetic Construct
  source 1..25: mol_type = other DNA
ggccttgtaattctacgcaccagat

SEQ ID NO: 16421 - DNA, 25 bp, synthetic construct
  misc_feature 1..25: note = Synthetic Construct
  source 1..25: mol_type = other DNA
ccaacgtgtcaatatgctgttgatt

SEQ ID NO: 16422 - DNA, 18 bp, synthetic construct
  misc_feature 1..18: note = Synthetic Construct
  source 1..18: mol_type = other DNA
ggggcttgcatccccttt

SEQ ID NO: 16423 - DNA, 22 bp, synthetic construct
  misc_feature 1..22: note = Synthetic Construct
  source 1..22: mol_type = other DNA
ggcactacctcacttcctttgt

SEQ ID NO: 16424 - DNA, 23 bp, synthetic construct
  misc_feature 1..23: note = Synthetic Construct
  source 1..23: mol_type = other DNA
gtggtttctggcttttggaggaa

SEQ ID NO: 16425 - DNA, 24 bp, synthetic construct
  misc_feature 1..24: note = Synthetic Construct
  source 1..24: mol_type = other DNA
ctctccctccctcaagtacacaga

SEQ ID NO: 16426 - DNA, 25 bp, synthetic construct
  misc_feature 1..25: note = Synthetic Construct
  source 1..25: mol_type = other DNA
acccaggcatgttagtgtttttcta

SEQ ID NO: 16427 - DNA, 22 bp, synthetic construct
  misc_feature 1..22: note = Synthetic Construct
  source 1..22: mol_type = other DNA
gcctgtgtggtccctcttcttc

SEQ ID NO: 16428 - DNA, 26 bp, synthetic construct
  misc_feature 1..26: note = Synthetic Construct
  source 1..26: mol_type = other DNA
ctgaaaggaccaggctaataatgact

SEQ ID NO: 16429 - DNA, 22 bp, synthetic construct
  misc_feature 1..22: note = Synthetic Construct
  source 1..22: mol_type = other DNA
ttcagagtcgggcactccatag

SEQ ID NO: 16430 - DNA, 24 bp, synthetic construct
  misc_feature 1..24: note = Synthetic Construct
  source 1..24: mol_type = other DNA
gctctcggagaaagacttgagtaa

SEQ ID NO: 16431 - DNA, 19 bp, synthetic construct
  misc_feature 1..19: note = Synthetic Construct
  source 1..19: mol_type = other DNA
ccaggcctcagcctgtgtt

SEQ ID NO: 16432 - DNA, 23 bp, synthetic construct
  misc_feature 1..23: note = Synthetic Construct
  source 1..23: mol_type = other DNA
gggaatgcatcttccccaactgt

SEQ ID NO: 16433 - DNA, 24 bp, synthetic construct
  misc_feature 1..24: note = Synthetic Construct
  source 1..24: mol_type = other DNA
aatctaaagtccagagcagcaagt

SEQ ID NO: 16434 - DNA, 23 bp, synthetic construct
  misc_feature 1..23: note = Synthetic Construct
  source 1..23: mol_type = other DNA
ggagccgaaagaaggcttttaga

SEQ ID NO: 16435 - DNA, 22 bp, synthetic construct
  misc_feature 1..22: note = Synthetic Construct
  source 1..22: mol_type = other DNA
tggggcactggaaagtaagttg

SEQ ID NO: 16436 - DNA, 21 bp, synthetic construct
  misc_feature 1..21: note = Synthetic Construct
  source 1..21: mol_type = other DNA
gggccctttgtgactgtgttc

SEQ ID NO: 16437 - DNA, 23 bp, synthetic construct
  misc_feature 1..23: note = Synthetic Construct
  source 1..23: mol_type = other DNA
gccagacaatgtgaggtgctgat

SEQ ID NO: 16438 - DNA, 19 bp, synthetic construct
  misc_feature 1..19: note = Synthetic Construct
  source 1..19: mol_type = other DNA
tgggtggggatgggtaaca

SEQ ID NO: 16439 - DNA, 24 bp, synthetic construct
  misc_feature 1..24: note = Synthetic Construct
  source 1..24: mol_type = other DNA
gcgagacaaaaggggatattcaag

SEQ ID NO: 16440 - DNA, 23 bp, synthetic construct
  misc_feature 1..23: note = Synthetic Construct
  source 1..23: mol_type = other DNA
cgagtaagtcaggtctccagatg

SEQ ID NO: 16441 - DNA, 21 bp, synthetic construct
  misc_feature 1..21: note = Synthetic Construct
  source 1..21: mol_type = other DNA
ggggatggcatcattgtgaga

SEQ ID NO: 16442 - DNA, 22 bp, synthetic construct
  misc_feature 1..22: note = Synthetic Construct
  source 1..22: mol_type = other DNA
ctgggaacgacagagaatcaca

SEQ ID NO: 16443 - DNA, 25 bp, synthetic construct
  misc_feature 1..25: note = Synthetic Construct
  source 1..25: mol_type = other DNA
ggatcatgcagagagagctgagaca

SEQ ID NO: 16444 - DNA, 19 bp, synthetic construct
  misc_feature 1..19: note = Synthetic Construct
  source 1..19: mol_type = other DNA
gagccgtggctctgtcact

SEQ ID NO: 16445 - DNA, 24 bp, synthetic construct
  misc_feature 1..24: note = Synthetic Construct
  source 1..24: mol_type = other DNA
cactccttctcctgtggggatttg

SEQ ID NO: 16446 - DNA, 25 bp, synthetic construct
  misc_feature 1..25: note = Synthetic Construct
  source 1..25: mol_type = other DNA
cggtagatctgatcctggaacttct

SEQ ID NO: 16447 - DNA, 21 bp, synthetic construct
  misc_feature 1..21: note = Synthetic Construct
  source 1..21: mol_type = other DNA
ccttgctgctcattggcttct

SEQ ID NO: 16448 - DNA, 24 bp, synthetic construct
  misc_feature 1..24: note = Synthetic Construct
  source 1..24: mol_type = other DNA
ctcttcatcttagccagtccactt

SEQ ID NO: 16449 - DNA, 22 bp, synthetic construct
  misc_feature 1..22: note = Synthetic Construct
  source 1..22: mol_type = other DNA
ggcttgtccaaggtccatgata

SEQ ID NO: 16450 - DNA, 20 bp, synthetic construct
  misc_feature 1..20: note = Synthetic Construct
  source 1..20: mol_type = other DNA
tccagggagggctggagact

SEQ ID NO: 16451 - DNA, 22 bp, synthetic construct
  misc_feature 1..22: note = Synthetic Construct
  source 1..22: mol_type = other DNA
gggccacgcaattttcctgtga

SEQ ID NO: 16452 - DNA, 23 bp, synthetic construct
  misc_feature 1..23: note = Synthetic Construct
  source 1..23: mol_type = other DNA
gtagtggggatctgacctaggaa

SEQ ID NO: 16453 - DNA, 19 bp, synthetic construct
  misc_feature 1..19: note = Synthetic Construct
  source 1..19: mol_type = other DNA
ccaccatcggcccatgtca

SEQ ID NO: 16454 - DNA, 19 bp, synthetic construct
  misc_feature 1..19: note = Synthetic Construct
  source 1..19: mol_type = other DNA
acgggagggcagtgagctt

SEQ ID NO: 16455 - DNA, 22 bp, synthetic construct
  misc_feature 1..22: note = Synthetic Construct
  source 1..22: mol_type = other DNA
tggtggtgtgtgcctgtagttc

SEQ ID NO: 16456 - DNA, 22 bp, synthetic construct
  misc_feature 1..22: note = Synthetic Construct
  source 1..22: mol_type = other DNA
cccacacacagaacgtggaaac

SEQ ID NO: 16457 - DNA, 22 bp, synthetic construct
  misc_feature 1..22: note = Synthetic Construct
  source 1..22: mol_type = other DNA
gaagagcaggaggaggcaagaa

SEQ ID NO: 16458 - DNA, 22 bp, synthetic construct
  misc_feature 1..22: note = Synthetic Construct
  source 1..22: mol_type = other DNA
gccaaactggctgggttacatc

SEQ ID NO: 16459 - DNA, 23 bp, synthetic construct
  misc_feature 1..23: note = Synthetic Construct
  source 1..23: mol_type = other DNA
gtgggtaatgacagcaactgaga

SEQ ID NO: 16460 - DNA, 22 bp, synthetic construct
  misc_feature 1..22: note = Synthetic Construct
  source 1..22: mol_type = other DNA
ggccctgggaagacttcaacaa

SEQ ID NO: 16461 - DNA, 22 bp, synthetic construct
  misc_feature 1..22: note = Synthetic Construct
  source 1..22: mol_type = other DNA
ccagaggccttgccagaacatt

SEQ ID NO: 16462 - DNA, 23 bp, synthetic construct
  misc_feature 1..23: note = Synthetic Construct
  source 1..23: mol_type = other DNA
aacccaggagactcagggtctgt

SEQ ID NO: 16463 - DNA, 22 bp, synthetic construct
  misc_feature 1..22: note = Synthetic Construct
  source 1..22: mol_type = other DNA
gcggttgtgagaaacacactga

SEQ ID NO: 16464 - DNA, 22 bp, synthetic construct
  misc_feature 1..22: note = Synthetic Construct
  source 1..22: mol_type = other DNA
actatcatcgctcccgaaggaa

SEQ ID NO: 16465 - DNA, 19 bp, synthetic construct
  misc_feature 1..19: note = Synthetic Construct
  source 1..19: mol_type = other DNA
gctgagcctggacgcttgt

SEQ ID NO: 16466 - DNA, 20 bp, synthetic construct
  misc_feature 1..20: note = Synthetic Construct
  source 1..20: mol_type = other DNA
tccccttgcaagaccgattg

SEQ ID NO: 16467 - DNA, 24 bp, synthetic construct
  misc_feature 1..24: note = Synthetic Construct
  source 1..24: mol_type = other DNA
gttctactcggcttctggaaagat

SEQ ID NO: 16468 - DNA, 22 bp, synthetic construct
  misc_feature 1..22: note = Synthetic Construct
  source 1..22: mol_type = other DNA
cactcccgggttttgtgtgaat

SEQ ID NO: 16469 - DNA, 19 bp, synthetic construct
  misc_feature 1..19: note = Synthetic Construct
  source 1..19: mol_type = other DNA
actgcccacccctcaaaac

SEQ ID NO: 16470 - DNA, 22 bp, synthetic construct
  misc_feature 1..22: note = Synthetic Construct
  source 1..22: mol_type = other DNA
gctagaccctccctcccaatgt

SEQ ID NO: 16471 - DNA, 19 bp, synthetic construct
  misc_feature 1..19: note = Synthetic Construct
  source 1..19: mol_type = other DNA
cagaaccccagcgcgatct

SEQ ID NO: 16472 - DNA, 19 bp, synthetic construct
  misc_feature 1..19: note = Synthetic Construct
  source 1..19: mol_type = other DNA
agcggagcctgggcaatgt

SEQ ID NO: 16473 - DNA, 22 bp, synthetic construct
  misc_feature 1..22: note = Synthetic Construct
  source 1..22: mol_type = other DNA
gccggtgccattcgtatccatt

SEQ ID NO: 16474 - DNA, 23 bp, synthetic construct
  misc_feature 1..23: note = Synthetic Construct
  source 1..23: mol_type = other DNA
cgaagtcccaatggcaactttca

SEQ ID NO: 16475 - DNA, 21 bp, synthetic construct
  misc_feature 1..21: note = Synthetic Construct
  source 1..21: mol_type = other DNA
ggtcgcggattgtgctgtcta

SEQ ID NO: 16476 - DNA, 20 bp, synthetic construct
  misc_feature 1..20: note = Synthetic Construct
  source 1..20: mol_type = other DNA
acggggccaacgaggggaat

SEQ ID NO: 16477 - DNA, 22 bp, synthetic construct
  misc_feature 1..22: note = Synthetic Construct
  source 1..22: mol_type = other DNA
ccaggcccaaacccactacaaa

SEQ ID NO: 16478 - DNA, 22 bp, synthetic construct
  misc_feature 1..22: note = Synthetic Construct
  source 1..22: mol_type = other DNA
ggagttttgcacagggacttct

SEQ ID NO: 16479 - DNA, 21 bp, synthetic construct
  misc_feature 1..21: note = Synthetic Construct
  source 1..21: mol_type = other DNA
cagtgggaaagccacggacat

SEQ ID NO: 16480 - DNA, 23 bp, synthetic construct
  misc_feature 1..23: note = Synthetic Construct
  source 1..23: mol_type = other DNA
ggcataggggaccaggaaagtct

SEQ ID NO: 16481 - DNA, 23 bp, synthetic construct
  misc_feature 1..23: note = Synthetic Construct
  source 1..23: mol_type = other DNA
gggtttgactcatgggagtgtgt

SEQ ID NO: 16482 - DNA, 21 bp, synthetic construct
  misc_feature 1..21: note = Synthetic Construct
  source 1..21: mol_type = other DNA
ccccttcctggatttgcttct

SEQ ID NO: 16483 - DNA, 25 bp, synthetic construct
  misc_feature 1..25: note = Synthetic Construct
  source 1..25: mol_type = other DNA
gagagaactgtagtggcgattttct

SEQ ID NO: 16484 - DNA, 22 bp, synthetic construct
  misc_feature 1..22: note = Synthetic Construct
  source 1..22: mol_type = other DNA
tgccaaggtgtcctgtctgttc

SEQ ID NO: 16485 - DNA, 23 bp, synthetic construct
  misc_feature 1..23: note = Synthetic Construct
  source 1..23: mol_type = other DNA
gcgttgaaactgtgctctcaact

SEQ ID NO: 16486 - DNA, 23 bp, synthetic construct
  misc_feature 1..23: note = Synthetic Construct
  source 1..23: mol_type = other DNA
gcccacatgtgttactggtggat

SEQ ID NO: 16487 - DNA, 19 bp, synthetic construct
  misc_feature 1..19: note = Synthetic Construct
  source 1..19: mol_type = other DNA
gcaggcagccgtgagcata

SEQ ID NO: 16488 - DNA, 21 bp, synthetic construct
  misc_feature 1..21: note = Synthetic Construct
  source 1..21: mol_type = other DNA
ctctgcctcacccattcttgt

SEQ ID NO: 16489 - DNA, 20 bp, synthetic construct
  misc_feature 1..20: note = Synthetic Construct
  source 1..20: mol_type = other DNA
agttgaaggcgctggagaag

SEQ ID NO: 16490 - DNA, 19 bp, synthetic construct
  misc_feature 1..19: note = Synthetic Construct
  source 1..19: mol_type = other DNA
acgcacacaccggcataca

SEQ ID NO: 16491 - DNA, 21 bp, synthetic construct
  misc_feature 1..21: note = Synthetic Construct
  source 1..21: mol_type = other DNA
ccaaatggccagctgtgaagt

SEQ ID NO: 16492 - DNA, 24 bp, synthetic construct
  misc_feature 1..24: note = Synthetic Construct
  source 1..24: mol_type = other DNA
ggctgtccagaattggactttatg

SEQ ID NO: 16493 - DNA, 20 bp, synthetic construct
  misc_feature 1..20: note = Synthetic Construct
  source 1..20: mol_type = other DNA
aggctgcccttaagcacgtt

SEQ ID NO: 16494 - DNA, 23 bp, synthetic construct
  misc_feature 1..23: note = Synthetic Construct
  source 1..23: mol_type = other DNA
caggtcaacgtctcatcttcgtt

SEQ ID NO: 16495 - DNA, 19 bp, synthetic construct
  misc_feature 1..19: note = Synthetic Construct
  source 1..19: mol_type = other DNA
tctgccaaggggtcaccat

SEQ ID NO: 16496 - DNA, 21 bp, synthetic construct
  misc_feature 1..21: note = Synthetic Construct
  source 1..21: mol_type = other DNA
gcatcagtgcccattcacaca

SEQ ID NO: 16497 - DNA, 26 bp, synthetic construct
  misc_feature 1..26: note = Synthetic Construct
  source 1..26: mol_type = other DNA
ccgagttccagccatttgtaaagttc

SEQ ID NO: 16498 - DNA, 22 bp, synthetic construct
  misc_feature 1..22: note = Synthetic Construct
  source 1..22: mol_type = other DNA
gcccttcaggcttctgtgagta

SEQ ID NO: 16499 - DNA, 23 bp, synthetic construct
  misc_feature 1..23: note = Synthetic Construct
  source 1..23: mol_type = other DNA
gctacacttccagctagcacttg

SEQ ID NO: 16500 - DNA, 21 bp, synthetic construct
  misc_feature 1..21: note = Synthetic Construct
  source 1..21: mol_type = other DNA
ggctcacatgctttccagtga

SEQ ID NO: 16501 - DNA, 21 bp, synthetic construct
  misc_feature 1..21: note = Synthetic Construct
  source 1..21: mol_type = other DNA
ctggccagaactgtgtgtcat

SEQ ID NO: 16502 - DNA, 23 bp, synthetic construct
  misc_feature 1..23: note = Synthetic Construct
  source 1..23: mol_type = other DNA
caatcctcccacctccagagtag

SEQ ID NO: 16503 - DNA, 19 bp, synthetic construct
  misc_feature 1..19: note = Synthetic Construct
  source 1..19: mol_type = other DNA
agccatgcccacccactga

SEQ ID NO: 16504 - DNA, 23 bp, synthetic construct
  misc_feature 1..23: note = Synthetic Construct
  source 1..23: mol_type = other DNA
accccacaatttccactcattct

SEQ ID NO: 16505 - DNA, 23 bp, synthetic construct
  misc_feature 1..23: note = Synthetic Construct
  source 1..23: mol_type = other DNA
cggcccttgttacatatccagtt

SEQ ID NO: 16506 - DNA, 20 bp, synthetic construct
  misc_feature 1..20: note = Synthetic Construct
  source 1..20: mol_type = other DNA
caggccagggagagctttgt

SEQ ID NO: 16507 - DNA, 22 bp, synthetic construct
  misc_feature 1..22: note = Synthetic Construct
  source 1..22: mol_type = other DNA
cccagagcatagaagccgatca

SEQ ID NO: 16508 - DNA, 24 bp, synthetic construct
  misc_feature 1..24: note = Synthetic Construct
  source 1..24: mol_type = other DNA
ccacctttacccaggagaaactca

SEQ ID NO: 16509 - DNA, 24 bp, synthetic construct
  misc_feature 1..24: note = Synthetic Construct
  source 1..24: mol_type = other DNA
tgctctgatacacgaaaagcatgt

SEQ ID NO: 16510 - DNA, 22 bp, synthetic construct
  misc_feature 1..22: note = Synthetic Construct
  source 1..22: mol_type = other DNA
ccagaaacagcaggggaattgt

SEQ ID NO: 16511 - DNA, 21 bp, synthetic construct
  misc_feature 1..21: note = Synthetic Construct
  source 1..21: mol_type = other DNA
atgccccagggaagaccattc

SEQ ID NO: 16512 - DNA, 22 bp, synthetic construct
  misc_feature 1..22: note = Synthetic Construct
  source 1..22: mol_type = other DNA
gcgaagcaccaaagggtgatgt

SEQ ID NO: 16513 - DNA, 19 bp, synthetic construct
  misc_feature 1..19: note = Synthetic Construct
  source 1..19: mol_type = other DNA
aggcttggccttgctttca

SEQ ID NO: 16514 - DNA, 20 bp, synthetic construct
  misc_feature 1..20: note = Synthetic Construct
  source 1..20: mol_type = other DNA
ccgggcgtgtttgacttaca

SEQ ID NO: 16515 - DNA, 22 bp, synthetic construct
  misc_feature 1..22: note = Synthetic Construct
  source 1..22: mol_type = other DNA
ccaaaggtgtaagtcgcagtct

SEQ ID NO: 16516 - DNA, 23 bp, synthetic construct
  misc_feature 1..23: note = Synthetic Construct
  source 1..23: mol_type = other DNA
ctggaaggtctgtggggtctgta

SEQ ID NO: 16517 - DNA, 23 bp, synthetic construct
  misc_feature 1..23: note = Synthetic Construct
  source 1..23: mol_type = other DNA
gctctgtgcttcctcatctgctt

SEQ ID NO: 16518 - DNA, 22 bp, synthetic construct
  misc_feature 1..22: note = Synthetic Construct
  source 1..22: mol_type = other DNA
cttcatcagggccagaatcctt

SEQ ID NO: 16519 - DNA, 20 bp, synthetic construct
  misc_feature 1..20: note = Synthetic Construct
  source 1..20: mol_type = other DNA
tccatctcccaccacctgtt

SEQ ID NO: 16520 - DNA, 21 bp, synthetic construct
  misc_feature 1..21: note = Synthetic Construct
  source 1..21: mol_type = other DNA
cgcggtaactccacaatcaca

SEQ ID NO: 16521 - DNA, 21 bp, synthetic construct
  misc_feature 1..21: note = Synthetic Construct
  source 1..21: mol_type = other DNA
gcagttggcaagacagcaaga

SEQ ID NO: 16522 - DNA, 24 bp, synthetic construct
  misc_feature 1..24: note = Synthetic Construct
  source 1..24: mol_type = other DNA
cactggcttggaacatgaggctta

SEQ ID NO: 16523 - DNA, 22 bp, synthetic construct
  misc_feature 1..22: note = Synthetic Construct
  source 1..22: mol_type = other DNA
acagtcctcactccacgtcaca

SEQ ID NO: 16524 - DNA, 25 bp, synthetic construct
  misc_feature 1..25: note = Synthetic Construct
  source 1..25: mol_type = other DNA
ggccatgggatctctgtgataacta

SEQ ID NO: 16525 - DNA, 27 bp, synthetic construct
  misc_feature 1..27: note = Synthetic Construct
  source 1..27: mol_type = other DNA
gttagcctctgactattccttacatca

SEQ ID NO: 16526 - DNA, 22 bp, synthetic construct
  misc_feature 1..22: note = Synthetic Construct
  source 1..22: mol_type = other DNA
tggtgcaatgcctccttaagtt

SEQ ID NO: 16527 - DNA, 21 bp, synthetic construct
  misc_feature 1..21: note = Synthetic Construct
  source 1..21: mol_type = other DNA
aaacgctgcctccctgctcaa

SEQ ID NO: 16528 - DNA, 23 bp, synthetic construct
  misc_feature 1..23: note = Synthetic Construct
  source 1..23: mol_type = other DNA
gttcattctaggaggcagtggaa

SEQ ID NO: 16529 - DNA, 20 bp, synthetic construct
  misc_feature 1..20: note = Synthetic Construct
  source 1..20: mol_type = other DNA
atcccacaggtggggagctt

SEQ ID NO: 16530 - DNA, 21 bp, synthetic construct
  misc_feature 1..21: note = Synthetic Construct
  source 1..21: mol_type = other DNA
acaggagtgcctggctaatga

SEQ ID NO: 16531 - DNA, 20 bp, synthetic construct
  misc_feature 1..20: note = Synthetic Construct
  source 1..20: mol_type = other DNA
tggccacaccaccctagctt

SEQ ID NO: 16532 - DNA, 24 bp, synthetic construct
  misc_feature 1..24: note = Synthetic Construct
  source 1..24: mol_type = other DNA
gctcaaatccacccagaggtcaca

SEQ ID NO: 16533 - DNA, 21 bp, synthetic construct
  misc_feature 1..21: note = Synthetic Construct
  source 1..21: mol_type = other DNA
caaggagaagacggcctgcaa

SEQ ID NO: 16534 - DNA, 22 bp, synthetic construct
  misc_feature 1..22: note = Synthetic Construct
  source 1..22: mol_type = other DNA
acgtgcactgaataccggaaag

SEQ ID NO: 16535 - DNA, 20 bp, synthetic construct
  misc_feature 1..20: note = Synthetic Construct
  source 1..20: mol_type = other DNA
aacccacgaacagcctcact

SEQ ID NO: 16536 - DNA, 22 bp, synthetic construct
  misc_feature 1..22: note = Synthetic Construct
  source 1..22: mol_type = other DNA
cgtctgctgcgctgttagaaac

SEQ ID NO: 16537 - DNA, 22 bp, synthetic construct
  misc_feature 1..22: note = Synthetic Construct
  source 1..22: mol_type = other DNA
tgtgactggaggtggcatcact

SEQ ID NO: 16538 - DNA, 25 bp, synthetic construct
  misc_feature 1..25: note = Synthetic Construct
  source 1..25: mol_type = other DNA
cacgtgtgttctacctgatgctgaa

SEQ ID NO: 16539 - DNA, 21 bp, synthetic construct
  misc_feature 1..21: note = Synthetic Construct
  source 1..21: mol_type = other DNA
ggagagagggtctcaccttgt

SEQ ID NO: 16540 - DNA, 20 bp, synthetic construct
  misc_feature 1..20: note = Synthetic Construct
  source 1..20: mol_type = other DNA
tttcaccgccgcacagagaa

SEQ ID NO: 16541 - DNA, 20 bp, synthetic construct
  misc_feature 1..20: note = Synthetic Construct
  source 1..20: mol_type = other DNA
tcaacgccccgggccaattc

SEQ ID NO: 16542 - DNA, 26 bp, synthetic construct
  misc_feature 1..26: note = Synthetic Construct
  source 1..26: mol_type = other DNA
ccttgaagtccattttcaccagtatg

SEQ ID NO: 16543 - DNA, 22 bp, synthetic construct
  misc_feature 1..22: note = Synthetic Construct
  source 1..22: mol_type = other DNA
acacccaatgagcttggtttga

SEQ ID NO: 16544 - DNA, 21 bp, synthetic construct
  misc_feature 1..21: note = Synthetic Construct
  source 1..21: mol_type = other DNA
atccagccttctgggccattc

SEQ ID NO: 16545 - DNA, 23 bp, synthetic construct
  misc_feature 1..23: note = Synthetic Construct
  source 1..23: mol_type = other DNA
cctcctcccctcttgcacagtta

SEQ ID NO: 16546 - DNA, 26 bp, synthetic construct
  misc_feature 1..26: note = Synthetic Construct
  source 1..26: mol_type = other DNA
ctctctagttcaagctccttgcttgt

SEQ ID NO: 16547 - DNA, 21 bp, synthetic construct
  misc_feature 1..21: note = Synthetic Construct
  source 1..21: mol_type = other DNA
catgctggggacagactctca

SEQ ID NO: 16548 - DNA, 26 bp, synthetic construct
  misc_feature 1..26: note = Synthetic Construct
  source 1..26: mol_type = other DNA
ccagaaatgtggcttagaggaaggaa

SEQ ID NO: 16549 - DNA, 20 bp, synthetic construct
  misc_feature 1..20: note = Synthetic Construct
  source 1..20: mol_type = other DNA
gctggggtgggattgcttga

SEQ ID NO: 16550 - DNA, 22 bp, synthetic construct
  misc_feature 1..22: note = Synthetic Construct
  source 1..22: mol_type = other DNA
cattagcagcggacaggaccaa

SEQ ID NO: 16551 - DNA, 24 bp, synthetic construct
  misc_feature 1..24: note = Synthetic Construct
  source 1..24: mol_type = other DNA
ggagaccggtgttttcttctcttg

SEQ ID NO: 16552 - DNA, 21 bp, synthetic construct
  misc_feature 1..21: note = Synthetic Construct
  source 1..21: mol_type = other DNA
caaaggcactgacaggtgtgt

SEQ ID NO: 16553 - DNA, 22 bp, synthetic construct
  misc_feature 1..22: note = Synthetic Construct
  source 1..22: mol_type = other DNA
tccattcccctactcccagcat

SEQ ID NO: 16554 - DNA, 22 bp, synthetic construct
  misc_feature 1..22: note = Synthetic Construct
  source 1..22: mol_type = other DNA
gggagcaagagtggatcgttct

SEQ ID NO: 16555 - DNA, 22 bp, synthetic construct
  misc_feature 1..22: note = Synthetic Construct
  source 1..22: mol_type = other DNA
gtgagtctaggcttcccagcaa

SEQ ID NO: 16556 - DNA, 21 bp, synthetic construct
  misc_feature 1..21: note = Synthetic Construct
  source 1..21: mol_type = other DNA
cgcgttcacaaatcgctcttc

SEQ ID NO: 16557 - DNA, 25 bp, synthetic construct
  misc_feature 1..25: note = Synthetic Construct
  source 1..25: mol_type = other DNA
cccttgtttctttcctcagggctaa

SEQ ID NO: 16558 - DNA, 20 bp, synthetic construct
  misc_feature 1..20: note = Synthetic Construct
  source 1..20: mol_type = other DNA
aacgcccagctgaggtttga

SEQ ID NO: 16559 - DNA, 20 bp, synthetic construct
  misc_feature 1..20: note = Synthetic Construct
  source 1..20: mol_type = other DNA
cttttcccgcgtgctgtgat

SEQ ID NO: 16560 - DNA, 22 bp, synthetic construct
  misc_feature 1..22: note = Synthetic Construct
  source 1..22: mol_type = other DNA
gttatgtgggaagaccccaaca

SEQ ID NO: 16561 - DNA, 23 bp, synthetic construct
  misc_feature 1..23: note = Synthetic Construct
  source 1..23: mol_type = other DNA
gcctgggaaacttgtgaatggaa

SEQ ID NO: 16562 - DNA, 22 bp, synthetic construct
  misc_feature 1..22: note = Synthetic Construct
  source 1..22: mol_type = other DNA
ccgcttgaaaagccacctgcta

SEQ ID NO: 16563 - DNA, 22 bp, synthetic construct
  misc_feature 1..22: note = Synthetic Construct
  source 1..22: mol_type = other DNA
cttcacctggaacccagaaaca

SEQ ID NO: 16564 - DNA, 21 bp, synthetic construct
  misc_feature 1..21: note = Synthetic Construct
  source 1..21: mol_type = other DNA
ggcacccagcaactggatctt

SEQ ID NO: 16565 - DNA, 20 bp, synthetic construct
  misc_feature 1..20: note = Synthetic Construct
  source 1..20: mol_type = other DNA
gccaacacaggcaggattga

SEQ ID NO: 16566 - DNA, 22 bp, synthetic construct
  misc_feature 1..22: note = Synthetic Construct
  source 1..22: mol_type = other DNA
atcttccttgccctggagtcta

SEQ ID NO: 16567 - DNA, 20 bp, synthetic construct
  misc_feature 1..20: note = Synthetic Construct
  source 1..20: mol_type = other DNA
tgcggatgcggtttccttct

SEQ ID NO: 16568 - DNA, 24 bp, synthetic construct
  misc_feature 1..24: note = Synthetic Construct
  source 1..24: mol_type = other DNA
ggaagttggggaaacaggaggata

SEQ ID NO: 16569 - DNA, 20 bp, synthetic construct
  misc_feature 1..20: note = Synthetic Construct
  source 1..20: mol_type = other DNA
gcgaggttagccagggttag

SEQ ID NO: 16570 - DNA, 23 bp, synthetic construct
  misc_feature 1..23: note = Synthetic Construct
  source 1..23: mol_type = other DNA
ccacttggcagtgagggtatttc

SEQ ID NO: 16571 - DNA, 20 bp, synthetic construct
  misc_feature 1..20: note = Synthetic Construct
  source 1..20: mol_type = other DNA
tgccagccccagtcctgtga

SEQ ID NO: 16572 - DNA, 20 bp, synthetic construct
  misc_feature 1..20: note = Synthetic Construct
  source 1..20: mol_type = other DNA
cactgcagcttgagccaaca

SEQ ID NO: 16573 - DNA, 22 bp, synthetic construct
  misc_feature 1..22: note = Synthetic Construct
  source 1..22: mol_type = other DNA
gggcgctgtgacttagaacaag

SEQ ID NO: 16574 - DNA, 21 bp, synthetic construct
  misc_feature 1..21: note = Synthetic Construct
  source 1..21: mol_type = other DNA
gcaatggcatccttgggaaga

SEQ ID NO: 16575 - DNA, 19 bp, synthetic construct
  misc_feature 1..19: note = Synthetic Construct
  source 1..19: mol_type = other DNA
tggtcccctgttgctcact

SEQ ID NO: 16576 - DNA, 18 bp, synthetic construct
  misc_feature 1..18: note = Synthetic Construct
  source 1..18: mol_type = other DNA
agcggcgcagtgagtaca

SEQ ID NO: 16577 - DNA, 20 bp, synthetic construct
  misc_feature 1..20: note = Synthetic Construct
  source 1..20: mol_type = other DNA
cacactggctccaggacact

SEQ ID NO: 16578 - DNA, 21 bp, synthetic construct
  misc_feature 1..21: note = Synthetic Construct
  source 1..21: mol_type = other DNA
cagtggcaggtccatgttttg

SEQ ID NO: 16579 - DNA, 21 bp, synthetic construct
  misc_feature 1..21: note = Synthetic Construct
  source 1..21: mol_type = other DNA
gcctcagctcctcctgggtaa

SEQ ID NO: 16580 - DNA, 22 bp, synthetic construct
  misc_feature 1..22: note = Synthetic Construct
  source 1..22: mol_type = other DNA
gctgtgggtcttgctctgcttt

SEQ ID NO: 16581 - DNA, 22 bp, synthetic construct
  misc_feature 1..22: note = Synthetic Construct
  source 1..22: mol_type = other DNA
ccccacagcaaggacataggaa

SEQ ID NO: 16582 - DNA, 21 bp, synthetic construct
  misc_feature 1..21: note = Synthetic Construct
  source 1..21: mol_type = other DNA
gttccccaacaaggggcatct

SEQ ID NO: 16583 - DNA, 20 bp, synthetic construct
  misc_feature 1..20: note = Synthetic Construct
  source 1..20: mol_type = other DNA
agctgggtgtgcctttgatg

SEQ ID NO: 16584 - DNA, 20 bp, synthetic construct
  misc_feature 1..20: note = Synthetic Construct
  source 1..20: mol_type = other DNA
gcctttctcgtgacccttgt

SEQ ID NO: 16585 - DNA, 21 bp, synthetic construct
  misc_feature 1..21: note = Synthetic Construct
  source 1..21: mol_type = other DNA
gtggagttggcggtggatgta

SEQ ID NO: 16586 - DNA, 26 bp, synthetic construct
  misc_feature 1..26: note = Synthetic Construct
  source 1..26: mol_type = other DNA
tcctagaaacgtgacgtgtaatgtag

SEQ ID NO: 16587 - DNA, 22 bp, synthetic construct
  misc_feature 1..22: note = Synthetic Construct
  source 1..22: mol_type = other DNA
cccgggctcatttagtgtgtgt

SEQ ID NO: 16588 - DNA, 23 bp, synthetic construct
  misc_feature 1..23: note = Synthetic Construct
  source 1..23: mol_type = other DNA
ccccaggcgtttctaaacaatca

SEQ ID NO: 16589 - DNA, 20 bp, synthetic construct
  misc_feature 1..20: note = Synthetic Construct
  source 1..20: mol_type = other DNA
aatttccagggtgcgtggtt

SEQ ID NO: 16590 - DNA, 21 bp, synthetic construct
  misc_feature 1..21: note = Synthetic Construct
  source 1..21: mol_type = other DNA
ccagcccagcctatgtgctaa

SEQ ID NO: 16591 - DNA, 26 bp, synthetic construct
  misc_feature 1..26: note = Synthetic Construct
  source 1..26: mol_type = other DNA
cctttggtgagtgaattggtctttga

SEQ ID NO: 16592 - DNA, 26 bp, synthetic construct
  misc_feature 1..26: note = Synthetic Construct
  source 1..26: mol_type = other DNA
ccagctccttataggggctattaaac

SEQ ID NO: 16593 - DNA, 22 bp, synthetic construct
  misc_feature 1..22: note = Synthetic Construct
  source 1..22: mol_type = other DNA
ggacaggtggtctagcttggaa

SEQ ID NO: 16594 - DNA, 20 bp, synthetic construct
  misc_feature 1..20: note = Synthetic Construct
  source 1..20: mol_type = other DNA
gcaccacttgcttgctcagt

SEQ ID NO: 16595 - DNA, 25 bp, synthetic construct
  misc_feature 1..25: note = Synthetic Construct
  source 1..25: mol_type = other DNA
ctcaaccaaagctctttaacacagt

SEQ ID NO: 16596 - DNA, 19 bp, synthetic construct
  misc_feature 1..19: note = Synthetic Construct
  source 1..19: mol_type = other DNA
agctctgggacgggcaaac

SEQ ID NO: 16597 - DNA, 22 bp, synthetic construct
  misc_feature 1..22: note = Synthetic Construct
  source 1..22: mol_type = other DNA
tggaacagcccctctgtgtgta

SEQ ID NO: 16598 - DNA, 26 bp, synthetic construct
  misc_feature 1..26: note = Synthetic Construct
  source 1..26: mol_type = other DNA
actttccctgcacctttatacacttc

SEQ ID NO: 16599 - DNA, 23 bp, synthetic construct
  misc_feature 1..23: note = Synthetic Construct
  source 1..23: mol_type = other DNA
cacaacccacccatcagtcattg

SEQ ID NO: 16600 - DNA, 23 bp, synthetic construct
  misc_feature 1..23: note = Synthetic Construct
  source 1..23: mol_type = other DNA
ccagaaaccatgccattatgcaa

SEQ ID NO: 16601 - DNA, 20 bp, synthetic construct
  misc_feature 1..20: note = Synthetic Construct
  source 1..20: mol_type = other DNA
gagcagccaatgcacagtca

SEQ ID NO: 16602 - DNA, 25 bp, synthetic construct
  misc_feature 1..25: note = Synthetic Construct
  source 1..25: mol_type = other DNA
tgttcagacctcttggaaattgcat

SEQ ID NO: 16603 - DNA, 22 bp, synthetic construct
  misc_feature 1..22: note = Synthetic Construct
  source 1..22: mol_type = other DNA
ccctggctttggtttcctttca

SEQ ID NO: 16604 - DNA, 18 bp, synthetic construct
  misc_feature 1..18: note = Synthetic Construct
  source 1..18: mol_type = other DNA
acgcacgggaagctgaaa

SEQ ID NO: 16605 - DNA, 23 bp, synthetic construct
  misc_feature 1..23: note = Synthetic Construct
  source 1..23: mol_type = other DNA
gaaccttgacgctagagctttga

SEQ ID NO: 16606 - DNA, 23 bp, synthetic construct
  misc_feature 1..23: note = Synthetic Construct
  source 1..23: mol_type = other DNA
ctgttggtctgacatgccctgat

SEQ ID NO: 16607 - DNA, 22 bp, synthetic construct
  misc_feature 1..22: note = Synthetic Construct
  source 1..22: mol_type = other DNA
agctagaatagcccctgagtgt

SEQ ID NO: 16608 - DNA, 25 bp, synthetic construct
  misc_feature 1..25: note = Synthetic Construct
  source 1..25: mol_type = other DNA
gctccaaagtgataaggaaggatga

SEQ ID NO: 16609 - DNA, 24 bp, synthetic construct
  misc_feature 1..24: note = Synthetic Construct
  source 1..24: mol_type = other DNA
ggatgcagcaaaggcagatctaag

SEQ ID NO: 16610 - DNA, 21 bp, synthetic construct
  misc_feature 1..21: note = Synthetic Construct
  source 1..21: mol_type = other DNA
cttgctggatgctcagcttgt

SEQ ID NO: 16611 - DNA, 22 bp, synthetic construct
  misc_feature 1..22: note = Synthetic Construct
  source 1..22: mol_type = other DNA
atcagcccagtggtatgtcaag

SEQ ID NO: 16612 - DNA, 26 bp, synthetic construct
  misc_feature 1..26: note = Synthetic Construct
  source 1..26: mol_type = other DNA
ggaaggctgataagagcagtttgtga

SEQ ID NO: 16613 - DNA, 23 bp, synthetic construct
  misc_feature 1..23: note = Synthetic Construct
  source 1..23: mol_type = other DNA
ctgtctggacacggagcagataa

SEQ ID NO: 16614 - DNA, 21 bp, synthetic construct
  misc_feature 1..21: note = Synthetic Construct
  source 1..21: mol_type = other DNA
tggcaccaagccaagggatct

SEQ ID NO: 16615 - DNA, 24 bp, synthetic construct
  misc_feature 1..24: note = Synthetic Construct
  source 1..24: mol_type = other DNA
catagattgccccacttctaggtt

SEQ ID NO: 16616 - DNA, 19 bp, synthetic construct
  misc_feature 1..19: note = Synthetic Construct
  source 1..19: mol_type = other DNA
tctcaccgcagccttccta

SEQ ID NO: 16617 - DNA, 18 bp, synthetic construct
  misc_feature 1..18: note = Synthetic Construct
  source 1..18: mol_type = other DNA
tgggagctagcccacgtt

SEQ ID NO: 16618 - DNA, 22 bp, synthetic construct
  misc_feature 1..22: note = Synthetic Construct
  source 1..22: mol_type = other DNA
tacccagtccacctccaacaca

SEQ ID NO: 16619 - DNA, 25 bp, synthetic construct
  misc_feature 1..25: note = Synthetic Construct
  source 1..25: mol_type = other DNA
gctctgggagaaaagataggcaatg

SEQ ID NO: 16620 - DNA, 22 bp, synthetic construct
  misc_feature 1..22: note = Synthetic Construct
  source 1..22: mol_type = other DNA
ataggccggtctgaaggaggaa

SEQ ID NO: 16621 - DNA, 23 bp, synthetic construct
  misc_feature 1..23: note = Synthetic Construct
  source 1..23: mol_type = other DNA
ctgccatttctttgggactgatg

SEQ ID NO: 16622 - DNA, 27 bp, synthetic construct
  misc_feature 1..27: note = Synthetic Construct
  source 1..27: mol_type = other DNA
cctctcctttgacatatttccttcagt

SEQ ID NO: 16623 - DNA, 24 bp, synthetic construct
  misc_feature 1..24: note = Synthetic Construct
  source 1..24: mol_type = other DNA
cttggtcaaggtccattggttaga

SEQ ID NO: 16624 - DNA, 23 bp, synthetic construct
  misc_feature 1..23: note = Synthetic Construct
  source 1..23: mol_type = other DNA
ctggaggatgaggggagagaact

SEQ ID NO: 16625 - DNA, 20 bp, synthetic construct
  misc_feature 1..20: note = Synthetic Construct
  source 1..20: mol_type = other DNA
accccatctctgccactgtt

SEQ ID NO: 16626 - DNA, 21 bp, synthetic construct
  misc_feature 1..21: note = Synthetic Construct
  source 1..21: mol_type = other DNA
ccttctgcctccccttgaaat

SEQ ID NO: 16627 - DNA, 22 bp, synthetic construct
  misc_feature 1..22: note = Synthetic Construct
  source 1..22: mol_type = other DNA
gtgcctttgagacctcctggat

SEQ ID NO: 16628 - DNA, 25 bp, synthetic construct
  misc_feature 1..25: note = Synthetic Construct
  source 1..25: mol_type = other DNA
cagagagagtcatgtgggtatgttt

SEQ ID NO: 16629 - DNA, 24 bp, synthetic construct
  misc_feature 1..24: note = Synthetic Construct
  source 1..24: mol_type = other DNA
agtgagcccatgcataactgatac

SEQ ID NO: 16630 - DNA, 21 bp, synthetic construct
  misc_feature 1..21: note = Synthetic Construct
  source 1..21: mol_type = other DNA
gtctttgcttggcctgctgta

SEQ ID NO: 16631 - DNA, 25 bp, synthetic construct
  misc_feature 1..25: note = Synthetic Construct
  source 1..25: mol_type = other DNA
ctgctgctgttaaaagatgggaaca

SEQ ID NO: 16632 - DNA, 24 bp, synthetic construct
  misc_feature 1..24: note = Synthetic Construct
  source 1..24: mol_type = other DNA
tctagctaatggagaggctgagat

SEQ ID NO: 16633 - DNA, 24 bp, synthetic construct
  misc_feature 1..24: note = Synthetic Construct
  source 1..24: mol_type = other DNA
ggggcagtgagtattgtctaatga

SEQ ID NO: 16634 - DNA, 20 bp, synthetic construct
  misc_feature 1..20: note = Synthetic Construct
  source 1..20: mol_type = other DNA
gcagctgtgccatgttgtga

SEQ ID NO: 16635 - DNA, 26 bp, synthetic construct
  misc_feature 1..26: note = Synthetic Construct
  source 1..26: mol_type = other DNA
gcttcctcatcatcttccggtctttg

SEQ ID NO: 16636 - DNA, 22 bp, synthetic construct
  misc_feature 1..22: note = Synthetic Construct
  source 1..22: mol_type = other DNA
tcttctggaacaagcccaacaa

SEQ ID NO: 16637 - DNA, 22 bp, synthetic construct
  misc_feature 1..22: note = Synthetic Construct
  source 1..22: mol_type = other DNA
ggttgtgaggggcaaagcttga

SEQ ID NO: 16638 - DNA, 19 bp, synthetic construct
  misc_feature 1..19: note = Synthetic Construct
  source 1..19: mol_type = other DNA
gtcagctccctgggccata

SEQ ID NO: 16639 - DNA, 25 bp, synthetic construct
  misc_feature 1..25: note = Synthetic Construct
  source 1..25: mol_type = other DNA
ccgtaaaccatttgcacagcacatt

SEQ ID NO: 16640 - DNA, 22 bp, synthetic construct
  misc_feature 1..22: note = Synthetic Construct
  source 1..22: mol_type = other DNA
ctcagttggccctgtggtaatg

SEQ ID NO: 16641 - DNA, 20 bp, synthetic construct
  misc_feature 1..20: note = Synthetic Construct
  source 1..20: mol_type = other DNA
aggccacagtgaccgagtct

SEQ ID NO: 16642 - DNA, 20 bp, synthetic construct
  misc_feature 1..20: note = Synthetic Construct
  source 1..20: mol_type = other DNA
tccggagccgggatctttag

SEQ ID NO: 16643 - DNA, 23 bp, synthetic construct
  misc_feature 1..23: note = Synthetic Construct
  source 1..23: mol_type = other DNA
ggcattgcaactaccctgtgtga

SEQ ID NO: 16644 - DNA, 20 bp, synthetic construct
  misc_feature 1..20: note = Synthetic Construct
  source 1..20: mol_type = other DNA
cctgggctttgccttcttca

SEQ ID NO: 16645 - DNA, 22 bp, synthetic construct
  misc_feature 1..22: note = Synthetic Construct
  source 1..22: mol_type = other DNA
ctgctctatgccatgggtctga

SEQ ID NO: 16646 - DNA, 21 bp, synthetic construct
  misc_feature 1..21: note = Synthetic Construct
  source 1..21: mol_type = other DNA
tggcaggcttccctcaacatc

SEQ ID NO: 16647 - DNA, 24 bp, synthetic construct
  misc_feature 1..24: note = Synthetic Construct
  source 1..24: mol_type = other DNA
acctccattcaacggatgagaaaa

SEQ ID NO: 16648 - DNA, 22 bp, synthetic construct
  misc_feature 1..22: note = Synthetic Construct
  source 1..22: mol_type = other DNA
gatagcccagccagtgttctca

SEQ ID NO: 16649 - DNA, 20 bp, synthetic construct
  misc_feature 1..20: note = Synthetic Construct
  source 1..20: mol_type = other DNA
ggaagcctcctgccagattt

SEQ ID NO: 16650 - DNA, 22 bp, synthetic construct
  misc_feature 1..22: note = Synthetic Construct
  source 1..22: mol_type = other DNA
aggacctcagaagggagcaact

SEQ ID NO: 16651 - DNA, 24 bp, synthetic construct
  misc_feature 1..24: note = Synthetic Construct
  source 1..24: mol_type = other DNA
gggagggttgcaaattctaactca

SEQ ID NO: 16652 - DNA, 22 bp, synthetic construct
  misc_feature 1..22: note = Synthetic Construct
  source 1..22: mol_type = other DNA
ggatgaaaggctctgggagaag

SEQ ID NO: 16653 - DNA, 21 bp, synthetic construct
  misc_feature 1..21: note = Synthetic Construct
  source 1..21: mol_type = other DNA
ggatggctgctgccctcttta

SEQ ID NO: 16654 - DNA, 22 bp, synthetic construct
  misc_feature 1..22: note = Synthetic Construct
  source 1..22: mol_type = other DNA
ccatttcatggggcatgacgaa

SEQ ID NO: 16655 - DNA, 24 bp, synthetic construct
  misc_feature 1..24: note = Synthetic Construct
  source 1..24: mol_type = other DNA
caacatagccccaaaagacctcat

SEQ ID NO: 16656 - DNA, 24 bp, synthetic construct
  misc_feature 1..24: note = Synthetic Construct
  source 1..24: mol_type = other DNA
actttgattgtgtcactgctgtct

SEQ ID NO: 16657 - DNA, 20 bp, synthetic construct
  misc_feature 1..20: note = Synthetic Construct
  source 1..20: mol_type = other DNA
tgtgtcccggacgtgtcaac

SEQ ID NO: 16658 - DNA, 20 bp, synthetic construct
  misc_feature 1..20: note = Synthetic Construct
  source 1..20: mol_type = other DNA
gctggctgtagcagaactga

SEQ ID NO: 16659 - DNA, 23 bp, synthetic construct
  misc_feature 1..23: note = Synthetic Construct
  source 1..23: mol_type = other DNA
cccatacaatgtggggaggtgat

SEQ ID NO: 16660 - DNA, 22 bp, synthetic construct
  misc_feature 1..22: note = Synthetic Construct
  source 1..22: mol_type = other DNA
cctccccaaggggaagcatttt

SEQ ID NO: 16661 - DNA, 21 bp, synthetic construct
  misc_feature 1..21: note = Synthetic Construct
  source 1..21: mol_type = other DNA
tctgggagcttctgcctcatc

SEQ ID NO: 16662 - DNA, 22 bp, synthetic construct
  misc_feature 1..22: note = Synthetic Construct
  source 1..22: mol_type = other DNA
ctggttcacacgatgcaagatg

SEQ ID NO: 16663 - DNA, 24 bp, synthetic construct
  misc_feature 1..24: note = Synthetic Construct
  source 1..24: mol_type = other DNA
ctgaaagctatgcgtgtagtgcat

SEQ ID NO: 16664 - DNA, 25 bp, synthetic construct
  misc_feature 1..25: note = Synthetic Construct
  source 1..25: mol_type = other DNA
ggaaagaggttcaggctctatgtga

SEQ ID NO: 16665 - DNA, 23 bp, synthetic construct
  misc_feature 1..23: note = Synthetic Construct
  source 1..23: mol_type = other DNA
ggatgtaccccatgcatcctaac

SEQ ID NO: 16666 - DNA, 23 bp, synthetic construct
  misc_feature 1..23: note = Synthetic Construct
  source 1..23: mol_type = other DNA
cccacctcaaccttgcaagtaac

SEQ ID NO: 16667 - DNA, 20 bp, synthetic construct
  misc_feature 1..20: note = Synthetic Construct
  source 1..20: mol_type = other DNA
cccagcgtgaaggcaaaaag

SEQ ID NO: 16668 - DNA, 25 bp, synthetic construct
  misc_feature 1..25: note = Synthetic Construct
  source 1..25: mol_type = other DNA
cagtcagaaggaacaaaggaaccaa

SEQ ID NO: 16669 - DNA, 23 bp, synthetic construct
  misc_feature 1..23: note = Synthetic Construct
  source 1..23: mol_type = other DNA
tgaaaagtgcatggtcctgttga

SEQ ID NO: 16670 - DNA, 22 bp, synthetic construct
  misc_feature 1..22: note = Synthetic Construct
  source 1..22: mol_type = other DNA
gctggaactcagtcacaagcaa

SEQ ID NO: 16671 - DNA, 22 bp, synthetic construct
  misc_feature 1..22: note = Synthetic Construct
  source 1..22: mol_type = other DNA
tggcctcaattccaggccttac

SEQ ID NO: 16672 - DNA, 25 bp, synthetic construct
  misc_feature 1..25: note = Synthetic Construct
  source 1..25: mol_type = other DNA
gtggttgtagtgacgagttttgact

SEQ ID NO: 16673 - DNA, 26 bp, synthetic construct
  misc_feature 1..26: note = Synthetic Construct
  source 1..26: mol_type = other DNA
caagacagcacaggtatagaggaaca

SEQ ID NO: 16674 - DNA, 25 bp, synthetic construct
  misc_feature 1..25: note = Synthetic Construct
  source 1..25: mol_type = other DNA
gctacttccacaatgaccaggaatc

SEQ ID NO: 16675 - DNA, 21 bp, synthetic construct
  misc_feature 1..21: note = Synthetic Construct
  source 1..21: mol_type = other DNA
gcgaccaggatgacaggtgta

SEQ ID NO: 16676 - DNA, 23 bp, synthetic construct
  misc_feature 1..23: note = Synthetic Construct
  source 1..23: mol_type = other DNA
cactttgcctgcatgaagattgt

SEQ ID NO: 16677 - DNA, 25 bp, synthetic construct
  misc_feature 1..25: note = Synthetic Construct
  source 1..25: mol_type = other DNA
cccagttacatctccttctccattc

SEQ ID NO: 16678 - DNA, 20 bp, synthetic construct
  misc_feature 1..20: note = Synthetic Construct
  source 1..20: mol_type = other DNA
tcctccggggtaagggaaca

SEQ ID NO: 16679 - DNA, 22 bp, synthetic construct
  misc_feature 1..22: note = Synthetic Construct
  source 1..22: mol_type = other DNA
gatccaggagtgctccagattg

SEQ ID NO: 16680 - DNA, 26 bp, synthetic construct
  misc_feature 1..26: note = Synthetic Construct
  source 1..26: mol_type = other DNA
ctgcagggattaaccggtcattatca

SEQ ID NO: 16681 - DNA, 21 bp, synthetic construct
  misc_feature 1..21: note = Synthetic Construct
  source 1..21: mol_type = other DNA
cccaggcagtgttgactacaa

SEQ ID NO: 16682 - DNA, 21 bp, synthetic construct
  misc_feature 1..21: note = Synthetic Construct
  source 1..21: mol_type = other DNA
ggctgctgaaggatgacagat

SEQ ID NO: 16683 - DNA, 27 bp, synthetic construct
  misc_feature 1..27: note = Synthetic Construct
  source 1..27: mol_type = other DNA
ctctctccactgaagtttgtgacatta

SEQ ID NO: 16684 - DNA, 22 bp, synthetic construct
  misc_feature 1..22: note = Synthetic Construct
  source 1..22: mol_type = other DNA
gcctggagctctagcaactgta

SEQ ID NO: 16685 - DNA, 22 bp, synthetic construct
  misc_feature 1..22: note = Synthetic Construct
  source 1..22: mol_type = other DNA
catagagcacgagtccacactt

SEQ ID NO: 16686 - DNA, 20 bp, synthetic construct
  misc_feature 1..20: note = Synthetic Construct
  source 1..20: mol_type = other DNA
aagcgcagcaggaagagtca

SEQ ID NO: 16687 - DNA, 22 bp, synthetic construct
  misc_feature 1..22: note = Synthetic Construct
  source 1..22: mol_type = other DNA
acctttgccagacatgggattg

SEQ ID NO: 16688 - DNA, 22 bp, synthetic construct
  misc_feature 1..22: note = Synthetic Construct
  source 1..22: mol_type = other DNA
atctgggaagccagggaggaaa

SEQ ID NO: 16689 - DNA, 23 bp, synthetic construct
  misc_feature 1..23: note = Synthetic Construct
  source 1..23: mol_type = other DNA
gctgaggacacacccatcctttc

SEQ ID NO: 16690 - DNA, 21 bp, synthetic construct
  misc_feature 1..21: note = Synthetic Construct
  source 1..21: mol_type = other DNA
cctgctccatgaccacaggaa

SEQ ID NO: 16691 - DNA, 20 bp, synthetic construct
  misc_feature 1..20: note = Synthetic Construct
  source 1..20: mol_type = other DNA
tgtccacacgttgggcttac

SEQ ID NO: 16692 - DNA, 21 bp, synthetic construct
  misc_feature 1..21: note = Synthetic Construct
  source 1..21: mol_type = other DNA
gagcctgactcctcccacata

SEQ ID NO: 16693 - DNA, 22 bp, synthetic construct
  misc_feature 1..22: note = Synthetic Construct
  source 1..22: mol_type = other DNA
ggaaaatccacccgtgaacaga

SEQ ID NO: 16694 - DNA, 22 bp, synthetic construct
  misc_feature 1..22: note = Synthetic Construct
  source 1..22: mol_type = other DNA
gcctggtcaccttcatctgctt

SEQ ID NO: 16695 - DNA, 20 bp, synthetic construct
  misc_feature 1..20: note = Synthetic Construct
  source 1..20: mol_type = other DNA
gaagctggaacgtgggtcaa

SEQ ID NO: 16696 - DNA, 21 bp, synthetic construct
  misc_feature 1..21: note = Synthetic Construct
  source 1..21: mol_type = other DNA
cctgaggttaggcacctccaa

SEQ ID NO: 16697 - DNA, 22 bp, synthetic construct
  misc_feature 1..22: note = Synthetic Construct
  source 1..22: mol_type = other DNA
ccatgctgccatctgggtcaaa

SEQ ID NO: 16698 - DNA, 21 bp, synthetic construct
  misc_feature 1..21: note = Synthetic Construct
  source 1..21: mol_type = other DNA
gaaaggtgggctttccacaca

SEQ ID NO: 16699 - DNA, 20 bp, synthetic construct
  misc_feature 1..20: note = Synthetic Construct
  source 1..20: mol_type = other DNA
ctgccttgcattgcgacaga

SEQ ID NO: 16700 - DNA, 20 bp, synthetic construct
  misc_feature 1..20: note = Synthetic Construct
  source 1..20: mol_type = other DNA
agctgtcccgggaacttgaa

SEQ ID NO: 16701 - DNA, 20 bp, synthetic construct
  misc_feature 1..20: note = Synthetic Construct
  source 1..20: mol_type = other DNA
agccttgcctgttgcctttc

SEQ ID NO: 16702 - DNA, 21 bp, synthetic construct
  misc_feature 1..21: note = Synthetic Construct
  source 1..21: mol_type = other DNA
ttgcctctggagggcacagaa

SEQ ID NO: 16703 - DNA, 24 bp, synthetic construct
  misc_feature 1..24: note = Synthetic Construct
  source 1..24: mol_type = other DNA
gccccggggtctttgtgacataat

SEQ ID NO: 16704 - DNA, 22 bp, synthetic construct
  misc_feature 1..22: note = Synthetic Construct
  source 1..22: mol_type = other DNA
ctcggctgcagtgtctcagtat

SEQ ID NO: 16705 - DNA, 21 bp, synthetic construct
  misc_feature 1..21: note = Synthetic Construct
  source 1..21: mol_type = other DNA
ggggaagaagcaagcatcagt

SEQ ID NO: 16706 - DNA, 26 bp, synthetic construct
  misc_feature 1..26: note = Synthetic Construct
  source 1..26: mol_type = other DNA
gcaccaagggtccatggatgctataa

SEQ ID NO: 16707 - DNA, 21 bp, synthetic construct
  misc_feature 1..21: note = Synthetic Construct
  source 1..21: mol_type = other DNA
gccatgacccaagcagctaca

SEQ ID NO: 16708 - DNA, 21 bp, synthetic construct
  misc_feature 1..21: note = Synthetic Construct
  source 1..21: mol_type = other DNA
acacttgtggcccctgagttc

SEQ ID NO: 16709 - DNA, 21 bp, synthetic construct
  misc_feature 1..21: note = Synthetic Construct
  source 1..21: mol_type = other DNA
ttggggctcaggctcagtgtt

SEQ ID NO: 16710 - DNA, 21 bp, synthetic construct
  misc_feature 1..21: note = Synthetic Construct
  source 1..21: mol_type = other DNA
atggcacctgccacgtcagaa

SEQ ID NO: 16711 - DNA, 22 bp, synthetic construct
  misc_feature 1..22: note = Synthetic Construct
  source 1..22: mol_type = other DNA
ggagacaggatggagggttttg

SEQ ID NO: 16712 - DNA, 22 bp, synthetic construct
  misc_feature 1..22: note = Synthetic Construct
  source 1..22: mol_type = other DNA
agccgtggactgaagctgagta

SEQ ID NO: 16713 - DNA, 23 bp, synthetic construct
  misc_feature 1..23: note = Synthetic Construct
  source 1..23: mol_type = other DNA
ctaggacccactgcagccattag

SEQ ID NO: 16714 - DNA, 24 bp, synthetic construct
  misc_feature 1..24: note = Synthetic Construct
  source 1..24: mol_type = other DNA
cccctctggcctctttctttgatg

SEQ ID NO: 16715 - DNA, 22 bp, synthetic construct
  misc_feature 1..22: note = Synthetic Construct
  source 1..22: mol_type = other DNA
gttccccgttcttcccttgtca

SEQ ID NO: 16716 - DNA, 21 bp, synthetic construct
  misc_feature 1..21: note = Synthetic Construct
  source 1..21: mol_type = other DNA
atgcagagctgggtggcagaa

SEQ ID NO: 16717 - DNA, 21 bp, synthetic construct
  misc_feature 1..21: note = Synthetic Construct
  source 1..21: mol_type = other DNA
gaggttgttccaggctgatgt

SEQ ID NO: 16718 - DNA, 23 bp, synthetic construct
  misc_feature 1..23: note = Synthetic Construct
  source 1..23: mol_type = other DNA
ccacctgaagattggcagttaca

SEQ ID NO: 16719 - DNA, 20 bp, synthetic construct
  misc_feature 1..20: note = Synthetic Construct
  source 1..20: mol_type = other DNA
tccacatcgccttgccttga

SEQ ID NO: 16720 - DNA, 21 bp, synthetic construct
  misc_feature 1..21: note = Synthetic Construct
  source 1..21: mol_type = other DNA
tttgcccctttcgggctgaag

SEQ ID NO: 16721 - DNA, 20 bp, synthetic construct
  misc_feature 1..20: note = Synthetic Construct
  source 1..20: mol_type = other DNA
aactgcactgctgcccatgt

SEQ ID NO: 16722 - DNA, 21 bp, synthetic construct
  misc_feature 1..21: note = Synthetic Construct
  source 1..21: mol_type = other DNA
gccaccaccacagtaagaagt

SEQ ID NO: 16723 - DNA, 26 bp, synthetic construct
  misc_feature 1..26: note = Synthetic Construct
  source 1..26: mol_type = other DNA
actgcctcctacttttgactatcttc

SEQ ID NO: 16724 - DNA, 25 bp, synthetic construct
  misc_feature 1..25: note = Synthetic Construct
  source 1..25: mol_type = other DNA
tcttgagacttaagcagctacaaca

SEQ ID NO: 16725 - DNA, 24 bp, synthetic construct
  misc_feature 1..24: note = Synthetic Construct
  source 1..24: mol_type = other DNA
acctcctacttcatacaggggaat

SEQ ID NO: 16726 - DNA, 22 bp, synthetic construct
  misc_feature 1..22: note = Synthetic Construct
  source 1..22: mol_type = other DNA
ccagcaaagccagctgtactca

SEQ ID NO: 16727 - DNA, 20 bp, synthetic construct
  misc_feature 1..20: note = Synthetic Construct
  source 1..20: mol_type = other DNA
aactccaggcagagccaaga

SEQ ID NO: 16728 - DNA, 22 bp, synthetic construct
  misc_feature 1..22: note = Synthetic Construct
  source 1..22: mol_type = other DNA
cccattcccatgtctggtcctt

SEQ ID NO: 16729 - DNA, 25 bp, synthetic construct
  misc_feature 1..25: note = Synthetic Construct
  source 1..25: mol_type = other DNA
gagagacacaatgctttgaacagaa

SEQ ID NO: 16730 - DNA, 23 bp, synthetic construct
  misc_feature 1..23: note = Synthetic Construct
  source 1..23: mol_type = other DNA
cacccctcttcaagactgaggaa

SEQ ID NO: 16731 - DNA, 22 bp, synthetic construct
  misc_feature 1..22: note = Synthetic Construct
  source 1..22: mol_type = other DNA
caggaaacccacaggcagttgt

SEQ ID NO: 16732 - DNA, 24 bp, synthetic construct
  misc_feature 1..24: note = Synthetic Construct
  source 1..24: mol_type = other DNA
gcaaaagatcactctggccacttc

SEQ ID NO: 16733 - DNA, 19 bp, synthetic construct
  misc_feature 1..19: note = Synthetic Construct
  source 1..19: mol_type = other DNA
ttggggctgaagccaggaa

SEQ ID NO: 16734 - DNA, 18 bp, synthetic construct
  misc_feature 1..18: note = Synthetic Construct
  source 1..18: mol_type = other DNA
cagtggcagtggcagtga

SEQ ID NO: 16735 - DNA, 21 bp, synthetic construct
  misc_feature 1..21: note = Synthetic Construct
  source 1..21: mol_type = other DNA
tgaaccccattcaggcaggat

SEQ ID NO: 16736 - DNA, 20 bp, synthetic construct
  misc_feature 1..20: note = Synthetic Construct
  source 1..20: mol_type = other DNA
tgtcactgcctgctccttct

SEQ ID NO: 16737 - DNA, 23 bp, synthetic construct
  misc_feature 1..23: note = Synthetic Construct
  source 1..23: mol_type = other DNA
taccacagggctggtctgaggat

SEQ ID NO: 16738 - DNA, 20 bp, synthetic construct
  misc_feature 1..20: note = Synthetic Construct
  source 1..20: mol_type = other DNA
actgagacactggggtgctt

SEQ ID NO: 16739 - DNA, 22 bp, synthetic construct
  misc_feature 1..22: note = Synthetic Construct
  source 1..22: mol_type = other DNA
acaaatgcatcctccgcttaca

SEQ ID NO: 16740 - DNA, 26 bp, synthetic construct
  misc_feature 1..26: note = Synthetic Construct
  source 1..26: mol_type = other DNA
gactaaattggctagaggggcagaag

SEQ ID NO: 16741 - DNA, 23 bp, synthetic construct
  misc_feature 1..23: note = Synthetic Construct
  source 1..23: mol_type = other DNA
cacagggctgtggccatattttc

SEQ ID NO: 16742 - DNA, 24 bp, synthetic construct
  misc_feature 1..24: note = Synthetic Construct
  source 1..24: mol_type = other DNA
gggtcccttgtataacccaaaact

SEQ ID NO: 16743 - DNA, 25 bp, synthetic construct
  misc_feature 1..25: note = Synthetic Construct
  source 1..25: mol_type = other DNA
acatatgactttgagttcggtgaga

SEQ ID NO: 16744 - DNA, 26 bp, synthetic construct
  misc_feature 1..26: note = Synthetic Construct
  source 1..26: mol_type = other DNA
gcctcaggtaggaacctaaagtctca

SEQ ID NO: 16745 - DNA, 24 bp, synthetic construct
  misc_feature 1..24: note = Synthetic Construct
  source 1..24: mol_type = other DNA
ccttcactgtatctgacgggaaac

SEQ ID NO: 16746 - DNA, 22 bp, synthetic construct
  misc_feature 1..22: note = Synthetic Construct
  source 1..22: mol_type = other DNA
gcgcgcgtaagaaccatagagt

SEQ ID NO: 16747 - DNA, 20 bp, synthetic construct
  misc_feature 1..20: note = Synthetic Construct
  source 1..20: mol_type = other DNA
ggctgactggtcccatcttc

SEQ ID NO: 16748 - DNA, 23 bp, synthetic construct
  misc_feature 1..23: note = Synthetic Construct
  source 1..23: mol_type = other DNA
gctttagtctgcatttgctgtgt

SEQ ID NO: 16749 - DNA, 22 bp, synthetic construct
  misc_feature 1..22: note = Synthetic Construct
  source 1..22: mol_type = other DNA
tgtgtctaccttcggggaaaag

SEQ ID NO: 16750 - DNA, 25 bp, synthetic construct
  misc_feature 1..25: note = Synthetic Construct
  source 1..25: mol_type = other DNA
ggtgggtggagcaacaattttggaa

SEQ ID NO: 16751 - DNA, 25 bp, synthetic construct
  misc_feature 1..25: note = Synthetic Construct
  source 1..25: mol_type = other DNA
gccatccaaaaaggagcttagattt

SEQ ID NO: 16752 - DNA, 21 bp, synthetic construct
  misc_feature 1..21: note = Synthetic Construct
  source 1..21: mol_type = other DNA
ggtcggtgcaaggattgaatg

SEQ ID NO: 16753 - DNA, 20 bp, synthetic construct
  misc_feature 1..20: note = Synthetic Construct
  source 1..20: mol_type = other DNA
tcctggccacttagcacaca

SEQ ID NO: 16754 - DNA, 22 bp, synthetic construct
  misc_feature 1..22: note = Synthetic Construct
  source 1..22: mol_type = other DNA
gcccctggatcagctccatttt

SEQ ID NO: 16755 - DNA, 24 bp, synthetic construct
  misc_feature 1..24: note = Synthetic Construct
  source 1..24: mol_type = other DNA
gagcagaagtgttgtttgtcacat

SEQ ID NO: 16756 - DNA, 20 bp, synthetic construct
  misc_feature 1..20: note = Synthetic Construct
  source 1..20: mol_type = other DNA
ggcagacatcgcttcaggta

SEQ ID NO: 16757 - DNA, 22 bp, synthetic construct
  misc_feature 1..22: note = Synthetic Construct
  source 1..22: mol_type = other DNA
gaccgcctgtggaaatgtgtgt

SEQ ID NO: 16758 - DNA, 20 bp, synthetic construct
  misc_feature 1..20: note = Synthetic Construct
  source 1..20: mol_type = other DNA
tcgccagcgtcaacaccatt

SEQ ID NO: 16759 - DNA, 20 bp, synthetic construct
  misc_feature 1..20: note = Synthetic Construct
  source 1..20: mol_type = other DNA
gacaacacgggcacatctca

SEQ ID NO: 16760 - DNA, 19 bp, synthetic construct
  misc_feature 1..19: note = Synthetic Construct
  source 1..19: mol_type = other DNA
ctggggcctaggctgaaga

SEQ ID NO: 16761 - DNA, 27 bp, synthetic construct
  misc_feature 1..27: note = Synthetic Construct
  source 1..27: mol_type = other DNA
aagaggcttaggaaggttaagaactac

SEQ ID NO: 16762 - DNA, 21 bp, synthetic construct
  misc_feature 1..21: note = Synthetic Construct
  source 1..21: mol_type = other DNA
cgaacttcgagcccacgtgat

SEQ ID NO: 16763 - DNA, 25 bp, synthetic construct
  misc_feature 1..25: note = Synthetic Construct
  source 1..25: mol_type = other DNA
gtcagctctaaagcactctctttca

SEQ ID NO: 16764 - DNA, 23 bp, synthetic construct
  misc_feature 1..23: note = Synthetic Construct
  source 1..23: mol_type = other DNA
ggtgggtacagtgaggtgaaatg

SEQ ID NO: 16765 - DNA, 20 bp, synthetic construct
  misc_feature 1..20: note = Synthetic Construct
  source 1..20: mol_type = other DNA
gggctgccagcaacaacaaa

SEQ ID NO: 16766 - DNA, 23 bp, synthetic construct
  misc_feature 1..23: note = Synthetic Construct
  source 1..23: mol_type = other DNA
gccaccatagcttacccacagta

SEQ ID NO: 16767 - DNA, 22 bp, synthetic construct
  misc_feature 1..22: note = Synthetic Construct
  source 1..22: mol_type = other DNA
ggtcaaggacacacagagatgt

SEQ ID NO: 16768 - DNA, 25 bp, synthetic construct
  misc_feature 1..25: note = Synthetic Construct
  source 1..25: mol_type = other DNA
ggaagctctttcctgtgagagttag

SEQ ID NO: 16769 - DNA, 24 bp, synthetic construct
  misc_feature 1..24: note = Synthetic Construct
  source 1..24: mol_type = other DNA
ggaccccattgatcagggtagatg

SEQ ID NO: 16770 - DNA, 25 bp, synthetic construct
  misc_feature 1..25: note = Synthetic Construct
  source 1..25: mol_type = other DNA
ctccccaccaccttctcaatttttc

SEQ ID NO: 16771 - DNA, 18 bp, synthetic construct
  misc_feature 1..18: note = Synthetic Construct
  source 1..18: mol_type = other DNA
aggcacctggctgtgcaa

SEQ ID NO: 16772 - DNA, 22 bp, synthetic construct
  misc_feature 1..22: note = Synthetic Construct
  source 1..22: mol_type = other DNA
ctcagagtccctgttggtgtgt

SEQ ID NO: 16773 - DNA, 20 bp, synthetic construct
  misc_feature 1..20: note = Synthetic Construct
  source 1..20: mol_type = other DNA
atggggacccatgctgctta

SEQ ID NO: 16774 - DNA, 21 bp, synthetic construct
  misc_feature 1..21: note = Synthetic Construct
  source 1..21: mol_type = other DNA
tgctatggtctgcggggtaag

SEQ ID NO: 16775 - DNA, 28 bp, synthetic construct
  misc_feature 1..28: note = Synthetic Construct
  source 1..28: mol_type = other DNA
ggtctggtaacctttccaaggaagtaag

SEQ ID NO: 16776 - DNA, 22 bp, synthetic construct
  misc_feature 1..22: note = Synthetic Construct
  source 1..22: mol_type = other DNA
ctccgcatgccacagtctgtta

SEQ ID NO: 16777 - DNA, 19 bp, synthetic construct
  misc_feature 1..19: note = Synthetic Construct
  source 1..19: mol_type = other DNA
tgaccggcccattggatga

SEQ ID NO: 16778 - DNA, 26 bp, synthetic construct
  misc_feature 1..26: note = Synthetic Construct
  source 1..26: mol_type = other DNA
gcatccccacttggaagaaatcaaag

SEQ ID NO: 16779 - DNA, 26 bp, synthetic construct
  misc_feature 1..26: note = Synthetic Construct
  source 1..26: mol_type = other DNA
ctcacctcactctgtcaatggtaaac

SEQ ID NO: 16780 - DNA, 20 bp, synthetic construct
  misc_feature 1..20: note = Synthetic Construct
  source 1..20: mol_type = other DNA
actgtccccaacccagttca

SEQ ID NO: 16781 - DNA, 20 bp, synthetic construct
  misc_feature 1..20: note = Synthetic Construct
  source 1..20: mol_type = other DNA
acgcaggtgatgaccacaga

SEQ ID NO: 16782 - DNA, 19 bp, synthetic construct
  misc_feature 1..19: note = Synthetic Construct
  source 1..19: mol_type = other DNA
aaccctaggggcggtgtgt

SEQ ID NO: 16783 - DNA, 22 bp, synthetic construct
  misc_feature 1..22: note = Synthetic Construct
  source 1..22: mol_type = other DNA
aggaccccaaagcccatgaaga

SEQ ID NO: 16784 - DNA, 23 bp, synthetic construct
  misc_feature 1..23: note = Synthetic Construct
  source 1..23: mol_type = other DNA
gggtacctgatggcctctctttg

SEQ ID NO: 16785 - DNA, 24 bp, synthetic construct
  misc_feature 1..24: note = Synthetic Construct
  source 1..24: mol_type = other DNA
cctgtgcgtgggatagataagcaa

SEQ ID NO: 16786 - DNA, 18 bp, synthetic construct
  misc_feature 1..18: note = Synthetic Construct
  source 1..18: mol_type = other DNA
ttgctgccctgggactca

SEQ ID NO: 16787 - DNA, 23 bp, synthetic construct
  misc_feature 1..23: note = Synthetic Construct
  source 1..23: mol_type = other DNA
agagcaggaacactggaaaactt

SEQ ID NO: 16788 - DNA, 22 bp, synthetic construct
  misc_feature 1..22: note = Synthetic Construct
  source 1..22: mol_type = other DNA
caggggagagggagacagtcat

SEQ ID NO: 16789 - DNA, 23 bp, synthetic construct
  misc_feature 1..23: note = Synthetic Construct
  source 1..23: mol_type = other DNA
gcaaccccacactttctctgact

SEQ ID NO: 16790 - DNA, 23 bp, synthetic construct
  misc_feature 1..23: note = Synthetic Construct
  source 1..23: mol_type = other DNA
gcagagggagaaacaaccagaaa

SEQ ID NO: 16791 - DNA, 24 bp, synthetic construct
  misc_feature 1..24: note = Synthetic Construct
  source 1..24: mol_type = other DNA
ctgaatcattggagggctgtggtt

SEQ ID NO: 16792 - DNA, 22 bp, synthetic construct
  misc_feature 1..22: note = Synthetic Construct
  source 1..22: mol_type = other DNA
gctgggcagcaggttgtagtaa

SEQ ID NO: 16793 - DNA, 22 bp, synthetic construct
  misc_feature 1..22: note = Synthetic Construct
  source 1..22: mol_type = other DNA
cccagaggagcggtagtcaaaa

SEQ ID NO: 16794 - DNA, 25 bp, synthetic construct
  misc_feature 1..25: note = Synthetic Construct
  source 1..25: mol_type = other DNA
cccctaccatagcatttgcctcctt

SEQ ID NO: 16795 - DNA, 20 bp, synthetic construct
  misc_feature 1..20: note = Synthetic Construct
  source 1..20: mol_type = other DNA
cagtgcaaaggcctggaaca

SEQ ID NO: 16796 - DNA, 22 bp, synthetic construct
  misc_feature 1..22: note = Synthetic Construct
  source 1..22: mol_type = other DNA
cgttgtagggcaagaccacagt

SEQ ID NO: 16797 - DNA, 26 bp, synthetic construct
  misc_feature 1..26: note = Synthetic Construct
  source 1..26: mol_type = other DNA
cagggtgtttgttatcctctctgact

SEQ ID NO: 16798 - DNA, 23 bp, synthetic construct
  misc_feature 1..23: note = Synthetic Construct
  source 1..23: mol_type = other DNA
cccacctgtcttttgatcgcatt

SEQ ID NO: 16799 - DNA, 22 bp, synthetic construct
  misc_feature 1..22: note = Synthetic Construct
  source 1..22: mol_type = other DNA
gactgggactcgcaagcaaact

SEQ ID NO: 16800 - DNA, 23 bp, synthetic construct
  misc_feature 1..23: note = Synthetic Construct
  source 1..23: mol_type = other DNA
tcgtacagcaaaaacctgacctt

SEQ ID NO: 16801 - DNA, 22 bp, synthetic construct
  misc_feature 1..22: note = Synthetic Construct
  source 1..22: mol_type = other DNA
gcacttttggaacccagccttt

SEQ ID NO: 16802 - DNA, 19 bp, synthetic construct
  misc_feature 1..19: note = Synthetic Construct
  source 1..19: mol_type = other DNA
gctcaggcacccgatcttg

SEQ ID NO: 16803 - DNA, 20 bp, synthetic construct
  misc_feature 1..20: note = Synthetic Construct
  source 1..20: mol_type = other DNA
gcttgggcttcacccaacaa

SEQ ID NO: 16804 - DNA, 21 bp, synthetic construct
  misc_feature 1..21: note = Synthetic Construct
  source 1..21: mol_type = other DNA
cggggccctttcaggaactac

SEQ ID NO: 16805 - DNA, 23 bp, synthetic construct
  misc_feature 1..23: note = Synthetic Construct
  source 1..23: mol_type = other DNA
attcaaggaacaggggaccaaat

SEQ ID NO: 16806 - DNA, 22 bp, synthetic construct
  misc_feature 1..22: note = Synthetic Construct
  source 1..22: mol_type = other DNA
tgtttaggcaaggagcctgtag

SEQ ID NO: 16807 - DNA, 23 bp, synthetic construct
  misc_feature 1..23: note = Synthetic Construct
  source 1..23: mol_type = other DNA
gccacagttcatacctacacgaa

SEQ ID NO: 16808 - DNA, 24 bp, synthetic construct
  misc_feature 1..24: note = Synthetic Construct
  source 1..24: mol_type = other DNA
tctctgccacccaagatctcttta

SEQ ID NO: 16809 - DNA, 22 bp, synthetic construct
  misc_feature 1..22: note = Synthetic Construct
  source 1..22: mol_type = other DNA
ggggaagttgcacggtcaaaaa

SEQ ID NO: 16810 - DNA, 22 bp, synthetic construct
  misc_feature 1..22: note = Synthetic Construct
  source 1..22: mol_type = other DNA
caccccagctgtagcatgatga

SEQ ID NO: 16811 - DNA, 25 bp, synthetic construct
  misc_feature 1..25: note = Synthetic Construct
  source 1..25: mol_type = other DNA
tccctatcccataactcgctattga

SEQ ID NO: 16812 - DNA, 21 bp, synthetic construct
  misc_feature 1..21: note = Synthetic Construct
  source 1..21: mol_type = other DNA
cgaaggccttggaccttcctt

SEQ ID NO: 16813 - DNA, 22 bp, synthetic construct
  misc_feature 1..22: note = Synthetic Construct
  source 1..22: mol_type = other DNA
ctccaggaacaacttgggtcat

SEQ ID NO: 16814 - DNA, 27 bp, synthetic construct
  misc_feature 1..27: note = Synthetic Construct
  source 1..27: mol_type = other DNA
gcatatgcagaaatcacatggcaaaag

SEQ ID NO: 16815 - DNA, 22 bp, synthetic construct
  misc_feature 1..22: note = Synthetic Construct
  source 1..22: mol_type = other DNA
gcgagactggttagcacggtta

SEQ ID NO: 16816 - DNA, 20 bp, synthetic construct
  misc_feature 1..20: note = Synthetic Construct
  source 1..20: mol_type = other DNA
cctcagctgcagccttcaaa

SEQ ID NO: 16817 - DNA, 22 bp, synthetic construct
  misc_feature 1..22: note = Synthetic Construct
  source 1..22: mol_type = other DNA
cgttgtgcattcctctgcttgt

SEQ ID NO: 16818 - DNA, 19 bp, synthetic construct
  misc_feature 1..19: note = Synthetic Construct
  source 1..19: mol_type = other DNA
cgtcatgccgccagtcttg

SEQ ID NO: 16819 - DNA, 22 bp, synthetic construct
  misc_feature 1..22: note = Synthetic Construct
  source 1..22: mol_type = other DNA
ggaggcacagctacttcccaaa

SEQ ID NO: 16820 - DNA, 20 bp, synthetic construct
  misc_feature 1..20: note = Synthetic Construct
  source 1..20: mol_type = other DNA
catgccttgctgtgttgcat

(The sequence listing continues in the following parts.)

The invention claimed is:

1. A method for amplifying and sequencing DNA, comprising:
   isolating cell-free DNA from a biological sample and tagging the isolated cell-free DNA to obtain tagged DNA, wherein each tagged DNA molecule comprises a universal priming sequence and a molecular barcode;
   performing universal amplification on the tagged DNA;
   performing a first targeted PCR to simultaneously amplify 10 to 1,000 target loci using a first universal primer and 10 to 1,000 target-specific primers in a single reaction volume;
   performing a second targeted, nested PCR to simultaneously amplify the 10 to 1,000 target loci using a second universal primer and 10 to 1,000 inner target-specific primers in a single reaction volume, wherein at least one of the primers comprises a sequencing tag; and
   performing high-throughput sequencing to sequence the amplified DNA comprising the target loci.

2. The method of claim 1, wherein the biological sample is a blood, plasma, serum, or urine sample.

3. The method of claim 1, wherein the method comprises subjecting the isolated cell-free DNA to blunting ending, dA-tailing, and adaptor ligation, wherein the adaptor comprises a universal priming site and the molecular barcode.

4. The method of claim 1, wherein the second targeted PCR is one-sided nested PCR.

5. The method of claim 1, wherein the first targeted PCR comprises simultaneously amplifying 20 to 500 target loci using the first universal primer and 20 to 500 target specific primers in a single reaction volume.

6. The method of claim 5, wherein the second targeted PCR comprises simultaneously amplifying 20 to 500 target loci using the second universal primer and 20 to 500 target-specific primers in a single reaction volume.

7. The method of claim 1, wherein the first targeted PCR comprises simultaneously amplifying 20 to 200 target loci using the first universal primer and 20 to 200 inner target-specific primers in a single reaction volume.

8. The method of claim 6, wherein the second targeted PCR comprises simultaneously amplifying 20 to 200 target loci using the second universal primer and 20 to 200 inner target-specific primers in a single reaction volume.

9. The method of claim 1, wherein the isolated cell-free DNA are tagged with up to 1024 different molecular barcodes.

10. The method of claim 1, wherein the isolated cell-free DNA are tagged with 1024-65536 different molecular barcodes.

11. The method of claim 1, wherein each target-specific primer of the first and/or second PCR has a concentration of 1-50 nM.

12. The method of claim 1, wherein each target-specific primer of the first and/or second PCR has a concentration of 1-20 nM.

13. The method of claim 1, wherein the first and/or second PCR comprises an annealing step having a length of longer than 2 minutes.

14. The method of claim 1, wherein the first and/or second PCR comprises an annealing step having a length of longer than 4 minutes.

15. The method of claim 1, wherein at least 90% of the amplified DNA map to the target loci.

16. The method of claim 1, wherein the target loci comprise single nucleotide polymorphism or variant loci.

17. The method of claim 1, wherein the cell-free DNA comprises DNA from mixed origin.

18. The method of claim 17, wherein the cell-free DNA comprises DNA from a fetus.

19. The method of claim 17, wherein the cell-free DNA comprises DNA from a tumor.

20. The method of claim 17, wherein the cell-free DNA comprises DNA from a transplant.

21. The method of claim 7, wherein amplified DNAs of multiple samples are pooled and sequenced in a single sequencing lane.

22. A method for preparing an enriched deoxyribonucleic acid (DNA) fraction of cell-free DNA (cfDNA) useful for analyzing target loci, comprising:
   (a) extracting cfDNA from a biological sample;
   (b) producing an enriched fraction of the cfDNA extracted in (a), comprising: (i) tagging the cfDNA to obtain tagged DNA, wherein each tagged DNA molecule comprises a universal priming sequence and a molecular barcode; (ii) performing universal amplification on the tagged DNA; (iii) performing a first targeted PCR to simultaneously amplify 10 to 1,000 target loci using a first universal primer and 10 to 1,000 target-specific primers in a single reaction volume; (iv) performing a second targeted, nested PCR to simultaneously amplify the 10 to 1,000 target loci using a second universal primer and 10 to 1,000 inner target-specific primers in a single reaction volume, wherein at least one of the primers comprises a sequencing tag;
   (c) analyzing the target loci by performing high-throughput sequencing to sequence the enriched fraction of the cfDNA comprising the target loci.

23. The method of claim 22, wherein the biological sample is a blood, plasma, serum, or urine sample, wherein the target loci comprise single nucleotide polymorphism or variant loci.

24. The method of claim 22, wherein the method comprises multiplex sequencing of the enriched fraction of the cfDNA from multiple samples in a single sequencing lane.

25. The method of claim 22, wherein the first targeted PCR comprises simultaneously amplifying 20 to 500 target loci using the first universal primer and 20 to 500 target specific primers in a single reaction volume.

26. The method of claim 25, wherein the second targeted PCR comprises simultaneously amplifying 20 to 500 target loci using the second universal primer and 20 to 500 target-specific primers in a single reaction volume.

27. The method of claim 22, wherein the first targeted PCR comprises simultaneously amplifying 20 to 200 target loci using the first universal primer and 20 to 200 inner target-specific primers in a single reaction volume.

28. The method of claim 27, wherein the second targeted PCR comprises simultaneously amplifying 20 to 200 target loci using the second universal primer and 20 to 200 inner target-specific primers in a single reaction volume.

29. The method of claim 22, wherein the cfDNA extracted in (a) are tagged with up to 1024 different molecular barcodes.

30. The method of claim 22, wherein the cfDNA extracted in (a) are tagged with 1024-65536 different molecular barcodes.

* * * * *